United States Patent 6,812,339 (POLYMORPHISMS IN KNOWN GENES ASSOCIATED WITH HUMAN DISEASE, METHODS OF DETECTION AND USES THEREOF) - sequence listing, part 40

SEQ ID NO: 14033 - DNA, 784019 bp, Human
  misc_feature (1)...(784019): n = A,T,C or G
gtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaataataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattgcttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagattttgccagaactcatcttggctttgtttacatttttcttttaaacgtataagactattgatggtacctcaccaaggttataacccctttataatcattaatttttaatctagaaaagagtcttggagacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatatatgttagagggtggggagagagttcagtatgtcaggactgctacatttatgagtgtgggtctttattgaagtctctctttgtagccaatccttttttttttttttaatttttaaattttaaattcttacttttagatatgggggtctcactctgttgcccaggctagagttcagtggcacaatcatagctcactgcaacgttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaaggagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccgacctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcctagagaaacctgcacacttgtgtctccacctttttacctcttgcgggcatgagtctggtctcagtaataacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagagggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgagcctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagagaagggctttgtccctggccccaaagactcagggagaggtttactggccaggtagaaagggcgtccaggtgaagggaccctggttcagtgatctccaacctgcacgtctcatttgtgaggaagccgtagggtgtggacttttcttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcgtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcgtagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccagctacttgggaggctgagacatgaaaatcacatgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactatctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaagataaagaaatactttgcaaatcagctgagcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatttattaagagaatggatattttcatgtcagaaattataggaaggatacagttatgggatgaggagcaattcttttttttttttttttgaggtggagtctcactctgtcaccaggctagagtgcagtggggcgatctcggctcactgcaaacctctgcctcccgggttcaagcaattctcctgcctcagactcccgagtagctaggactacaggcgcgtgccaccacacccggctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgtgtgtgtttcggatcccaggttccaaacctgcactaaaacttgttgctgcatctcacctaatcgtgtagtgagccaggtgagctcatctgtgaaatgcagacctttctggacgtaccacctcgtggggtgaagggaaagaaatgatacaggtgtacatcagggtataagctgtcctagagtctggattctttttatccagaagccattctttcagcctgtgcctttttgtaaataccataccccatctatttccacaaaggatttggggcattagcgagtaaagggggaatatgttctagaagaagggcgctcacctcagtaaattgatgggtgggccacaaaaatcatgtcacaagatcttgttgatgtgcatgcattcattcattcaacaaatattattgagcatctaacataagccgggtgctttgctagggacagaatgctgtacaaggtccctgtcctcatggggaccgtatgttgggaagacagatgataggcatggaaatgaagagacaaaccactccgacttcagcccaggaaggagctttaatttgagtaattgttttcactaattcatcttcacagaaagaaataatatgatcaccttcggttagtaaacaaaacaaataggcaaacaggtttacaggctgaggtgggctggatcacttgaggccgggagtttgaaaccagcctagctaacacggtgaaacccttctctactaaaaatacaaaaatattatctgggtgtggtggagctttcctgtagtcccagctactctagaggctgaagcatgagaatcacttgaacccaggaggtggaggttgccatgagcagagatcgtgccactgtactccagcctgggtgatggagcaaggctctgtcttggggcggggggcagggcaggggaggggggaaagaagagaaacagctttacttacgtttttgatgagcctagcctttgctgtgctttggaaaatgggctgtggaatttggctgaaatagtcaaatgcgtagctggctgtatgtggactgataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcgaattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctctgtctcccaggctggaatgcagtggcattttctcggctcactgcagcctccgcctcccaagttcaagccattctccagtctcagcctcctcagtggctgggattacaggcatgtgctactacccccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgtaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaattagtcggaggcggaaggaaatgcaaaagtggacatttactcgagaaagaataaagaaaccatgcaggattccatttcacaaacctctacagctgttgctggggagtcagtggaggggtactggaggaaggcagactttgttctaagctacttagcagccaaggaaagcagaagaaactattattattatttattattattatgtgagttggagtctccttgtgtcatccaggctgaagtgcagtggcatagtctctgctttctacaacgtccacctcctgggtttaatcgatcctcctgcctcagcctcccaagtagctgggattacaggcacccaccactacatccagctgacttttgtatttttagtggagacagggtttcaccatactggcccagctggtcttgaactcctgacctcaagtgatctgcctgcctcagcctcccgatgtgttgggattacaggtgtgaaccactgcttctggcctagaaactattattaatagaagttctgggacaacggccctgctctcattacttgcccccaatccatgcaatgaaatactggcctgtgagtatgtggtcccttcagctcattttctgaagctgaccaaaggagcacagtaatgcataacgggggagtaaaattcctcaagacgagcaaaaaaggcagaaattaataaaactctatgtattagttatctatcactgcataacaagttacctcaatatttagcaggttaatacaatgcacattcattattttatagcctttgtagattaggaaccagccattgcttagctggaccatctgctttagagtctcacaggctgcattcaaggtgtccactgggctggggtcaacttcttaccgacaaagctggtgccccaaaagaatggggtcttatcctgttgggtgtcatgaagccaacacacaaaaccgaaagtagtgtcaagcagtacaggctttattcaatggccatggaattgagaagcaggagcatggctcacaaattcacaaatcagcttctccactaatgaggggtgaggaagttaaaatatagactttgttgttgttgctgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgcttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatatgtaatcctaggatttgttgttgttttgttatgattttttttaagcaggaagctaaaaaaaataaccacccgttactttgctgcttttagaaaataggtttgagattgattttgaatactaaagtatagttttcatgttataaagccaaccatgttaaaaatgtataataaagtatctaatttagcaaaattcaaatttcccctatgaaatatcaagctctttttatgcttcttcacatggcaccttgtgtagaatttgaaccactttaaacattgcatccttgagttgcatatgatgggatctcttgaatcatttacattttgaaaaaagaaagtgaaatattctttaagaagccaaagtaatccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatatttgccggatccaaaaaaaatactgtgtatcaactactgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctataaatataaaagagcaagtaatgaaattaccatggctgaattctgaatattaacccagagcagatttcctctaagaaagatcataagaagatgcttaaaagaaaacattatatttcaaaagaattaggttctgaaatatacccaataatgaaaacaatacaattttcttctgctttttgtccttcctgttccaagcactgggaaggagctggcatatttcttatgtatgaaaagtagaataatatattggattcctttatccctaacccggaagagtctttcttggactgtggtttgctttcccgttatacttaagcttgtttattgcatcttccgatgtcacattatctcattgccaagctaaaggctctgttgggttcttagttgaacccagagtggaggccgatttcatccaaagccattttttttaaaattagaaattaaactcacctttggcaagtcctcctgaccagggatgggtcctcatgttagtctgtaatgtgaagatatgaaatgtatttgatacaataggagattcactgtgattttcactgaatgagtatacattctgcagaactagaagataaagataataaaacaattcacatttcttaggactaatttattttccacagtccactaccaacatggtgggatggggaggagctgagaagagcatatttggctgagtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttgctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggtcatattaatgcaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcataaaaagagattgcgtaacaccctttgaacaaatggatatttgagaaccatcctgtcttcagatttagattttttcaatttttttttactgtcatatgattcacatgctagttactgattgctatcatgcagtctgccagcagaccagatggcagatcttttaattagatatgtttgtgtgtgtatgcatgtgtgtgtacatgtaatcacagttcatcaaggacctaataaatacttttttctctctctctctttttttttttttttttttgagacggagtcttattctgttgcccaggctggagtgcagtggcggatcttggctcattgcaacctctgactcccaggttcaagggactctcttgcctcagcctcccgagtagctgggactgtaggcatgcactaccacacctggctaattattatgtttttaatagagactaggttttaccatgttggccaggctggtatcgaattcctgacctccatgtgatcggcctgccttggcctcccgaagtgctgggattacaggcatgaaccactgtgcctagccttaataaatacgtatttatgtctttcgatctttttctgtttttctacattccgtttcccctatggctgctattgttttccagtgagctatttatatatatatatacatatttttgagagggaatcttactctgttgcccaggctaaagtaccatgtcaagattatggctcactgcagcctcatgagcctcaaccttcttggcctaagtgatcctcctctctcagcctcccgagtagtttggattacaggcacctgccttcatgcctggataattttttgtatttttgtgaagacgggtttcatcatgttggccaggctgcagctatttatatcttatatgtgtatttgtaaaaaatttattcctcagccctgtgtggtagctcacttctgtaatcctagcactttgggaggctgaggtgggaggattacctaaggtcaggagtttgataatagcctggccaatatggtgagaccctgtctgtactaaaagtacagaaattagttgggcatggtagcggtgcctgtaatcccagctgcttgggaggctgaggcaggaaaatcgtttgaacccgagaggtggaggtggcagtgagtggagatcacgccacagcacttcagcctgggcgcatgagcgagactatgtctcaaaaaaaaaaaaaaaatttcttattcagttgatttaagatggtttataaagacaacatgagctagcggtagaaatgcgaatggacgcttgtagacagtaaggactcaatacgtgggtttgttcaagttatattgtgcagacaggcatatgcagttagaaaatctgtctagggtagggagagataaaaccagctacttcagccctgctatttttatcctgaagattttttttttactctgtttatgaataaaacattttaatcagtgctgtatcaacactgatcaatttttttcatggaagtgtaatacagggtgaattccattaagtcaattaaatacttagatccagtttttaaacagtgcgaagatagttaagctcttcttttattgaaagcctttttaccaaaaccatttttttttattttatagtgaagatttcatgtatctgttttctgtacatgccaagttttacagctttttgtatcatgagttttcttttgcatcaattatttctaccaagtccaacttgtagattgggcagatctggatttcaccacacctggtttttgttgtcattgagtttttgtgatggggtgatttcagtgagaaatatatgccattaatttgatgaaaaatcagtatttatttattaactaatacccaagaaattccccagcaagcctcttccagtattctagagtttctcgtttcttgaggattggtctccgggcatactcctaatctaattgtttcccaaactttcaatgttttggatgactttggaagccttgatttctgtaggctgtagcaggacaaattctgatggacagatcaagatgttctatgttgctctaaaacagcatctctcaaacttttttggaccactatctaagttttttctgttaaaacccaatacatttatacttatgtatattcgtgtgtgtgtgtgtgtgtgtattatatgcatgtgtgtgtatttgtctgaaataaaagttttacaaaatgatacttttatctgagcagtgtcctgctgttttttttcccctaggttgtgtttttgtgtttttgtttgtttgtttgtttctttgtttgtttttgagacagaatttcacttttgttgcccaggctgcagtgcaatggcacgatctctgctgaccccaagctccgcttcccaggatcaagcgattctcctgcctcagcctcttgagtagctgggattacaggcatgcgccaccatacctggggaatttttttttgtatttttagcaaggttgttgatcaggctggtctcgaactctcaacgtcaggtgatccatcctcctcagcctcccaaagtgctgggattgcaggcttgagccaccgtgcccacctgtgttttttgttttgtttttgtgtatgtgccaatgatgacccagtttcaataccaactgttgctttcaccacccactattggtttcaccaccccgctagatcacagtctgttctttggcagtcactgccccaatactgtttgatgtgctcccctctgataaatgttcattgagtgccccacatgtcaggtactgacttaaggcatagcaaatgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaaatcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggctataggccaggacctgtgctatgtagcttatctatttctcatgctgattctacttttgttactaccgaaggagcttagagggaatcagtgacgtggacaaggctatgtaactaaagggggtggaggaggattcaagccccttgcaacggactgaagtgcccaagctctaaatccctgccacccacagcctctgttggccccaggttgtgtctgagattcagaggttgtttttatagcagcaacacagtaagttgggaagagggacacatttttaacatagacaccaaaagagaggctggaagagttgaccacttagaaatgtcacgagtgtctgtgaatagtgttgggggctgagaggcaagagaagaaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctctttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacatgatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctacttgttctcttggttccttcaaagtaatgactaagtacaggtctttagatagagagctgcaccaaccaggtattgcttcgtgtcttccacgtacgtcctgagaaagcgaaggtgaatttcaccaattggtaggtggaaatagaaaaactgttgattctttttttcattcaccaatcttttttttccccaaatgctaagctttatttggggaaatcttaacagccgtttttataagactctgcatttacaacatttgtgggggctgcagaggacgcacatgaaaataacatgaactggccatgtacggtggctcatgcctgtaatcccagcactttgggaggccgaggcaggtggatcacctgaggtcaggagttcgagaccagcttggccaacatggtgaaacctcatctctactaaaaatacaaaaattatagctgggcgtggtggcgggcgcctgtagtcccagctacttgggaggctgaggcaggagaatggcctgatcccgggaggcggagctttcagtgagccaagatcgccctactgcactccagcctgagcgtgagactctgactcaaaaaaaaaaaaaaaaaaattagctgggcgtagtggcaggtgcctgtaatcacagctatccagaggctgaggcaccagaactgcctgaacctgggaggcggaggttgcagtgagccaagatggtgccactgcactccagcctgggtgacaaaaaaaaaactttacctgggcttagtaagttgcctgacttctcatcctggagttcgtatccccttgtttctagaagagaaatccctcagatgtgaaggtgtgttccatgattttgtcgaacttgccctacatactgttttattatatattctgcccacttctattccctgccaattaattaattgtttcattggtatagtttttttttttttttttttgatacagggtcttactgtgttattcaggctagagtacagtggcgtgatcacagctcactgcagtcttgacctcccaggctcaagcaatcctctggcctcagcctcccaagtagctgggactattggcaatgccaccatgttcggctaatgtttttaattttttatagagacaaggtttccctatgttgcccaggctggtctggaactcctgtgctcaagccatcctcccacctcagtctcacaaagtgctgggattacaggtacaagccaccatgtcaggccattggtataccattgtttttcttaaacatttatttattttcttatatttacagcatatgtggtcatttaaaattattttatagcatataaaagtaaaaagaatataaattaattttttagcattaatattagggaagataatctgacatttaaaaatacatgtctatatgtgtatacatacatagaagtatatatataaataccagtactagtgtctgctaataggtggcgccactttttatctgtgtgtgttgggggtggaattagcatgtagaggttggcaaaggggacaggagactgtgggatgattagtatattcttatttggcctgggagggaaaaaaaatctttcatttccaacaatattcattctctgtgtcacctcagcatttaatttacttccgtcacaaaactacttgaagttgtcccaggctagttggtcctattaattacaacctagagggattctattagtaaactaatggattacagtacctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactggatatttccgagtggcctacaagtggagcgtgatttcatctttcatcaagagaagcagcttttcctcctcttgtatccgttttcttccttttctaactatcaaggtcatgcggtatctgccattttgcatattcttgctttgcttcatgttttccttaaactctgtgcacatgaatatttgtggtatatggcttaattgtaagcgatcaggcatcaatggctttttatgaggcaaaatctactttctgcatttgcgtgtgccattattatagattgctgatgtttgccaatggatattcttggaagtcgtcttctggtttaaatgcagttaagtatttaaaaataataccagtgacatgtttgcatttacattcagcctgaaggcctacttgatgctgcaactgaaaaattgttagactagattttattttattttaattctttttgagacagggtcttagtctgtcacccaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttccctcccttccccaccctaaagagtctcgctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagaggcggagtttcaccaagttggccaggttgttctcaaactactgacctctcctcggccttgcaaagtgctgggattataggtaccccgcctggctgatactttccttagttgttttcagtgtaataacctgtcttcagtctactctttgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatgggatccacaagatggagtgatctttacgccatcctcctgaccataaatactaaatgaatactctatttcagttgagtttttagtttgctctgttacgtgaggacacatcacttgcacctcagtgtgagtttgaaagtgttttctctggagaataattctgaagaaataggccctccagatatcagtagtgacaggggtatcagtaatgttgattactaagttcttgccacaggtagaagccatgctactgcacaagtttcatacttgaagagtggacatctgacacagtgttggtggttgttgaagtgtatgactattactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatcctgtatttgacacagcccctcccagcattctgagtcatcgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtggaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcaaaaaccctcacaggtcacgcctgaataccttcaatgtgccccatgtaaaaatacactgcaagtcgattggacatgccctatgaattataccttatttatgatcgtcgagccctcccttttcccgtcatgctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagcggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacgaggcagcgggcactggggcagccacatagacaacatctaaatttttgttgctttcctgggtcttgccctgtccttactgtttcccttgggcacgctgttcaccccttaggacatactacagtaaccttttcccaccaccgtgggaggactgtgattttgtaaatgtcctctgatctctcctctttgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccgtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccagttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttttgtttgcaaatgatcacctggtaatttaagagggtgagctaaacttcctccttttctagtatggacctttggggctcaggatgaggatgttcaatttgtactgctggtggagctgcctttccattaagtgagtctttctccaagggaacagaagtcttaggttgttgatctggcggtcagaacctaggacaggcaaggcagtgggctgttgtagaggagatgaagctgatcagagcacacccacaccagtgacaaccggtcaggacctgggaagggctctgacccattcatctgagagatgtggcatgaggaacactgagacctaatgcttattgcttaatattgtggacaagggactctgtgggttgtctagtactaagcagaatggaagggaaggatggaaggaagagagggagagacggagggagatggaggatgacagggagatggagggaggcaaaaagaaaaagggagaaggaaagagaggaaagaggggaagggaggaaggaaagaagagagagaaggaggaagagagggaaggaggcacagaggtagagaggcagggagataatggagatcctggccaaaagttaatgctccgtttctagtagtccacagaaagcaccttgaccaagtgactgaatacaaatcgtatcacaaactactaggatttcttgggtgcttaccatgtgccatatttccttgaatcttcatgacgatccttcaagggatccttgttttctaaagggtaaaggtgcaggttagaggctatgtcagaagcaagtcaggatttgaaggcagatctgtctgcttttgcccctctgtaaatccagagctgctgcctcatttcttacgttgcccccacccgtgcagcaattcttcctgggaggcctcattgttcatattcataaagggccccattcagtctcctttttggagaaatggccactgcaactctctgttctgacctggggggaaatgttagaccctcaataaggagaatcagagaaagaagaaataaaacatattactccattcccatacttctgtgaagaaatacccgagactgggtaatttataaagaaaaagagatttactgaactcagtcgtttcacctggctggggaggcctcaaaattatggcagaaggcaaaggaggagcaaaggcacatcttacatggcagcagacaagaaagcgtgtgcaggggaactgccctttataaaatcaccagatctcatgagatttattcactatcaagggaacagcacaggcagatcccatggctttgactcagttacctcccactgggtccctaccatgacacatgggagttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataccttttcattagtaactcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtatggaaagcctgttaatgagtacaagtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatcgtgttacccaggatggtctcgatctcctgaccttttgatcagcctgccttggcctcccaaagtgctgggattacaggcgtgagccattgcacccggctattgggtacaagtttcctttggggtggtgaaactgttttggaactagaggtgatagctctacaacactgtcaatgtactaaatgacactaaattgtacactttgaaataatttatgttatgtgaatttcatctcagcaaaaagaggctaacacataaggagacatattttgatacatgtggcatattaagctgctgttgttgttttttaaatattccagctgcgtgcagtggctcacacctgtaatcccagcactttgggaggctgaggtgggtggatcacttgaggtcaggagttcgagatcagcctggccaacatggtgaaaccctgtctctactataaactccgtctctactataaatacaaaaattagccaggcttggcgctgggtttctgtaatcccagctacttaggaggctgagacaggagaatcacttgaacccgagaggcagaggttgcagtgagccgatatctcacctctgcactccagcgtgggcaacagagcgagactccgtctcaaaaaaaaaagcacaaaaaatttttttcttccatctgtatcacacagttgcaacgttgtagcatgggcaggaaataattgggttgtatgtaatgcccagtaaagtaaacagatcttagagagggacaccgatccctaccctgcatggggttattcacagagccatggggacactaaacgtaccttatctcttgaccatgctattgattagttatgtgtttgcctgtgttattaataatgtatacattgaaaaatctatgtgcattatagtctttgatcttgtcatgaatttcaaagccaaagattccattttccttctttttaaaaaaaatttttcaaagaggtaggctggaagtaaatttaaaaattttcccctttctggcagagggcttttttctgatcaccacccatgttaattagatatgcatgtatgtgtatgtatgatgtatatacccatatacacacagtctatatatacatgtatgcgcacatacacatattttaaggaaagaattataaaatgatcaattcaagcttactatatgctagaggtgaggaatatttgaatacaagtcttatctagtagattaaaacagaaattaaagactgtagactaaggcaggatcaaaggacctcttttcattgttcttttattgtttattgacttcaaaaaagactttttagtttaaactgactgtaatgtctcttgaatggtcttttgtaaaatgactttgaaaactcggggataatgtcttcattaagtggagaaaaatcttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatacttcatacaaagctatgaagcatattggaagattttaggtgccctgtcttcctggatataaaatgactccaaactcagtgatactgatcaccctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacattttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaaccccacgtattgttgcaacggcaaaaaagagaattgcacagaggaacaccacctatcagagttcacactgagtttgcagattcatccttttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattacaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttgttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcagactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacaaccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatgtaagatccataatgactcttgccaattagcaggctgctctcttccaagtggtaacccagggactcaagctcttttcatcttgtggctcagccgtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgatgtattgtttgtttaaaatcactttggattctcatttaccttttccccctcaagatctttgtttttgactttggagataaccagaaataactaagcatgcttccttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcctcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgattgacctacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctggtattttcactcttccttcctaccctggatgctgatttgatgcttccagccttagcggttttcttgcttctaggactgaacagggaagagggaaaagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgattgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatataagcaatagtccctgaacatcatttggcctgaactaggctagagtttctcttaatcaaaataataacgatgatttttccatgccaaggagtggtgtcatatcatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgttacctaattccaatgtttcactttattcagcgaagacattcctttgattattctggttaggtgttatgatgccaatttgcccacacattttttcttaggcgcctatgcttgcagtagacagagagttgaggaaagctcaaggttaaaacaggaaaaagtaacacagtaaatacctatttttgtgcataattcaaattaaaaccccaaccacctagaagcaccaatacaaggaactggctgcatattgcattcctgtgacctgctgtcttaatgatggaatgactaacgaggatcagagggaatgtggtcagcctcttatctcataagccaaatgctgcatattccaagcctgtcaattctgaaagcccttgttcatttttaaataatgaaaaactttggggccttgttcattgtttctaaaggaagacatttagaaaatttagaatataaatttctgttagtagaaactaatttctcttgcttttctctaaagtatacttgatttgaaatatgtgccctgaagttttgctatgttgaaaaaaatgatgagccgggcacagtggctcacgcctgtaatcccagcactttggaaggccaaggcgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaaaaaaaaaaaaaaaattatgtcatttcgttgtcacagcgtcagcagaataaatcttagatcaagatgggattactgcgccactcccttcttcccagtctgtggtttagcacgggaaaaagcaaactagggcccttgggccaaatctgatctgcagcctgtttttgtgccgcctgcaggagaacatttttaaattgctgaaaaaatatgaaaggaaaaatatttcaaggtgtgtgaaaactacatgaagtttaaacttgagtgtccttaagtaaagttttataggaacacagtgttgcttatcttttatgtaatgtttgtttgctttgagaccgagtctcactctgtcacccaggctagagtgcagtggtgcgttctctgctcactgcggcctgcatctcccacgttcaagcgattgtcctgcctcagcctcccaagtggcttggagtatagacacgtggcaccacgcctgggtaatttttgtagttttagtggagacaggatttcaccatgttggccaggctagtcttgaactcctgacctcaactgatagacccacctcagcctcccaaagtgctaggattacagacatgagccgacctttttatgtattgttgatacagtatgacaagggaagagttaactgattgcagcaggttagagcacagcatgaagagctgacaatattgaccgactggccctctcagacaaagtttgccaacacccaggtgagcagatacacttatctgtgagcagacgtgattcaggggagattgttgtccctcctttcctaagaaaatgtggaaagatgagaatgttgccaccagtgctgatatggagcgttttttttggaattgtcttaaacaagtcccaaccttgactttgcctgtgtaccctactctttactcccaggtctttgcaaggtaagctgtcaggtgttagctgaagatacggcagcccaccagtggtcccctgaatgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaattttaagtgttaacattgttcaaattttcattactaacacctctcacattgttagaaaacagttttatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccctcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccgctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgactttcatcttgatggacaatgagtactcactctacttttttagtttatatttttattttagttcatttcatttaagacagcgtctgttacccaggctggagtgcagtgacatgatctcggctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatccaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtggatgaagctggaaaccatcattctcagcaaactgttgcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgtaacaaacctgcacgttgtgcacatgtaccctagaactgaaaatataataaaaaatacatattaaaaaaaaaagaactggagcatcgactttcgttttcatttcaagacccgtcccccatgatcacagaggatgaaaagtctgcttaaattataagctagctaattgcttcttcagttgaagacctaaatgagttttaaagtgaaatgcatatctctaagggctaagtagccaacacaataggcaattgagataggaaagactaatttagaaaaggttgttttgttcgtttttctttttccttccctcccttcctgatttcccatcttcttcctccctcttctctcccctctcccccttctcctttccgtccttcctccttcagttccctctttcctctttttcacccttttatttaacattataaatacgatgggattgtgtctgcgcttttgttggtaattaaataaattatttatacatttaacacaatcttgaattaccaggtgatcatcttaggcactcaaaagcataagagcccttgaaagcaatatctaagcatagatattccatagcacgtcttacaatctaaatattgcttttagtgtaatcgaagcagcaagagtagtcacagcagttgatggactatttttcaaattgatttcaaaaatgtatttaaggggatgatcttctagtctagattacctattgatttttaatatgaaaagctcattatgtaagcagtaaccgcatataaaaacctagcaaacctttgcataaatcctttaattgaatttccagagcctgtggttctactttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagtgttcatgccgcaatgcacttatagcttgtgtgataggattatggaaaaaataataaaactaatttccaggggagaatttctaatgtgagattttattttttttcaatttgataattaatagtgaaatcatatcatatatataaatcatattttagcctataaactgaaatggcaattaggaaagataatatatacttgatgtaaaaccatgttacgtgcggataatcttttagcactttaattttttaattgtagaaggagagaattatgaattcaagtcaaacacattaaatggtgggtttcatccaaaaaatctgattcttttactatgtactgtattagtggatttataatattagtgggaggaagtataaaagatatggaaaaagatattctggttatgttcgtgctaaaatgtgtgtattagaattaccaggggaaagaaaaatataaaagctgcaataggtttttctattttttaatacctaacatttgttattttaaaagcaataaaatcccctaaagaaatattcgtaatcaataagaacacaaaatatggaatatattaactgagttataaaaatgtttgtagtatagcacagaatgaaaaacacagcaaggtatgtacggtttaaagtgtaatcaattttgaggttgtatacaaggatatacatgataaatacaagtagtagcatttttagtaaaggctgttacaaaatactgtatttatggcctattccattctttttatagctcattaatgtagaaaacaaacacagtgtatccatcttctcagacggtttaaaattcccttaaatgatgtttttaaatgtaaataactgagctcatttgatctggttcttccttaagccaatgttagcatgaatggccatatttaccaccccggggttccttttcagactccggaaagaaaaagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattcttccaggccacaagggggccgttgagttactggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagccttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcatgatggtatagaataagatattttcatagtgaaaatggagataagacatgtcccattccctagaatagactgtcactgctctcgttgcctccaaggaggaaactgttataggaatgattgacatggaggttcatctgtagaatatggacagccctctacaaattgggaacaagggccaggacacgaaatatagtgacagcctctggcctgggagtctagacagtggtgaaaggcaggattcatggagttttccaagataagattcaagacccaaactatgaatgaaagccaggctgaggctggcaccaagtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatgtaaattaattaaaattaaaagttcaattgctctgaaatagcagccacatttcaaatcttcagtagccagatgtggttattggctaccatattgggtagcaccgatatagaacatttctaccatagtagaatgctcttttggatacatctgctttaaagcattagtccccaaagtgtgaaggatgaaccacttgggttccgagaggaaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccgtacttttcaatgtaagcatattggctctcaatttaaaaatgttattttttacagatagtacacagatgcactgacacaggtaccctctccagtcctctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcaagacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaagttttgatgggaactttgcaggatgttcgtttgtttatcattagccctgggagagtcatccctcgcctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagagagaacctttccttacccaaagatttcgtaactttctcacatccttggttaaggctgagctgcctagctgtctgcatttctgataggttttgctttcatacacatttcaaggacttaagaaatctgtttctaaagaataacttagaatgtgcttgttatggtcccacctattctggggaataggtggatattatacatttatttaggtggaatggtgggtcagatggcttcatgtctttttacatcacagttccacagccctcattagtgaagcagaggttgaaggaggtcacttgctttttatcccaatgtcaaataactccataattttttttattattttttgagacagagtcttgctcttttggccaggctagagtgcagtggcgcgatcttggctcactgcaacctctgtcgattctccttcctcggcctccgtagtagtcaggactacaggcatgcaccaccatagctggctaatttttgtatttttagttagacaccaggtttcaccatgttagccatgctggcctcgaactcctcacttcaggtgatctgactgccttggcctccgaaagtgctgggatgacaggcgtgagctgccttgcctagccaaataactccattatttaagaaaaattaaccagtatttattgaatacttactgggccctgtgctaagtgctttccatgtgatttctaatttcctgaccattctatgaagtggctactataattatcctgatttcccaggcagagaaactgaggcttagagagttgaagtaatcaactgggtgttaaaaagctggtaagtggcacagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctcttcaacctaccttttgttggcttcaaggttatgccatattttgcaaagtcaagttggagatggctctcgatatgcatgagtgtgttagactgcttttcttctattttttaaaaatgcacccaaatgtaaaagacacttttacctttttgatttgatgttgaaggtcatttgaaaaatactctgtctttattctttgaaatggatttactctcaagaaagttgcatgtcactttacttggaagagacgggtctcagtgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcacaagatactaattctttttttcaaatgcagcatcgcttgaagctgtgataaaatatcacacctttggaaatcaaggctcttcttgtttatttatttaactcacattaattagccttaatttaaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatggcttaccttactttttagacataatttttgttttctgttaaagggtcagttatagataagtatgctcccttgcaatgaaatgaacccactttatcaattttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatatattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacctggcaaggcacgctctgctctgccctgccttctgatgagctgactaacaccttatagatgaggttcccttagaaccaaagatgccccatgaaactccctaggatgaatgttggaagtccttccaactgggattcccagccggaaaggaaacagttcatctgactacagggtttaggtttacatgtactttaaaaaaaaaaattaataaagtttatttttacagtaattttaagttcacagcaaaactgagtgggaagtgtagagtttcatatactccctgtcctcacacatgcacagcctcctccagctatgcacattttcaatgaaactacatgttcattgaaaatgatcttttgggtggttgatgttcgattttggctctgtgttgggcctgcccagtgaggtccttttgactccctaaggaaccctgttttgggtttcttttgaggttgaagatatttcagactctttccccctcaacttccataggaaccaaactctctttcttcctcccgtttggttggaaagttattttgcctcactgcgtgatttttctactgcaccaactcccctttcaaacgttattccacaacatactaaattaatgtatactgtgttctttgggtaatggggaggggagcctgtctcacagcacgcatttgttcagctctgtgttgaaagagcactgcccgccgcgtgaaggacatctgctcacaagtgagcaattgtgcttctgatttggggcagcacctttgcttgaacgctggctccagatgaaagaacagattgccgcggagccgcttttccaaggatccctctccccagcatggggcttcatatattattgagagcaaacctactttccaccgccactcctggatgcacttattttgcgagccttattcagaatgtcagcatggatcacttggcaacaaaggcctaaagggcaagccaggaagcttccatggatacgttatttatggtgtttaattattattgtacagatttattaaatgactctgttacctaggagtccatgtagttgctgaaaagagtttgctaactttgaatcgtagatgttttatctgaaaacaaaatttccttgtgaatgctgttaccatattcctggtgtctatgtgagggggtgtgtggtggtatgccggtaagtgttgaacaacctgctctgttggcgggaactaggggaaacaaaccctgttttgtagtatttgctgattactgtggtgtaaatactcacaccttggctgatttcaagttgcagcttggaacttggagttagaaagagatgtgtagtcccataccattttatgtatgtaaagtatttgcactatgccgactaatagacataaataacctcatgagcatagataatagtcacatctactaagattattcagaagtattgagctttgagtatgttttacctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttgaaacagtctcactctgtcgcccaggctggagtgtagtggtgtgatctctgctcactgcagcctctgcctcctgggtttaaggaattctctgccttagcctcccgcgtagctgggattacaggtgcatgccaccatgcccagctgatttttgtattttcagttgagataagggtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcctcccagaaaaagtagatgcatcagcagagttgagcccctgggcattatttccccaattccgtatcccatctactaatacaaactaatgagatctattaaggatgagtccacaagtttgaagggagtctcttactaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcatttgtactgggcatctgtcctgtatcttggagatgtttagtaacatccctgacctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagggatctcacaggaaacttggtaatgtagattttggaggacttgaaaggttcctgctacctttggctggggatggagggaacatggaagatgggtctttgtttagaggaagctctttatcctggtacgctggaagttggcatagtcttagcagttagtccagatgtgaatttcaggattattctgtgagtcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgggtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttctttatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtatctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgaggttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacatttgtgagctcttttttttttctaaccactttcccagtgagacttcagttttcattctccccttagcagctttcaaatatgtacgtaacacaaatgttacatgtttgagcatttaaactgaatttggacagggcttctatttccagaaccttctaactctatttctttgtgacctgatagtcttgctctccagggtaaaagaagaggatggaaatggctgtggggcgcctgaggtgggccctggcatgatggcaagttgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaactgttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaaattttttttttttttttggttgtggtggcgttggcttttacttggggttgacctttccttatcaaggacatacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggacggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagttcgttacttagactaggaaatggctccgagaagctcacccatcaccatttgctctactgcaaaacaggactcattagcaggagctcataaaatgaaactggcagtgagctcatatggaagaggcatcacgggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtcagctcctacaccatgagtgcttttgtatggtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgtgtatttaagctccagtggtactcgatgtgttgttttctttgttcttttttttgagacagggttttgctgtcacccaggctggagtgcagtggcagagtctctgtgcactgcagcctccgccttccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaagactcccctttacacattgccgttcccttgccttctactcctcttttcattacccttatcaagattctgcagcccagggtgctgcttgttgatggacatcttcacctgactttctccctggtccaggtgcattttaagcatggaaggtgacacttgccattctcaatggacaaagggagtggggagtgtgggggtgtgctttggggttagtctctgggttttcgaaacttagcattctcagattcccagccaactggtttcacatgacaagtaaatgagcaacctggaagatgagtggcgtttccacacacagggaagcagatagttccattaggtgacagtgtgtgcacagtttatggaggatgaagcggaaaacctgagccacaaggcagtagaggttggacgagacactcattccgaaggcgggtgtgtatgtgcaaactgtataatttttttcttcttttctatctgctagcaaagtgggtaagttgacccatgacatggtccactggagggaccacatttgtgactctagcaattaagcctcccttctcatctgtggataaaactgacctcccagtgtgctggagtcaaacatattcagcatccaatccacattggactgtttgcatgtaacgtacagaacactcattcatctacatctaggaccataacagcgagcaggagacagtccctgaccctggggactaagcccaggacctgccactaggagatattcatggaatcactgtttctcctccttttcaaagaagactgaatttatgatgaaactttcttcgtatattggctttgagaaattctgttttggtgcttatgtgctctggataattctcaatgactttcaaagttatgattcagggagtaattggttctgagagaatatgcataatcacatcaaggtgtgtttgttttccaccatttgtagccttttgacaaatttctgggggcctcatgcctgctaggccgaatacttgtgtcccttgagcctggagacggcaagtacccagtgtgcatgcatgcactcccaaagtcctttattcacgacagacatcactaatcaatcagtcatgcttagcatactactccaagtagtcattactaatcatctctagtcagcatgggagatactctttaccatcccggtaaagtgacgttttgatgaaaacagcatggatcttcctgcagagaacagactagccccctgtacagcacacaactcggggaattttaggtctggtgatttactgctgttggagcctggccttcttcctgggagaaggctggaaaaacttcaagtcagttacttaatggaataatacatgtttcctgcttccattgtcttcctggacctgacactcactctttaaccataagcagaagacacatacaaaaatgtcctatgttaagaatctttatttaagacaggtggctagcattatttgggtccagaagcttccctggaaagaaaggattcactgcaagatcgacaggcttacccagttcatttaggcgtggctcgattaatgcacacaaagctttgggaacatatcagtcacatcaagctaggtccacctgtgtgagtaagtaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgagaataatgagctaatatgtatctagtaattgctatgcacttatatgtatagaagcgtataatccacagcactccttctgaatacgttacgtaaatggaaccctcgcaacagtcttatccccattgtagagatgagaaaactgaggcatacagaagggatggaactaggccaagagcatagaggtggaattgttgtgtgagcctgtagagtccgtgttcttacccactgcatgatgtctgatcatcgtcaattttctttccatttggacagatgaatggtaacacttccctactaggtagagcaatgattccagaagtttataataattggaaagtgtattagtcgattctcacactgctataaagacattcctgagactgggcaatttataaagaaggaaggtttagttggctcgtggttctgcagactgtataggcttctgcctctcgggaggcctcaggaaacttacagttatggcagaaggtgaaggggaagcaggtaatgtcttcacatggctggcactggaggaagagagaaagtagggaggtggtagatgcttttaaacaaacagatctcaggagaactctttcacaagacagcactagggggatggtgattagaaagcacctcatgatcccgtctacttcctgcagagaacagactagccccctatgcagcacacacctttgtgaggtccctcctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaaagcattaagcaaacaaaaggaaataaaaacggcaacaaataaaacttctgtgctttttgaaattttgtttttggcaggcaacattccaaagatctttttcatttaaagtccaggagtcttctgtgtgaaccccacacaggtaccttggaaagactgcatctcctggattttgcatggttctggcttaatggacaacatatcagtcattttttgaggaaaataaatttaaggcttggttatcggtccttgagtcagcacattgagcgttttgtcaattagctcctccccccatctgtatggtatggcttttcctgtaattacagtcaagatcctatagccggaggaaggcctgtcaattgagtaagaggctgatgttcatcgcacagtgacagcccattcggagggttttaggcctgtccttagagaggcttgttatttcctctttcggtactttgttgcaacctagttcaccgccatcagatgaatggaggtttcttatgctgtggcgaaacccagggggtcaagcccctcggacatgacgtactgcaaagtgaggatgtttcattgatttgtatttttaaaattaaaaataattatttaagctgcatctgtgtgcttataagaaaagatatagaaagattagtagtagactgttgtgttctttttttttttttttttttttttgagatagactcttgcctgtcgcccaggctgcagtgcggtggcatgatctcggctcactgcaacttttgcctcctagattcaagcgattgtcctgcctcagccttctgagtagctgggattacaggcgcccgccaccacacccagctaatttttgtatttttagtatatacggggtttcaccatgttggccaggctggtctcgaactcttgacctcaggtgatctgccctccttggcctcccaaagtgctgggattataggcgtgagccactgcacctggccagtagtagacttttgatagggtttttttttctcaaggtgtaggtttggctaggaagtcatagaaaatgctctttttttttttttggagatggagtctcactttgtcacctaggctggagtgcagtggtgtgatctcagctcactgcaacctccatctcctgggttcaagtgactctcttgcctcaacctcccgagtagctgggactacaggccaacgccacggcacctggctaatttttgtatttttagtagagccggggtttcaccatgttggccagggtggtcttgaactcctgacctcaaatgattccctgcctccacctcccaaagtgctgggattataggtgtgggccactgtgcccggccaggaagatggtcatgttttactttgaagcaatctgtgcttggtttatttttttcagtgagtgtggattacgtttataattttcagttactagttaggtaaagaatcaaaattaataaacacatttatagttctcagagattccttgagagaggaacatctttaaatggataaccacagtcttctaaacacctgaaagggtgtcttttgctgaattatggagttttagttttgctttagaatttttggatgattagacttgtacttcttttaggctatttttccacctggtactatttggctttactgactgccctcattccccatacaccaccttgttttgttcagattcccctaagtcttcattctcgtcccacctccccatcactcctgactacttgaaacacgacttctgtcctcagaaggcagcagtgttccctcctcccgttcatttttcattttcccgttgcttaaaaaaatcaagcatatgtttgcagtcatcactgatgttctgcctcctcttctaaagttatagatgagtgccaagttggcagagcatgtagaaagatcactgcagatgtccttgtcgtgttgaccttattggagaatttcctatctgtgatgacctgtaaatggaatttaagggaggaatcacacgtgttagcacggggttggcattgcgtggctgttttcaattaacttgaccactatcataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggagtccctttagacaacatcactgacaactcactatgtaaaaccaaacaaattattagctttcttactgtgtgtttgcatttgctgtgcccagggaaatgggaagtgcattgaggaagaggccccaagacaaggagaagtcactccaactttccgggaacaccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggccaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatctctgctcatgcttgagagtggtggtgtttggaaagactcaatagcatatgcacatgaggaagttgaccaaatgattccacagcgcatactcattttttgctctgattctagcttttcctccaattttattcagaatttgttcttttcttacctcacaccatatagaaaaatcaactcaaagtggattggagacttaaacataagatctgacagtgtaaaattagtagaagaaaacaaggaggaaagctccatgacactggtctgcacaatgagtgtttttgtatatgaaccgaaaaacaggtagcaaaagcaaaaatagacaactgggattacaacaatctaaaaaatttctgtacagaaaggaagcaatgaacagagtgaagcagcatcctacagaaagagagagaatatttgcaaaccacacatgtgataagggattaatattcaaaatgtacacacagcgtaaatgcaagaaaagaatctgatgtaaaaatggcccttccaacatctagcattattgtgtgttgaataaatacttgttcgattaggtctaatcactcttcatgattggatttccaaaatgtggactctcagcagtacattacagggacagtggttgggtctggagatgtcacccttagctgtttttcacaatgagaggttgttttatcataaataaatcaataaatggcagattatacaccggagttactgagaaatataaaaaaaaaaaaagcccacattttaaagggaatttggtatttttaacaaagcatcagggggccgggagcagtagctcacgcctgtaatgccagcactttgggaggccgaggcgggcggatcacaagatcgggagatcgagaccattctggctaacatggtgaaatgctgtctctactaaaaatacaaaaagaaattagctgtgcgtggtggcgggcgcctgtagtcccagctactcgggaggctgaggcaggagaatggcatgaacacgggaggtggagcttgcagtgagccgagattgtgccactgcactccagcctgggcaacagagcaagactccatctcaaaaaaaaaaaaaaaaagaaaagaaaaaaaagcatcagggttgtcaccatgaagcaggaggagaaaaataatgctgttagacttcttaaagcgtattttgtggtttattttattgctctgtaaattgcaggctgtaattcatggggctcaggccagtgatttcacagttgatagaccaggcacatctcttcccaccccttccccacctaggggcaaggttttcaggaagagccccttttctaaaccacacatggcctgctcacaaatcttatgataaaactctacccactgagaagcacaaggtgtgaggctattgatgaggagttgaaggtgacagagactgagaaagggctgcacacctttggcctaaagggtaatgagcaacacacaaggattgggagatgttcatggcaagaaaaattcagaagggacattgttgtttcactaattctgtaaaggagagcagcggcatttacttaggccgattccccattctctctttctgtttttaaacagagacagatcttgctctgttgcccaggctggagtgcagtggcatgatggcatgatcatagttcactataatctcgaactcctggtttcaagtagtcttcctgccttggcctcccaaaatgctaggaatacaggcaggagccactgttactggtctgtttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggcccttctctttcctcgtgatgcacggtgatagtgcgtatctaacacttgaaggtgtccacgctggccctagctcagtgagatggctttgctttgggggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctaagtggtcaggtgggactcatggagattttccgttctttggagactagcagcgactgcagattactcatcagctgtctccttgagtccacaatgccgggcggtggacgggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttcttccttcctccttttcttctttctttccttccttccttcctttctcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctttctctttttttttttttttttttttttgaaaaacttttttggagcagcacctgcatgttgtaaaaacacaaaataaaaaaaaaataaataaaagcagaccccttggttcagatatctttgtttgtgtaaatgttttggcattctttgtgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctggctctctttcaaactgtactgctcactttgggctgtacgttagaaccacctgagaagttctttttctttcttttttttttttgaggtggagtcttcctctgtcacccaggctggagtgcagtggtgggatcttggctcactgcaacctctgtctcctggcttcatgccattctcctgcctcagccttccgagtaactaggattacaggcatccgccaccatgcttgggtaatttttgtacttttattagagacagagtttcaccatgttggccaggctggtctcgaactcctgacctgaagtgatccacccacgtcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagttaacgtagaaggtttctgggggcatggacctgagtcttatcccctttgcaaaagtaagaattgtatcgtagcctgactcagggttttagccaacttctctggatgctaatgctattctcttctttatacttgtcttccctcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcgtttgatgacatgtcttggcagtgatgtctatgacactgggcaagtgtcttaaaatgttgtgcatcagaaaaaagtcatcattgccaaggccagcagatctcgaaaagggggctgggacacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcttcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttgtcagaggtgcatgctgagagcatgatgggaagatggagtcttccatccactggtaaaatctggaatctgctctcatttcattttcactgaactgaaaataaggtaacagaccctcaggtctacctataagtaccttccaactgttccacttttgtaaatttagttcaaataatacatatgctgaaattcctatatcccccccatactccagatcttcagtgtggaatttaaatataattccttattgtaaaaaaaaaaaatttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataactgaaataccaggtgtatagaaatgcatctgtggaaaaatgaaatcatatattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcgtacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatgtctgtgcatcagggaggatgggagaattaattccagtttctcaattgcaaaagtgaggctggtcatggggcttggaaccacgccacggacgcatgaagcctccccgtttacatgccaaatccagagcttaggcatccatgctcagggctctctgtggtaggcaacagctggattatttactttctagaatatctcgagttcttaatctgagcagtttcgaaaccaagcccacattaattaatataaataatgactgggaaacgttgcaggactccccggaaaagaatgtataagttgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcctcagcctctagaatgcctggagtgagaaaacagaatattgttcttttctgtttatattatttcatactgagttaacacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcgagcactggatacctagactctgctgggctctagagaagtgctgggctacagcgcccagtgccctacctcttggggccagccagcctcaccaaaaaatcaggcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatgtgattctgtagagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagccccttcccgacccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcctactcacatgtttatggcccggtgagaccgcatcctccctttctctatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgttttttttttttttgtacagagtcttgctctgtcgtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccgcctcagctgcccagggtgctgggatcacaggcgtgagccaccgtgcgcgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaaataagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcattttacagctctggcatttctgggtaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattagaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggcctttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctagacctcacacccagtccctattcttaggttttatttctcaaaccaggttttgcctgagaaattacagcaaatgattcagagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgcgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggcaacaaagagagatcctgtctccaagtctgtctgtctgtctgtctgtctgtctgtctctctcggaaatattccttcagtgtattagtaaagaagttacttatgagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgcacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatgcttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgatatcaccattgaggggagcaagatgacatgtgcctaccccacgtgtccagcagcaaagccacctggcatagtgggctgctcagcgtgcctggttcatactgcgtatttatagtcccagggtgttttcagagagtaaaagtcctttatgattagcaaattgcaggtcctcccctttctgatatttacagcccttgcaaccgcctgtacaaaaatcgggaaaaggcagaagacggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcgcgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttagcaatgcaacttgcacttaattttaaaacgctggaaaaataatgataaagattgtgtgatcaagtatagcagccctgtggtgtttcctcagaatggtgtattacagaaaaggaaaaagccatatacatggagaaaaaactcccgatatttaatattatcaattgctggttcctgtaaatttgcatttatggatcacattataaaagcaattactcttatggattgttcatgcagaaatgcattatgatgataatatacttttaaaagtatatttatttccagaattcaatttgtaagaggtttgagggaaaaataatactgagttttgagtgtttctgattttaaaaatgtgttcagtagaattaaacgtgttcaccaaaacccattttatccctttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttactttgcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttcaaagatgctaaattatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcaagtatcttactgtatgatggttgcttttgggttgaattccaccttgggttcaattcaacatgaaagttaaccttttggtgaaggaatgatccacgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaacgggagcgaatagtattttccaaacttacgtcaccacttaccatccacctgcatactttacacgtcttggaatcaaccttacagggaacacttggtcgaaaaacagtgttttctaaatttatattacagttcccactccccccgcccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccgttgagtgtgtgcatgtacaactgcttgaaaacagcttgtgagttcactattaggtccatgaaatttttctccttggcaggttttcactattaatttgcttgacaaaggatagatacattttccatgtgtggaggtaaaagcagtgcagtgagctaaaaagttagcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggcttgcaatttattattaagtggaataagcagtttaaaaacagtatgtacagggtggttttctggctatataaacacacaggcatagaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagcctggccagtgtggcaaaaccccacctctactaaaaatacaaaaaaaaattagctgaacctggtggttcacgcctgtaattgcagctactcaggaggctgaggcaggagaatcacttgaacccgggaggcggaggttacagtgaaccgagatcgtgtcactgcactccagcctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcaatcagtctctctccttccatccccccttgtcccccttttctcttctctccccttccctgctccctctactttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggacacgtgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgagcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttgttattattattaatgttattttttgtttgtttgttttttgagatggagtcttgctctgtcacccaggctgaagtgcagtggcgtgatctcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttataattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctactttttgtttagctgtttttctaatttaatcttgtacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatggtaaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaacctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatcccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgttgttactgctgtaagccactttcttctccctctccgttaaaatgcaacttaattggtaaagtttagttgactagagatttcatttatttatttatttatttatttatttatttatttgtttgtttgtttgtttgagatgagtcttgctcttttgcccaagctggagtgcagtggcatgatctcggctcactgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggtttttttttttttttttaaagaatgcgttgattttgtttttctttcttttttttttttttttttgaggcaggccttaggtctggcacccaggctggagtgcagtgacgtgatcaaggctcactgcagcttccaactcctgggctcaagcaatcttcgtgtttcagcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctcatgccattctcctccctcagcctcctgagtagctgggactgcaggcgccagccaccacgcccggctaattttttatatttttagtagagacggggtttcaccatgctaaccaggatggtctcgatctcctgacctcgtgatccaccagccttggcctcccaaagtgctgggattacaggcattagccaccacacccggcccaaattttcttataaagtcaaatgggagatacttgtttgcaagaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgtattttatggttgcagagcacacgtatcatcctatctgcttctgacacccagtaagcagctctggcttttataattttgatgaaagaagtttcccaacagtatttcggtgtgcatgctcacacaccagccctggtcgtcagtgaacagattcttccaggtcttcattgtggcggaagaaagtgagatcagagatcccgaggaagggcttcagtttcaccagtagtggagctagggagtaggggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacaggtgtcccccagattggatcctctgctctaggacacattcttgtcctagagcaggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagctagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtaggaatgaacagatgaacaaccccacacaacctaaggacaactttgaatcaattcttctaagctggtagcagaagccacctttccatttgacttgtatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccacccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgctacatttaatctttatggtagcctcatgaacaggctcttatttagttcagtggttcttgatcaggagtgatattgcctgccagggaatgcatgtcaatgtctggagacatctggggttgtcagttcaggagggtagaggataggggggaaaaggtgctactggcatctagtgggcaaaggccagggatagtgctaaggatcctgcagtgcaaaggagcatgcccaccacaaaatatcagcagtgccgaggttgggaagctctgtgccattgtgcaaagattcaaggtggctatgtcacaggactggtacatgtccttttttttttttttttttttttgagacggagtcttgctctgtcgcccaggctggagtgcagtggcgtaatctcggctcactgcaagttctgcctcctgggttcgtgccattctcctgccttagcctcccgagtagctgggactacaggtgcctgccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaacctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttaggtaggggtttgaggaaaatgaaaaggcctatttgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttcctttttcttttcttttctttctttctttcttttttttttttagggagggtctggctgtattgcccaggccggagtacagtggcacgatcttggcttactatagccttgacctctctggctcaagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccgtgggctctttttggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttccgtgttgatgaagcaggaaatttccctgacccctttgcaggcaggaagtggagtgcggatgctggaactagctggctgctttggtgccagtagaggtgaactgcactctcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttcagtggagggtcagcgtgacagccttttgcacccacatctgggttcttgtccagtgtccaggaggaatgaggtctcatgagcaaattttaaggatggcaaatgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcataataatttttaacattgattgagtgtggataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcgtgagtcttggcatctttttggtagagaaccttgctaggttctcacaatgtagaaattaagcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggaggctgaggcaggtgaatcacttgaggtcaggagttcgagactagcctggccaacatggtgaaaccctgtctctactaaaaatacaaaattttttttgtattttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactatattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcaattacctcccacctggtccctcctgcaacatgtgggaattcaagaagagatttgggtgggtacacagccaaaccatatcaaaaaccatttacaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccagattcaaagttgtcctgggccgcatgtggcccaccagccatggtttggacaagcttagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtagccccctcccgaatgcgtcctcagaactcgctggttctcgtcctcgccctcagcatacttgctcattgtttgtttccatctctatcatctctgtgagccctttgaggatggatgtgtgtccatcttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaaaataaatactagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaaccctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtggcattttggcatgattggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttattttattttattttttttgagacagagtctctgtctccaggctggagtgcagtggcacaatctcagctcactgcaacctccacctcccgggttcaagcgattccactgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcccccaagttcctgtccgctggtagaattcacaaagctggttttatgtctccttctcttcctcttccagtgttgtcttttccctgcattgagatagcattgcatggagatccttgtactcctcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaacaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgcgtagcttcatcatagatctcagcttaaggacaatgaaagtcgtttattgagtacttagtatgtgctggttgcagagccaagtcttttttttttttttttttttcctccttttttgagagagagagtctcactctgtcacccagactggattgcagtggcacaatctcaactgactgcaacctgcacctctcaggttcaagcaattatcaggcctcaacgtcctgagaagctgggactacaggcatgtaccaccacactcagctaatatttgtatttttagtagaggcggggttttgccatgttgtccaggctggtcttgaacacctgacctcaggtgatctgcctgcctcagcctcccaaagtgctgggattacaggggtgacccaccacacccagccagagtcaagtatttcaagtattagagttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattactgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcaatggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaagcggggcaaggggttggagaatgttcatatcacattattttggatgtctggggttgcacctggaagctcagatagcaatatctaggcacggctgccagtgctctatacattcacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctgtgtttgacatcgagatagaatttttcataaccctttactagtaataaatttgattgttaagggaccgggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacaggtgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttcccctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacggcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagagcatgttttccctctaaagagaggcagctgataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatccgattcagtacatatttataaaaccacacttacatttaaatacaggcctttcccatttcacagtgtttctagctcccctttccaatacatctctctctctctttctctctctctctctctctctctcacacacacaacacacacacacacacacagccaaatcagacaccaacataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagtgcagtgacatgatcataactcatggtgacctcaaattcatgagcccaagcgatcttcccacctcagcctgagtagatgggactacaggcatgtgtcaccatgccaggctaatgtttaaaaatttttcttagaggtagagcctcactttgctgcctaggctgatctagaactcctggcttcaagtgatcctcctgccttgagctcccgaagcgctgggaccaatagagatttctctgagaattaggtcccccactattaataaggtcattgtcagctgagttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagagcccgccactgcactccagcctgggcgacagagcgagactccgtctcaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacaaattgttcatcaggtgtatctccagccctccgtaaacactgccggatggatgaacctacgtaatgatctcctggtgccattttcctgactgtagatacttgggtaaggaggagactttgactctagatgacatgatgtaccctgtgttctgcaagctggagaacatcatgtagaatctgaaaattaggagagagaggcaatcagaagaagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttcacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagatccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcagtgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttacctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatctatctctacaaaaaatttaaaaattagctgggtatggttgtgcactcctgtggttccagctactcaggagactgcggtagggggatcacttcagcccagaagttcaaggctgcagtgagctgtgatcgctccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacaccagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaattcacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaacaactacccaaggcctgttggaatgtctgccagtttcaacccacggggatagggtgagatgaacattgattgagcctttacatcggagacactataacaaatgctttgtgtacatcagctctttcaaattaatacaattctactagaggggacactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgctatgtcctcatatcgggggaggggcaaagggtctctctatctggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaattcaacatacgaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcagatatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcagagaaagttggatcgaccattaatcatgctatctcgacttctgtgtgtctcctttttgtccatctcttaaatcagtcacttggcagcagcaagacatgtggccactccagaccatttgatcgaagagctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaagcctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgtcattaaaagttctcactggatcattccatttatactcagagtaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataaaccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgtgctggggatggcagcagagtggggtggttggatgggaaggcgggaaagagctagcttggagatgatacgcttttccatccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccactgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgtttgctcttcgcgcctgtgctttgaatggtgaataccctcggcgggaggcaggcacctgatgccactgcccccgccccacctgcccccgccccgtttctcagatcacacaggcaggctgaggagcgcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttacctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacatgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcacgcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacaggtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaagctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagttgttccacagatactttgagtgcagtacaagttggtaatgggtaacaggctaaaccatgtggcaccccttccctcttatcagcttcttgctaccatgcagaaaagtgctgaaggtggcctgccctaaggcagtagcactagagcagggatggggaggacttggtggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacctagcatatgaaaacagttctggctgatgggttggtagaagtgatagatatagatacatatatacacatatatgcacagtaatagatataggtaaagaccttgatatatgtacatatattgtatgatacatatccatgcatatacgtgggtgtacacacacaggtacacacaaatatatatgtgcctttggacaaaaaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcataggcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccactttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagtgcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattgtcgcacctcagcctcccaagtaactgggattacaggtgcccaccaccaagcccggctaatttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacgtcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttctacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaaccttcagtctgagttgggtaccttgcatcctcctttgttcccatactaacccctacaaccatggtcattttgtggttatctgtttaattctctgctggctattccaggctgtcagctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctctggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttaatcgtgtgaatgtattgcagaaatggacaggacaattctcagcccattcatcttacagacctcaagtgaacaggcacaaaacaacaggctccaccctccttcccccctctatctcatactttacctcaatttatgacttggcttacaatccgttgcagaaagcctagctccccagcttctcctgaatctacgtttttctattttgtctgaactagccaaggtctctggagtttgctgttatattgcttcagagaaattagtgacattgaaaggctgttgtcttttttagtgtacttttggttgttaggagaaatttacaaggccatttttttctcccgtctctgcagttcaggagattatattagaaaatattctatacaaaaaatatgcatagtagggcttttctccagctagtagctcagaataagtcagtactactgaaacaggtaccttttgtggaattgattctgaaatctgtttggatctgaaatctttctttcttgcctttgagtaagatacggcagagaaaaacaattacactagctgctggtctgtatttactggttagaatagaatattattaccatcaagaataacattagtggccaggtgcggtggctcacgcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgcctgtaatcccagctacttgggaggctgaggcaggagaatcccttgaacctgggaggtggaggttgcagtgagctgagatcacgccattatactccagtctaggcaacaagagtgaaactctgtctcaaaaaaattaataataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctctagctctcacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccctaacctcccaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatcgctcccctgaatggaggtgaaagcatgcaagctaggagttaagatctttaactcagggaagaccctgtctatggaagtgctgagctcttcagtgtcatcacagaaaagcatgagcccctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagataccaataattaatatctatggttgattgtaaaaatggccaccaattcttccctgtcccctgcatatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttctgggtgcgaacaagcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatgaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaaggcaagtagaaaacgaaaacaacatcaaaggatacactacacaattgttggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcagtctcacctggtcaagatgtcagtagggcttgttccttctggaggctctaggggagaatctgtttccttgcgtttttcatcttctagaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagtagagaatataagctttatccagggggccactcagtgatgggagtcttccttatgaagctgtcccagctccatctctcaggactgaaatgtgggtaagaccatcacatttttcatcccccgccccccgcccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgcctgcctgaggctctctttctggttcccagatggatgcctttgtgtgtcctctcatggcagagagaggaaggggtctggaacctttctcttataaggatactaatcccatcgtaccccgtcccccatgatctcatttgaaattagtcacctcccaaagccccacctccaagtactgtcacactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgctgccttgggcctgtggcttctcctccctgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgataggtgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccagggtggtctcgaggaggcccattaccggctggagtgacagagtgtgtcaagcctgcagctcgtcccgtgtctaatggaacagaaacaagcaccctgctgcccttgttttccagtggctcaccggggctctgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgagggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctccgcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctatcagtagatgcatctaataatcctaacactgtcatccttatacttgaggtcttattgtccacttctaccttagctatgtaaacagatgagtaacctactctggatttacccagatagtgctgttaggcaccacacacgatgagattggaggcacctgggtgtcagcctcttgggctggctcattacaggccactctgtctgaggaacactcaggtttgcaaaccgtttcttaaaattacaggatacctagggacctgttggggtgggagggaagaaccctatgggcagaaatgtgactttctgtagcaaagatgtactgtttcccactgagaagaatcaaaaatagaaaagtgcttccttgtctctctatattgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgtgtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttttgggtagaaggaacagaaagtgaaacggtgccctggcaaggcaaagattattcattgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttacataggagaatatatacagtatgattcaatttatagaaagcttaaagtataggcaaagctaaacattcaggatatttgataaaactataaagaaaaccaagggaatgaagaatgcaaaatatgagctagtgttttcccaggtgtgagggacggggcatggttgggaggaaaacagaatggtgccatggcgagagatacacaggggaggtattggaaagttctgtttcttaaaatgagtgacaggtacctaggtagtcattctatatgttattaaagtgtacacacattgcttatgtgaagtcttgttatatgtggcacatatcacataatctgaaagaatctgcttcctgtagtaaaaattaaaaaaattatagccgggcacggtggctcacgcctgtaatcccagcactttgggaggccaaggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtatcagatacttggctgttttgttttttcttcttagccattttgacctgtgagattttatgtgatgaaaacataagaatgtggtattacaccctgtgatttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgctgactgttggctgttggctggaggtacccctcagctcctagaggcatcaacagttcctgaatatctgggcttttcccacaaagcagcttccttcatcaagccagcaacaagagtttctggggcaagttggtcaacaagatggtgtcttacatgcccaatgtaatcatggaagccatgtatacctcatcacatttgccagatttctgctgattaataccaagtcagaagtcctgcacacattcaaagggaggacactgcacaatggtgtgaataccaggtggtagggattatgtggggccaccttacagtctatcagccacaacttgaagtatcttctctcctctttgctgccaaataatgtctctgaagactgtaagacctgaatcctatctaaagttgtcggtggttgcttccttcctgaaagcaacaagaagcccatgaatgtcttatggcctgaagatctgccttcaaagactactacctgtgttgtcacaaatggcaagatttcatcctttttatggctgaataatatttcactgtatatgtgaaccacatttttaaaaatgcatttctgaacctgaaggacattatgttaagtcaaataagccagacacagacagacaaagacatatgatctgactaacaatgtggaatctgaaaaaaccaagctcatagaatagaaacagagagtgagaatggtggttgctggggctagggggtcagtgaagtggggaggtgttgatctaagggttcaaacttctcgttaataataaaccagttctggagatctaatgtacagcatgagtggtgatggatgtgttaattaattcgattgtgataatcattacacaatgtatatagtaatcaaatcattactttatagaccctgaatatattcaatatttatttttcaattatatatatatatatatatatatatatatatatatatatatatatatatatatatatatatatatatatatatatatatatatatatatatatatatttaaagctgtcatggaaagccttaaagttaaaatacgaagatttttgagaaaaactttgcatattttaattgctgtctggaatcctccttcagctgggatgagaaatcatctctgggttagttctgtccctggaggtgagggccagacaacacatcaaaactgactttttattttttttcaaagttgttaagactatctaagattcagatctccctaatactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtctgatttcaccccatcctaagatcttgtgacttcagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgttgcatagaatgactctcctgtatgaatttttaaaagaaacttcaatatgctatgcatttgaaagggaagaagtaatcaccataatcttgaggtatcttttaaataggcttcctgcgcagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagctatgatgtgttttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcaggagcatcacttgaggccagaagtttgtgaccagcctgggcactatagtgagaccctgtctctactcacataaaaatattagctgggcatgatggctcataggtgtagtcccagctactcaagaggctaaagggggatatttcttaagcccagaagattcagactgcaatgagctatgattgtgccactgcacttcagcctaggcaacacaacaagaccctgtcccttaaaataaatgctgccttgggtatcttaatcctttctcaagattccttctaaggctaacatttctttgccatccccacactaccatctgctcacttttatatatcttgaccattttatttttcatcccatcttcactccatgtaattagttagctattgctgcagaacaaatcaccccaaaattcagtgattagtttataggtagccccatttcacccatctcattctatagctcaggttgaaagttgagtcatgaattggggaacattcttctcttggtgtaaattagtcaccagtgtctcatagggttgggctgaaacttaacacatcccatcactttgattggctaaagtcagttacataaccaagcccagcttcagaagggaaattgtatgccttacaaggaggtgagaggatggaaaatgaatatttgctgaacagactttctgtccagtttgttgtatttggtggtggtgcagggcaaatatatgtttaaaaccttgttcagatttttagctttcttcagaacagagcttttaaaactgagcatttgtcccctaaattccagcactgcggccatgagtaaagggtgccctgaccacgagcaaatcatttagctggctcacctttcatgcaaccttgaattcaccaggaaggaagttcatgcagccctgggtatgatgccctaattttgagccaagccagctagagttcaagtccaaaccattccacttcctagctttgggacgatgaacaatttacttatgctttctgggctttggttcctaaattatttaaatggggatgattacatacattcatcattttcaccttctcaaagaccttctggacaattccccaattcatagctctgggagacagtgtgttgacactctatttgaccacatcttcctagcagtcttgcggaaggtgccactttgcgaacgatctgttgctaggtaatgtcaatgacatgactttcagtttagcacatgtacagatgaccttgtttgggcttgtgccgttggtaattcagtttcaggatttccgtttgacagaatatattcaagggtggtttcttgctatcagttgtacccttgtggccacagtttttccagataaccaagactcactaatattttcacaagaacatttgtcacctaggtccagatttcagaggaaaaaagtataccgccattgttcttgtataaactttataaaatatttggggaacatcactagccacctgcttccgaaagtacttagatactgtgtcatcttaatacaagacactatgcactaattaagctgttgttgatgcttttttgcctttttgacaattaaaaataatctcataccactggattagtctcttgcctttcaattttatgtttatatacaaatatatgtgcataccaaattttatatatatatatatatatatatatatatattttttttttttttttttttttttggtcggagtctcaccctttcacccaggctggagtgcagtggcgcaatctcggctcactgcaagctccgcctcccgggttcacgccattctcctgcctcagcctcctgagtagctggcactataggcgcccaccaccatgcctggctaattttatgtatttttaatagagacagggtttcaccatgttatcaggatggtctcaatctcctggcctcgtgattcacctgccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattgccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttcggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgaatataaaccagggggtaggaaacaacatgagatgaggctggcgagagagaaggatgccaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactatgtgtgttttcacttcttctttctttagagaaaacaaatatcatctgccttgctaggtagttgtgagaaatgaggagataatatctttaaatctcctacggtgatacctggaacatgatggtgcttgggaaatgtctcttcttctgaaatgaggctgcctcgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctcccaagttcaagtgattctcctgcctcagcctcttgagtaggtgggactataggtgtgtgccagcatgcccggctagcttttgtatttttagtagagatggggtctcactatgttgcccaggctgacctcaaactcctgcagtacagtattgcaccttcctcggcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgagcaaaagacacagaaaggatttctttatcgtaagcacacttctctacattacctttataatccaacaactctgctattagtaaattatagaaacaacttttgtaacactatcttgtttgcagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttattaaatgactttaatcatatgaaaatcagccatcagccttattagagtggttgattttttttttaatctaagagctttcttggttattttctgttcttaatcattgttgtatatccttaatgcgcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttattgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgggtttgtcatcctctatttgaaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcagtctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctcttgaagaagatgggagttaggagaagtgaatcttttgttttcgaagcctttgtccttgtgagtctcttaattggggtgtcttgtaatgcaaagtctttaaagatgtgtgttcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctcttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatcaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaaaactgaaacagtaattcccatgtgctgagtttgctgtgaggattaaagacaaggactgttctaagcccggcatataacgggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagttagcttaccagggggtggtgatcttaaaggggcaggaaggagccttgtggtatgctggaaattttccattcatctggtgatgtgatcacttggccgtgtgcacgtgtaaaagttcaagctatatgcttaatatttgtgcacgtcggtgcgtgtaagcaatatctcaaaacatttgagagaatttcccattcattgacagaatttttctcccgcctcggtcaaagcacacagtgggttttcccaacaactgaggtgcctgagggttgggtgccaaagaggcagaaaggccgagatgaccgcttgacctaattccctattcagctgaggcctccacccctggcctgttcaaaggcagttacggatcttttactcaaaacctgaacctaaaaagaaattctttagccatgtccgtgtgaactaaattcagcgtcagatgtacaaggctgtggttctgaccacccccgggctatttctgaccacaggacagcttaaatggtgtggcccataaaatgtaatctgcaaactcaggctgaatgttgatctatttagggccaagagaagaccaggccttggcagcagttctccctgaggtaggatcttaggtcgaatggagaccatcaccctggctgccagccccaggaggctggaaattcgttagcattctttatctttggggatcggccacttacttgtggggttgactcttacagcctttgaccacctcccaaaagctggattcactgatgggcccccaactcaactttcactggccaaagtacttggggttaatttagcaaaccccaggatccccagagggtccctcggtattgtggttttctcctcgcttccaccttatagtggctccaccaggacctcttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggcctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggtgggaggattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcaccctgttgcccaggctggagtgcagtggcgtgatcacagcccactgtagccttgacctcccaggctcaacctatcctcttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaaacgtgcatgaatctttcaagataagtgtcttattgattatcctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggatactgaggctcagagaaagtgaggtcattgagtcacttgagttcttgttgagtgttctttcctgctgaggtgtcctaggtgcctcttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaatgtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtccaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggctttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagagaaacacatataggataggaaaatagcttgccatgtctgatagatattaggcattcagtctctctctctctctctctctctctgtttattatagatagaaataaaaaaattataaatagaaatttatttctcatggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgacgtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggaccaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgagtaactgctctctgaaggtggaggctggactgcttcactggacagggtggcctggggttattctagtgcagtggtagctggtgacaaaactcaaagaagatgtaactagagaaaaggtactcagtgcagcctctgtgagctaccaccactgcctctagttttccagaaaaccaccactgaccactctctgtacagatgcgctcaagcgaccataaccaccagtgttcctaacaatgcgcctattgacttcttatttcaatagatatccagatttattatccctcaaggtaagcatcgattttacctttgtctcagtcaatatttacctctgaggtcaatacgtgtggatattcacctcagctgcagtcaatatccatttcgtattacaatatatgatgtgcatatgtgaaaataaagaacagcatggtacaaaaaaggtctgctaggcaaagaagctttttgcaaagcggatgtgtttttgttttattttttgtttgtttgtttttactgtgtcactttttagaggtcagattctatttcactaaataggacatatgtgtcttctgccaagatgtggaattttggcaaggctagcatgataacaaataaacattcaagcagtcacttaatgatattgaattgaacaccatttctcagaagttcctgtattaaattacaaccataagaacatacacaagcatgcagattgtaagtgtgatgagaatggaaacattccataggacgcagagttattcctcaagcccctggactcgcagagaatcaggtgtatgaagcaagaggaagaagacaagaatcaggaggcaaagagaaggaggaagaagcctcagtggggttgcttctttttatttcttagagccagagctggaagacaaggcctggcatattttggcaggcctggatcagagcctaggtgtgtaaattaggaattgcatttggctgctgctaacaaggacccaaacatggtggtaaattcttccacataaaacaacagaaaataagttgttttctggccctgggctggggtggccactccaccgtcatcgatgatccgggctccttttctctttctgctttgtgacattgcttctatcttcatgataactcgctgcccagaatgaccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcttgatgggggaatgagcatatatcaaaccaggacagtccaagtccttccggggactttgctgccacagttgacagggggaggtatttgcataacttcaccacacacagctaagctggtgatcctgctgcttggcagcatcttcccagcgtacaacagaggaaaactgcctgttgtagttaaaaaaaaaaagagagagagagagagagactgatacacaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacacttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtcaagaggcttggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttcctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagataattagcatagccatcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgttgtttctgctcattttttatattcaaaatttctaatcatgtgtgactatatatgtattatacatggtaggacttatttttttaatgtgaaagaatataaaacaaaatacgatattatcttttgagtgatatcaacaaaacaaaacatgatatccaaagtcaccctgtatggttggatactttgggtttgccatcttttcttttgttcatttgtttcatgcaatagaaacgttttgagatcctgtctggctgggttctgctaggcctgggtctacagcagtttgctgtcaaggtcttggcccttcaagagcatgtagtgtggtggggaaggtgtacatcagtgaagaggtaatccaggtcacggtgggatgacacaggctgctgtggcaacccacagcaggaatagccagtcctgccccagcagggcgtatcaggggtgctaaggtgacttccaagattgaggttggcgagttcgtgacaggtgtgcaagatggggtgttccaagactggggacaggacaggtgtgcaaggaccagccagctgaggtagaggaaacctagacctatggaacatgctgatttcaaggtccatttgtggggagaacacggactgtgtcattggaagccagcagggagaatcagttgagaggtaagccgggcctagtagaaagtaagcgaagccctttcattaagtgaacgaagggtgcatggtgagtacacagccatgaaaataaaatgatataaatcagcacggtttcagctgccctcccatctttctactgtgatctcagcagtgatggggctggctttgagggttggagatcacacacacacaatcagccagctctccaaagcaagccccacactctcttgatgctatcctcaataaacatgcggtctaaacagtaaccatgttctagctatgcagatgcagtttaaagacaaatcctttgagcctccagcatgcgatcccctcccaatctcattgctgctcccctaccctcttctgcgtagaagcgctggagccaggtgcttacgacctgggtgctagtatctttgtgaaaactgctcctgacctattgctttgtttattttagccggtgcctttgtagagggaaaacagcttagcaagcatttagtaggtagatccaaagtccccaggagctgttgggaagtccataggtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttggtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtatatatatatatatataaaatatatttccatgaatatactgaatgctaagccctccccactttttttttcttttttaaattcagaaatttctagttgtgtttattcccctcgtcagcatactttatcatatcaaagccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcaaacgttttgaaaagaaatctcctttcaaaaatcacagcactggttgaagcaggagcatctctccccttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattcccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcccaaggctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatccgatctcgtgagacttgttcactatcacgagtaaagcacaggaaagacttgccctcatgattcagttacgttccaccggggccctcccacaacacatgggaattgtgggagcgacagttcaagatgagatttggatagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatctccattttaagtattcttttctttccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggactcagatgtcactgtgcaggtgactcacgcctagaatcctctgcctatcgtgacagggagaagcctgtgtgaccctgtggccatctcagtctctgcagggcatctgtagctttggaggtacctgggcaagagactgcctttcctactagagcttctgccatccctctgtcactatttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgtaaacactgaattctataaactgttggagacagattctggagagacactcaggcttagctctagaaagaaacgggtaagacagaggaggttcagggcaactgtgttgccttccttgactggtgcatgggaattccccagcagagagaaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctggatagattttttttagacagagtctcgatctgacagccagactggagtgcagtggtgtaatctcggcttactgcaaccttcacctcctaggttccagcgattctcctgcctcagcctcctgagtagctgggactaaaggcacgtgccaccactcctggctaattttttatatttttagtggagacggggtttcactatattggccaggctgatctcgaactcctgcccttgtgatccacccacctcggcctctcaaagtgctgggattacaggtgctagccaccacacccggcctcttctcgatagatcttatttggctgacaacgaaagctgttgtgctggtagcatcatccctttgcatgcaaaagataaactgaaatctgaagtagccatatccttccggccaggtttttcaagtggttactctgttctgatcattgtcatgacaggaatagtgaaaataacaataaatcatttttctttaacgatccatttactgtatgctgggcactgcacaaaatggtttacatggtttatcttgtagcgttccatttaagtctgctaagagtagatgctatcattctctccattttacagataagaaaattgaggcttagagaaattgagtaatttttgccaatcctgagacttgaatctccgctctgtcttctgcatacactttttacttgtcattgctgattagctttctctttccatctccctgatcagaaccattctgcgttcttagattcaacaaaatgtaatactccaccttgccagtatctagcgtgttttcagaaattgtgaacggggtggaggtggagtactaactgcaatcagatgttttatttgtttatttatttttccttcttgcgttgctcttaagcccccactcttgggcaaggctctgtgctatgctgttttatgcacatcatcttctaacagcttctctgccacacctggagaagtgccaatatcattttcatggcacagataaggcattggatgctcatagtttaagtcatcaggtggtgactggaggagccagaaggtccctttgggcctgtcctctcaccagcatcaactgcaccaaaaagatctcattctgattatcagggatgaacccccccactgggtgatcaggcaaactacatgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacctgtagtcccagctactcaggagactgaggcaggagaatcgcttgaacccaggaggaggaggttgcagtgaactaagattgtgccactgcactccaacctgggcaacagagtgagacactctcaaaataagtaaataaatataaaataaaataaaaaatatgtcctgtaatgaaattgaaagagaacactttgtttcttatctagttggaacaagtggggtggggacagacaagtgactgaccactctccatctgactcagtgtcagtagactctctcaaaaattagaagctggctgacatagtggctcacacctgtaatcccagcacttcaggaggctgacgtgggaggattgcttgagcctaggagttcaagatcagcctgggtaacatagggaaacccttctactacaagacatagaagaaaattagttggccatggtggcacacacctatagtcccagctactaaggaggctgaggcggtaggatcgcttgatcccgggaggtggaggctgcagtgagctgtgatcacgccactgaattctagcctgggtgaccgagaccttgtctaaaaaataaataaataaataaaattagaatctgaattttgaagacacaaattcagatgcatgtggatgggcccaaaatactttgtttacatgtactccaaatgtaactcctggggcacccttccttattttctctaccacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctccctccttcccttcccccctccctccttcccttcctccctccctccttcccttcctccctccctccctccctgtcttcttccctccctccctcccttctttccttcctttctttccttcctccctccctcactccctccttccctttttccctccctctctcccttcctcccttcttttctttcctttttaaatgctgattttgttttctttttaaagccctcagttggcaaacttaaaagttgttaagtctgtgttagcctggctagctttttttttctctactagaccttcaaagtctaggaatgcctgatgtatctgtatcctgtgagtttgccacttcatgatatttgatatgtcattgtttccccataattttttcattgttagcgttgtctctccagcctcctgcttcctcttcctctgtctccctcatggtgtgtcttgctcaggcatgtcttatataatcaatatttagtgatttgacttcttaagtccttaaaaaaaaaaaaatccaggtgcaaaacacaaagacagggctcatgtcaagggagggaacctcgctcttctactctcagtgaaagaaaggcaagaccactccagcctattttttttttctttcccttggcccttgtcaaaagggtagccagttttctgttaccattgtgctaactgaagaatggaaaatatgcccagagtttaaaaaaaatcaaccaatgcctgccctttctagagcaacctaattaacaacccaaatgttaaaatttctttatttagaaactcagctatccagaattacaactccgcctctcgtgcttggaggcatagttctttgtcatattcctgagtgtctacagatgatgaaaatagccagttatctttgcccttcatggaaaggataggaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcacatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaagaaagaaaaaaaaaagggtgcttgatgccctgctcctgctatgtccgggaatttcttgtacccttcatatgagcccctctgaacaaaagcaaatcctgttgacctgtcagcttaaaaagacaagaaatatgccacattccgcaggaataaggagaaaagaatggtgcgaaaatcagtgacacgaagttgaatatgtgaacacatccagacaaatgtgaagccagcccgattaggacgactgaaagggcatttccccagaattgcagttttttttttttttttttttttttaaataggggacgctattgtcattcagaaagccacaggctgttctgaaaacaggcaaaaatcaatagcccacttgttgaggataagtgaattagcctgtgttgaatgtaactgagtacctgaacacttgagtgggcagggattgttggggagaaaagacaattgtcttttatgtccacagcggttcacatcgctgattaattatgtccaatgatcatttttgtgcaggactaatgggcagactctgtttttgtttttgtctgtctgcccacaacctggtgaactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttctttttttttttttttttggctgtctacagagaaggaggatataggggcccttaagagaaaaactggagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcaggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgggagatggaaccattttagtgcatttgatatgatgtgatgtggctttctccaagcctgagagtgcctgaaacccagagaggtcgtacgttgaccatgccacggggcccttcctggtaaatctaagcagaaatacaccatgcatgagacagaacaaagaaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccgtgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacgggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttactatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttttttttttctttctttcttttctttttttttctttttcccagactcctcatacccctcctaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagccatctgctaatccctgtgatttaaaaatgtgcgtgtttttagtttctgtctaatttcaaccttttcttgctttagtgattaattaccaggtttctctattaagagcttgtgcgtgtgtagggggtagcatagaataaacaggctcagagcccccacccccacccccctttaagtaacagtgacgcaaacgacctttatttagcagaaggtagctctgcgaatccgctgaatgtccgattgcgatctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacagaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgttcatcatttaattagagatttgcttattgaaacgactgaaataggtagttgaaattttgcccttggacaagggagtaatttgtgatttgctacgttcatttcgtgagacttttggtgaaagacatctccttctcatatgtttaggcaagcgttgatgacatcaacctagccttttattttaaatcccctgtcaacgcaattagataatacaaaaataacaaaactataggaggttgaggatggggctgggggccaaggagattacttggtttgaaatgaataaattgtctatcgtaagggaattctttggtgcattttattgtgtgaaatgagcctggtcatatgactgccctgcctccctggaggcctccctgccctcctccttcccacagacacttatgggaggtactggccaactctgtatggccagtactgccctaagcaagaccaagaagcttagtctcaatttcagagagttattttggcaacatatttgggaaaatgatagttagatgctgcgttagccagcctctgcatgattttttacgcagaacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggcccttgaaggtttgtgaaggatggcaaagtgacttggatgttgatttctaaaggaggtaaaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtaggactacagttgtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaacatgagtgctcaagaaatagtaaattttagtatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactgtttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctccactggttcaacacacctgaattccggattcaagatgcaatcaccactactgttgttgtgtaagtattgctagagatggctgcagaatacctgggaaagctagctaagcagtgactggaggaaggccccagctctttggaacgaactttccagccgagaatgctttccaaaatgggaacaagatcccaaccccttatcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcgtgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagatgcacaaagcagagggaatcaagtagaataacatggtttatttgtgtgtgtattgttctgtttttggtaaaatcatgcttatcatatcttcaatgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgcctttttgatactaacgctacatgaagagggacggggccaacagcaggctcttccttgacgtgttttatgtacactccagaaatattgacagagttgtctttttgttttggtttttaaatgtttttttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgtgtaaaataatttgtacaagtttatatttttagctaaattaaaatactcacattcccattattttttagaggttgtaagctaagtaataacattctagaaactctctgttttttgaaagggcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcactacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgaggcggagtctcactctgttgcccaggctggagtgcagtggcacagtctcggctcactgtaagctccgcctcccgagttcacgccattctcctgcctcagcctcccgagtagttgggactacaggcgcccgccaccacactcagctaattttttgtatttttagtagagacagggtttcactgtgttagccaggatggtctcgatctcctgacctcgtgatctgcctgccttggcctcccaaagtgctgggattacaggcgtgaactactgtgcctggccaggataatctttaagaagaagataacattagctattcttctcacttcctacgtagaattccctaccctgtgtctttggcctggaaagggtattggtagcaattgtcttcggctttccctgccatgtgtatgcattcccacggccacacaagcacacacacacttttgtggttttttttttaattatataagcaagtaggatgtttgtcttagtttttttgggctgctataacaaaatgccatggactgaataatatataaacaacggaaatgtatttctcacaattccggaggctgagaagtccaagaggaaggcactggcagattcagtgtccggtgaggatttgtttttgatctcataggtgtccatcttgctattttctcaactagcagaggcaactctctggggtatcttttaaaagggcactaatggccaggagtggtggctcacacctgtaatcccagcactttgggaggccgaggcaggtgtctcggtggatcacttgaggtcaggaggtcgagaccagcctggctgacatggtgaaaccctgtctctactaaaactaaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctaatgacataattacctcccaaagtccgcacttcctaatgttaccactctggaggttagaatttcaacatataaattttggggggacacattcagaccacaataatgttttataatgttccttttgctttaacaagagacacatgtcagatagtagacatgatctgagaagacacaaaacccagcgtggtgattttggcagccttgccatgcatctctaacatgcacatggccagaaaaatagcttggacattctgttcaaccctccacatcaactggtcagtttagtctttaaaaggtgataggcctgttgtggtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatccacatgttgcctccagcatcccaggaactccgttaatgtttatttgaatgatggaatgaaggtgtcttgctatattttgacatttctgtcaaaatatgaatctatctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatgactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaccatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgctctcataagagacctcttctcaacaggatccatgtttgatccgggggaataaagctagagttgctttcttccttgtaatatgtataatgactcatgagagaattccccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattccagcactttgggaggctgaggtgggaggatcactggaggtcgggaatttgaaaccagcctggccaacgtggcaaaaccccatttctactaaaaaaaaaatatatatatatatatatatatatatatatatatatatatatatatatatatatatatatatatatatatatgtagccatgcatgggggcctgcccttgtagtcccagctacttgggaggctgagacatgagaatcgcttgaacctgggagtcggaggttgcagtaagctgagatcgccactgcactccagcctgggcaacagtagcaagacgccatctcaaaaaaaaaaaaaaaaaagtgtaatgcaagtagaaaagggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtaaaaagaaccatgtgaactgggcgtggtggctcatgtctgtaaagccagcacttcgggagtccaaggtaggagggtcacttgagcccagcaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaaccaagtgaaagagaaaatgagactaatctctaacctcagcttccttttctgccaaatggaagatcatctctaattaataatgagttagaatacctaggacagtatttggcacacagttgatgaggatggtgtacctagtagctaatggtgagtaggatgaataataatactataccttttggtttctgaaatgagaaatctaaggaactggcttaaccaagaagcagcaagctgttttaattgtgctgttaggagggctgtttgttaaggtacagaagaggattggcccatggctttctgctaagaacctgctgaatgtctgtatagaatccctgcattgtgcctcctatcaatcaggtgcttaggtttgacaagtttcctccaacagactcgtgtagaagtttctgtatcaactggaaaaaaccatggtgcttgggacattcaaggccgaaacttggtccctggatgggagaagatagctgtatcattggcagaggtgccttggtcatgtaccctctccagactagacactagatagtgggtagggtgggacagttttatgtcctctgccaccttatctgggactcttgtcccctgagaagtttgaaaatttggcacattttagtatttgtcagtgtacttcctgcttcttgatgcacttgtactgcacaagaattgattttcaggaaatatggtttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttgattttttcatgtccaggtcactacgtattgcgtatatttggttggaattttatttttgagcaattcatttacccagattgtgtttctggagattaaagcatctcactgtatttttatttttttctacattgcaatttcaaaataatccaactcaaaggctgttgaaaggctccttctgtttaaggtaaagcctgtggcagcctttaacttcctttctcttctcctgctgccaccttggtccacaatttatctttgaaaatgctgggttttaatgggcagggtatagtgcagaaaccagatggttttaactcacacctgtgaaaatgctggggatctgcgaaacattaaagttaatggccagaataaggctgccaagctcggtggaattgtacttaactggcatatcattctggttaactgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagttgcttattcttttcttcttccagttgcatctctccctctacttagatacacatttccattttacttctatttggtagtctcagaacttggcttttattggccagtatattcaatgattcacttgcacctttaaccttgtgttgttctaatctttttttttttttttttttttttttttttttttgagacagagtcttgctctgttgtctaggctggagtgcagtggcaccatctcggctcaccacgagctctgcgtcgtgggttcatgccattctcctgcctcagcctgcggagtagctgggactacaggcactcaccaccatgcctggctaattttttgtattttttagtaaagatggggtttcaccatgttagccaggatggtctcgatctcctgacctcatgatctgcctaccttagcctcccaaagtgctgggattacaggcgtgagccaccgtgcccagccttcttgttttaatcttttagacaactggacacaggtttgtctttgaaattgtcctggtttttcttgatgttttagtgctcctggatgtccaatgtcattcttgggctagttgaaggaaagttttggctacccagttgttagctgctgaagtttaactgtgcattctaagcacaccagtattttattacatcatacctgggcagcagataattttagtaaaaccttgaaaagatatgactattgggaagaaatttgggattctatcctttttctctccattcttctctcctgcaccaagtttctaagctcgtgattaaataaattctgaccctactctgataaaagtgaacccttgtggctggtcgcagtggctcatgcttgtaatcccagcactttgggacgccgaggcaggcagatcacctgaggtcaggagtttgagaccagcctggccaacatggtaaaaccccacctctactaaaaatacaaaattagtcaggcgtggtagtgtacacccataatcccaggtacacaggaggctgagacataagaatcgcttgaacccaggagacgggggttgcagggagctgagatcgtgccactgtactccagcctgggtgacaagagtgaaactccatcttaaaaaaaaaaaaagtgaacccttgtagtttcttcctctgtttgacagacggaccctaagacggccccagtgataccccacctcctggtgtccaaggcctgatgtgatcacccttcccccaccttgaatgtaggtgggacatgggacttacttctgaccaatagaatatgaaaaagataataggatgtaactgtttagattcggttacactatatggcaaagcaaagggattttggaaataccattaaggtcttacatgagacagattttgagttaatgagcagggggatcctcctgggtgggcctgacttagtaaggggaaaatcccttaaagaggagctaaaataagagagtctctctctccattgctggctttgaaaaagtaagctgccttgcagtaaggaactgcatttggcttctaggagctgagagtgccctaaggaagccagcaagaaaatgaggacattagtcctataaccacaaggaaatgagttctgctagcaacctaagggagcttgaaggtgattgaccatccccagtcaagcctctgatgagaccgcagccccactaggcaactagatttcagcatggtaagaccctggatggagaacccagctcagccatgcccagactcctatcctatggaagctttaagataataaatgtatgtggctttaagctgttaagcttttggtaatttgttagatggcaacagaaaatgtgtacaccctggatagtagacagagactgcatctttctttggcatttggctgcacagcaagttctaagttactcaccaggtttcagaggagagatgggaatttgatgatcttataagaaacctgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttacagtgagtgcggtggcagctgggacattaaccaagttgtgaaaggagccatgatgttattagctgagtcatgtcactgcacctccagcctgggcaacagagtcagactctgtctcaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtgacaaagtctttgctctacaggtcaagttgggacttactgaggagaaatgaggggacttcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctcaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatcttgccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtcttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaaaagtaaatgtgttttttgctattaaaagtaatgcggttttacttctgcagtttttttgccatttgccaattacttttgcagtttttgccagtacttaaaagtaatggcaaaaactgcaaaagtaattggcaaatggcaattgcggtttttgccgttacttaaaattgcattacttaaaagtttttaagtaatgcaattacttaaaacttaagtttttaagtaagtttaagtaaaatttgcattacttaaaagtaatcgcagtttttgccattacttaaaagtaatggcaccaacctaatattgttattactttttaccaacctaatattgttattaactaaagtccatcgtttatcatattgccttaggtttttaaaaaattttttacctaatgacttttttgtgttccaggagcccatccaggataccacttttatttattttttttttctttttgagatggagtctggctcttttgcccaggatggagtgcagtggcgcgatcttggctcactgcaacctccgcctcgcaggtttaagtgattctcctgcctcagcctcctgagcaggtgggaccacaggcatgcgccaccacgctcagctaatttttgcaggataccacattttatttaattgtcaggtctccttagcatcttcttggctgtgacagtttctcagaattgtctttgtgatgaccttgacagctttgaggagtgctggttgggtattctgtaggatgcccctgtgttgggatttttatgatgtttttctcatgagtttactggagttaatgaatttcagggaggaagaccccagaggtctgttttcatcacatcgtatcaagcattccaccttcatcatgactcttcactgttgatggtgactctgattcacctggtcaaggtagtgttcattaggtttctccactgcacacttagtctttccctctactttccacactgctgcctttggaggagtgttgctgtgcccagctcatgcttgtggagtggggatttaatgttctcactcttcgagggtagagtatctgcataaactacttggaattctacatggaatatttgtgtcttctcccccatttatttatttaatcatttatttatatcacggtacactcatggacatttattttatgctttatgttataatcctatactactttatttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactcttccccctgtgccccaggtgtgtttgctaccatacctccccaggggatagccctccaaacctgattggccacctagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctatgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgatgcaaatcctgggaagactctggaacaacatggaggcacctatgttaactctatttcattttggaaaagttgagtagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttgagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttttttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtatttttttttttttttcctctgcaagggatggggtcataagacattggtgaggttaggccttcctttgtctcccaggagcacacttgatagcaatgtagggtgaattccaaatctgtgagttagtgccatatatagcagtgttgtcagtaagatttctcactggcatctctgcttcccctcttgactctcttgaaatcccttcttcaggcagaagttggagtcatttctctaaaatagaaatctgatcttgccaccaccctacttgccactccctgcttaatcccttcactggctcaccatatcccttaggataaaataacaaaatcctttccagggcctgcaagacccctgccaacctctgcagcttactttgtaccactttccccagaaacctgctacctaccctgctccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaactcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcaccatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattctgagattatgttcaacagatattttcagtgttaaaatattcttttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgattagaagtaggagaagcttgctctctttttattggcacttctgtcttacatgcactttttgatttaaattattctgtcttctatgaaatgacagtgattggaggtggtttatttttttttaagtctgcttactcggaaaaataaaacaaagttgacaacctgatttcagacctcccaattttttcttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgattccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggccaattttttttttttttttttttttttttggtggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgatcgcctctccacccctgctacgtgtaatagaaaggtagggccatgttggagagggatccaacatttattatccccattttacagatgaagaagttaaggtggccaggcatggtggctcatgcctgtaatcctagcactttgggacactgaggtgggtggatcacttgaggtcaggagtttgagagcaatctggccaacatggtgaaaccctgtctctactacaaataaaaaattagccgggtgtggtggcgtgtgcctgtaatcccagttactcgggaggctgaggcaggagaatcgcttgagcctgggaggcagaggttgcagtgagctgagatcgtgccactgcgctccatgctaggtgacagagcaagattccatctcaaaacaaaacaaaacaaaaaaacaagaagttaaggattgcagagcataagtatcttctatggggctacccaactaggtcgggacagggcagggatttgaacctaggagctcttggattgcaatttttcattcacccctccctctccacccttcctgtcttcaagcctgagcaggtgatactgcattttgtaccgtatgactttaaaacagaaccacgagttcagaactttggttaggtcctgcccgtgttctctagctaacgcatggcaacgctggtttccaacctttcactgtgcgggtttctgatgagtacgctggcaggcctctggcttcagagatgccactacaaaggtctcctccttttcataaacattgctgcaaggcccgcttctcaagaaagcaacttgtgctacctcctgcgtgcttttatgcttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgttttccttcccactcacatgtaggtcacctacgggagcaggggaggaaccatctgaggtgtttttttttttttttttagatttctcattgctgagaacagttccagctctgctgaccaaaggctgagtgtccttttattagtctgagcccctagagaaaccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgatacgcttcagctcttatttttaagtcatccttatctctttcacttattccctcattcaggcaccaaaaatgctgtttgactgggagagcaagtggagctgttcaaagttctagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagtgtgtgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggagggcagacaagttgctcatcctctctgcgcctcagtttcttcatctacaaaatgaagatgttggttatttctttattcaagggttgttgagaggatgaagtgctaaaaatgcttgaccagcattcacacaggcactaagacggtgagtactcactacttagcgctgtcaacatcatctccgtccacatcaatgtcgtcatcgtccttatgaaaagccctgggcatcattttgcccttgagctggatgtccatgttggaaaaacagctagtggaaggcgtgcccaaatctcagaagttggcgtttccttgcagatatcattggtggccattggaggggaaaaagatgctttggaaaccaggacacagagaaaagtgcctcgtattatacagagccaagagaggtcactgtggaagtacagaggaagccttggcctaattgcacggttaatacaattccgtaactcatcctgccaacacgaaggtagatggacggtccttatgctcgctgcggaacactgcctgtgttttcctaggagagacatctgcactctagtagtgattaaaatgcctttgacaggctcttgctattaagagtttctggctccagtttaataaaaggtagtatattataatggaaaccaggttattattgataaggactagacatattagagaccaggttaaagctttgatagtcccaaatgcaaggggagggagctaagggttattgcaaacctactgtgtgtcaattgctctaccagacacctcagagacatcacagccaaagacccccacctttgaataaaccaagtttggcctctctgatatattaatatatttaatcatcagactttcagtgttaaaggagattacagtagaggcatccagttgattggggaatagttgttgcaaatgataagctcttttgaataaactgatactgacttaatgaggttctgctgtgtactatcttttttttcctaatagaaaatagagtagctgccctccccatccgccattctcagtccttttgcttactagtaatgaccctcttttctctcactccatgggaacttttaaaactgataattaatggatttttagcctcaagtttctggaattctaagagggcctgaaaggtaagtgctcacttactgaggtgtgtgaacaaaaacaggcaacctagctcagcaagtaagaatggagtggcatctccccacctgctctggagtcatgtgtttgcttctggaagggaggcaagaggcattcaacctcctgttaatttggttgctccttcagatacgctcttcatggtacagccctgagctgcatcatttaaagaccaattgttaaggaccaatctgagggcctgtgcattagttaaaactccttatctggtcatagagggtggtgtggtttggacgcgttccccttgtctgtgcaattcccaacagaggcaagtgcgcatttgagacaggttgagggttcaagctgtccaatccctgctcatctgcagcacaccaaggaatgtggactaatgaaaaataaactgcatgcatgcaatgcccatcacactgcctgcattttctaatcttcacaataactctgtgttgagaaatattcctgtctgtaatcccggcactttgggaggctgaagcgggcagatcacctgaggtcaggagtttgagaccagcctggccaacatggtgaactccccccaaccaacgacccttcccatatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccagcccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccaggagtctgtgtttgttctttaaacctctctattcagttgcccagctcttttcattccctgtcctttccccctctggctgggtctgcctttccaaccgctaccaccttccaccaccattttttttttgtttcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccagttgacaccagactaatgcttctgacttttccatggtgccccagcagcaggctggagggaagggcgggggcggtcagaggagagatagagcacttcagattccactcgaatacattagagcattagagcttttctcttcctcagggtgctctctctctctgggttgggaggagatgtggcatttctaggaattcacagtaaaatcagaaataattaggagatttcacagttgtagctcctgtgaagattcaggaattttttttttcttctatttgcaagctttagtcctaggcatggaaaaagaactttgaagaaaacctgagagatatgagtgtaaaacaagagaatgattccctctggggtgctggtagtgggggcttaatttcctaaaggcttactgggtatcagggctgctttcctttataatcttttacccgtcttatgggggatgaacagaaacacactttagtgctagaaaagctgggcccaaaagaccagtctcctgtcccatacttggacatttattgttctttttgggcaaggtgaaaacttgaaaccaaaagtctgttgagtttggaagacttgactcccaggatgtacaaagtacttctgcatgtgcgcaaagtcctgtaggcccaggcatcaatgacacatgcagtgtgggcccaggcatcgatgacacacgcagggaagcaacccaagctgggtcagtccttacaaggagaccggcacctgggctcacaccttgccgtatatgacttcatgggaacctcataacagacctgtgggctcagaattattctctcactttgcagatgaggaaatggaagtgcacagaaggaaagtaagagtgtttgagatcctgtagtgggttcattgctgagaataaacccggagttgcctctgggaggacctggtggtgggtgggatggagagagaggcctcccctcagactccaggggcacagattggattttttttttttccagacagagtttcactcttgttgcacaggctggggtgcaatggtatgatcttggctcactgcaacctctgcctcccaggttcgagtgattttcctgcctcagcctctggagtagctgggattacaggtgcccgccaccacgcccagctaattttttgtcttttttagtagagacagggtttcaccatgttggccaggctggtcttgaactcctgacctcaggtgatccacctgccccagcctcccacagtgttgggatcacaggtgtgagccaccatgctaggcccagattggcttctgtgtgaggatgaagagtaataggaagatagagtggtgatctaatgtcaactgtggagggagtgggaggcaggtgttcgcagggcacagctggtttcctttttgaatcccacccagtgctgggggcaagtttcataagcctgtgaccacccagataggaaagtacacagcaacaccaggcagattcattttctttaaatgaggggttcaaaatagaaacacaaagcattgagtattgagaagaaatggatcttcaggtttggagggaggccgatagagagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcagaattggcaggaagggcacaggggcaaggtataggctcacgtctccacattctgcacctcccaggctcctgccattgatgtgagcgggttcctgtactgcatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaagaaagaaggggccgggcatggtggctcacgcctgtaatcctaacattttgggaggtcgaggcaggcagattgcctgagctcaggagttgaataccagcctgggcaacacggtgaaaccccgactctactaaaatacaaaaaattagccgggcgtggcagtgtgtgcctgtaatcccagctattcgggagggtgaggcaggggaattgcttgaacctgggaagcagaggttgcagtgagccgagatcatgccactgcactccagtctgggtgacagcgcgagattctgtcttcaaaaaaaaaaaaaaagaagaagaaaagaaaggaaggacagatggaaggaaggaaaagggaagggaaaggaaaggaaccagctgcaaaaattgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctcgtggttaacccaagcaagaggtagttaaacggccccgcagattgccagtgactccgggaatgcctaggtttatgtatggattaacacagtgatagaccctgagtagcaaaagacgaagactaattacctgacagagctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagtccttggaaaatgcaaagagggggaaaaagaagaaaaacagcaacgagtttattggagagttaacacttaaatactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagggcttctgtctccagattccttgttctgtccctttatgctgactttccttttttgctcaaagtctctctccttgcttctttctctttgggctccctgcttttatttcggccctgatggaatctgtcgactttactgagctccatgtatgtgcaccaggtcagattcaatgctgcctaggtccacagtcctcagttatttgttcctgtgattttcgcgccaccaggagccacttgttggatgagatttccgggcaagttgagtctccatgtttttgtcgtgggctactgccagctgagatatggatgaagactccctttcatgtttcccttctttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattctctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacatgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgagtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttgaacctgggaggtggaggttgtggtgagctgagatcacgccattgcactccagcctgggcaacgagcgaaactctgtctcaaaaatgaatgaatgaatgaatgaatgaatgaaatactacttctccctgtcctccccaccctaagcatctgatcagacaggtagtgctggtggacagatggacagacacctaccccatatgtcacctccctcctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatggggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacactagtaggtacagcaggagagcatgtagaagaggatagatgtagaaaatcgggacggcatgttaggaatatagataggaattactaaggaaaattgtatttttgtggaattctttgaactcgttactattagtaaacggtgagttttggttctactcttcaatgagtttaagatgaaggaaatcattaaatagtgctttcttttcttcaaaagttgggttgcattgcatagttaaagttctttaaattcttctctaaaccccaaggctaagcaatatacaatctagttacaatggtctgcttgctgttaccagaatctatcaagctctttcctatctaagggttttttccatgtactggtttctctcctgcgtggtcttgttctacccttgaggagggtaccacttcctcattgcttagttgtcagtataaatgctcctttctcagagaggcccatcctgaccatctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatatagggagaaagggagcaagagaggggaggggaggtgccagagcctttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctattgccaggctgatctcggactcctgggctccatcaatcctcttgcttcccaaagtgctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatctcccatcagccgaaactaactctgctgtgtcacgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccagtgccccaatctggagtccaccatcctgggtctagctggggacatccttgaatcagcctctgggaatcactgaaccaacatgagtcacttgctactgtgagatctcagaacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacacggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataacagctaccatttcctgagggcatactgagtgctgacaggcacatcaacatcagaccatcaccttcttatacctcaaaatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaacggtgggcttttctttctcatttgctttcgcttagtattttccattattcatttggcttcttgaaccctccctatctgtaccccacacttactcttattcacccagaacaggtgtgtgccaccttggagaagatgaagccagagagaaaatcagtcagacaggaattatgttgaaaggtgactgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaccaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggttccctttgtttatttttacactagctttgcactaggttaattttttcccacatggcttttcctgtttgtttctttgattgtttttaattaataattagtttgcttatttatttgtttattttttgagagggagtctcgctctgtcacccaggctggagtgcagcagtgtgatcttggctcactgcaaactccacctcccaggttcaagggattctcctgcctcagtctcccaagtagctgagattacaggcgcccaccaccaagcccagctaatttttttggttttttttgtattttagtagagacgggatttcaccatgttggccaggctggtctcaaactctggacctcaaatgatccaaccgcctcggacttccaaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaatagctgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctactgccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacgtactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccgtgtgccttgcttcctaggctgtccaccatgacatcagcctgcccatgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctgcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgtaatgtgattctccttaacagagggattcgtaagcttaggactgatagagatttggcttttctgctgttggattgatagctccttgactgctgaagccattgcccatctgttcaactgttgtattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgtgagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagctcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaaagaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggacccaggcataaaacgtgatttgactcccccttgcccatcacagttctggagttcacatatcatttgttactttgaaaaatgaacttttgttatttgattatggtgataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagctaggccatttataatttggacactattttaaaaaataactcaggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgccagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctacttaaagcaaaatgccttctcctaaatccaggtagagagaaactctcaaaggccagggtctggactcaagatgagcacaggatttagaatcagaaagtgtgagttcaaattgccttcggctcttcacctgggtgggcgatttgaatagagctcacagccctgaaaaccctggttttcagactctttattggtaaatgaagtcagcttagtgatatgagaattatgaaacataaatccctttgtaaaaatataaaataatcttacaatcatcatcgtcatcctcatcatcgtgttccttcacaccagcggtatttatggtatttatcaactaactgctgtgtactatgctctattgaaaatgttagcaatatagtaatgaacaaaacagatgttatctctacccttatggtttttatattttaataaaagtggcagaaaagaaataggtaaaacaataaactgagctctttggagaagaggcccacgttcttttcagattctgatttctccgtgatataaatagttttttaggtgatcacttgtttttaatgtacctacctatctatacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatactctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagaaaaacacaacattgagtgaggtctagggtgaatgccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagatcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcctaaggaaacttaaaatcatggcagaagatgaaagggaagcaggcatgttctgcatggctggagtaggaggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcacaattcacacaccaggctgccactttggcccctgcgtcaccttcaccaccacccaatgtgtcctgctcatcactgaggtttgtcatttttactctgagtctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtggacaagaggtcacattgccttttctagcttggaaggtggcgcaaataactgcttgaggctccctctcttgggccaagcttgactctggattttcattgttgtccttttttattaaaacaggttttgtttttttgtgtgtgtgttattttgttttttgtttttttgtttttcgggggctggagtagtgtgcagagcctggcggtgattgttctcattagaaagtatagtgtaatactcaataaattacttttgttctcaccttgggaagtggactcagaggccaagtgactttgatttttcactttatcctggagtttctcaaccttggcactattgacattttaggccaggagattctttgttgggggggatttcctgtgagttacaagacattaagcaacatcactggcctctacccactagatgccagtagcatcttctatttcctcaagtctcaaaataccaaaaacatttgtagatactgccagatacccctggggaacaaaatcacccctggatgagaacccctgctttatcctcttacagttttggttctttccatgagaaagtatttttaatagcaaagtaatgaacaagaaagtattaataagacccaaataataatataaactactcctttactaatggtcattatgtgccatgccctgctctaaacacttgccatgtagtcactaatttaatcctcacaagaattctgtaatgtagtgtagtttcccagggcttccttgaaaacgtgccatagactagatagcttgaaacaacagagatttattctctcacagttttggaggccagacacctgacatcgaggtgttggcagagttggttcctcccggggctctcagtgaaagcctgctccgtgcctctcctccagcctctggtggctgccattaatccttgacattcgtcggcttgtggcagcagaaccccagtctccgcctccgccttcacatggccatcttcactctctgtctttgctcccttttcctatagggactcaagtcattggatttagggctcactggaatccaggatgacctcattttaccttaacaagttgcatctgtgaagattccatttctaaataagatcacatgctagggctgggcacggtggctcatgcctgtaatcccagaattttgggaggccgaggcaggcggatcacttgaggtcaggagtttgagaccagcctggccaaaatggcaaaaccccttctctattaaaaatacaaaaattagccaggtatggtggtgcgtgcctgtagtcctagctacttgggaggctgaggcagaagaatcccttgaacctgggaggcagaggttgcagtgagccgagattgtgccactgcactccagcctgggcaatagagtgagaatccgtctcaaaaaaaaacaaacaaacaaacaaaaaaaaaacaaaacacatgctggtgcacacataaatttggaagaaatgctctttaacccagtatgagcacgtggtattcttatcctcattttacagatgaggaaattgaggcacagacagattcaataactacgtgactcacagagataaccgtgtagcagaatcaggaattcagcccagttttttcagttgcacagcctgagctcctaaccatcgcgcctggggttctcaaaggctcgtccccaagcgacaacatcagggtcatctgggaacttgttagatgtgctcaccctcaggctcgccccaccccgccagacttcctgaaccagaaactctgggagtagggctcagcaatctagttttagccctccaggggattctgtggtgcctaaagtttgagaacttctgatcaaaaatgccagataagaaaaaaaaacctttcgagacatcatttgaatcaattatcaaatgtttccaaagtgcacttgctttgcaaaccactgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcagaagagcaaagtccgggtccccaggctcaactatcagccgccttctcatcccaagggctgtcaccaccagaaatttaacatgctgttagtgcatgcaaaaaaaagcccagtaattgtagggctcatcagtacattgttaattgatcctcatttcctattattttacctcaaagcaaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtacactaaaggtccctcttccctggcagacagtggttcattttatttgaggaggtatgttgtgggcttggggaaacagaaggaaattggagacattgatatgcttcctgagaggtggaaggggccacttaacacagctttcatttttcagttgccaatgggagaggagctggggtgggcatataatgagtaacattcaaagctccttctgtctttttttcagagaattcacaaaacaactcagggcctcctggtcctgcaaaagtgtttactgtttatttgtgttgtttctgcttgttttgcttgccaccagctccctactcacttgggggaaaataacccatcaaaggaatagaagctcaggataaacgtttcagacctttcagtaagatagtaaaatttctttcattcccagacctctctccaaaagaggcagccatcattaaaagtttgttatggattcttccagaaacgttctatgcatttagcatcagttgcagatatggatagccttttcaaaaaatgcatgcaactgagactattggctatgttttgtttattacctactttttccatttaatagtatcttggagattatttggtaccagcacatgtagctcaacctcctaatactgcatgacggataatatgccatcacatggtgtcatttaatatattcattcctatttatagacattgaagttagatccatgtcttactattacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctaccattcacacgtgagaatgcctgtggccccccagaaattatctccagcagcagcaacagagaggactggaatgccattgacaggtcccacaagtcagcaatcagcacgccattttttaaaatttatgttgctattgtatcgtaaggttcttctgaagcgaccacttcataacactgtgtagtccaatccctaagctgggcaatttttttttcccctttcaatacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgagaggtggggagggggtgggggctctgtgcatggaatggggggaaaagcttcagggaagggcagtgcaaattgtttctggactgatgccatcttttaataatagtagttaatagactgggtacaatggctgacgcccgtaatcccagcgctttgagaggccgaggccggtgtatcgcctgagtccaggagttagagaccagcctgggcaaacagcctgaggcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtagtagtgaatgccctgactttggggtttgcagtaagctaggattaagtgcttcacagtgaggcacagtggggagctactctgaggatgaattgcctagtaaataagtgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgcaatgagacatctagtttttttctctttcgtttgttctgtttcccactgagagaattttctagctttatgtggagaaaacagtattggaaattattactcagttcaagaaaacctcactgagcacctaccatgtaggtgctcatcccgataccactatcaggccctttggaccagttgcaaggatgcaggatgaggaaggcaatgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtggtcattgactggggctggattcgggaaggatccacttccaagctgcacagttgttggcaagatgtagtgttttggtggttcctgggctctgggactcagctttttggctgttggttgttggctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcatgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctgatttctattatgagtaatgctgctatgaacattcatatacaagttttagggcagacttctattttcattccaatatctctttatggcatgtcttagcagtgatgtctatgacatccaggatgtgtcttgacatgtctgacatcatttaaataaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacagggataatagacaacgctatcaagaggggggccaaccacacatgtgcagccactgtatgacgtctggattttccttgacttatggtgatcactattgggaggtggtaagcaaacaggtgacataatttgaatcatggttttaaaagacgccatggttgccatgaggaggacaatgcgtaggaggcaggagtgaaagctaaaggatatgctgggaggtgaccctggagttaaagagagcaactaaggtgaccaggtgacaataatggagatagagaaaacaggatggattcaggaaacatgaccacactgagcatattcaaatgtaattgtcagttttcgtgtctccctcccactggaccacaagcccctaactcttcatgtacacaccctgactcccagtgtgggctggccacccaggaggcacccagtttatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtgcttctctgatgtggctttaagatacttgctctgtcgcccaggctgtagtgtagtgattccatctcagctcactgcaacctccacctcctgggttcgagtgattctcctacctcagactctcaagtagctgggattacaggcatgcaccaccatgcccggctaatttttgtatttttagtagagatggagtttcaccatgttggccaggctggtcttgaactcctgacttcaagtgatctgcccaccttggcctcccaaagctctgggattacagacgtgagccgctgcgcctggccaagatactgagatgtgggggccaggcacagtggctcatgcctgtaatcccaacactctgggaggctaaggctggaggattgcttgaagccaggagtttgagaatagcctggttaacatagtgagagccccatgtttctaaaaatttaaaaaaattagccgagtgtggtggtgtgccacagtagtcccagctactcaggaggctaaggcagggggattgttggagcccgggaggtcaaggctgtatagtaaactgtgatcctgccactgcactctagcctgggtgacagagcaagacactgtctctttaaaaataaataaataaattaaaaagacactgagatttgggggttacttgtaactgtgtcataacctggctccttactgccatcggcatgcctagagggatcccagttttacacatcagaacaacccaagccccagtgtgtcacgccattacatgcttacagcctatttttacaaagtttgaatattgtaatttgcctttaaaaaattgttttaaagatctgcctaggtcagcaaattttatttactctctagaaccatttgattggggtactgccttaagaaataaagcagattccttcagtcgcatgtgggcctggagtcactggaaaatgcagacaaaacaagatctgctgattggcaaggtcatcttgggaagggccatcgtgcagtaaagagcaggtccattaattcaggggggatttacatcagttccatctgcctctttcctaatgggactgtttggttgtgttctttcctggagagattagtgattgaaaggaggagatctagaaagaagagataaaagtttacatttaattttcatgccatgcagcgttctacgaaggcttcctaaggaggctccatactaaattcagacataagtcagaaggcagcttctcccaagacactgttgatgtccagggggtgacagttccatcacaaaagggggttaaaagggtttaggggaagtttagttgtcttccttttatctctaactctaaaacccaactgctggctgaattaaaagtctcttacataatggtcagaggagttttgagtatcggatctttgtgtacttgctttttaaattcagtcacgtcttaaatagtacttttcactctcctcctctccacaccactttatgtgtttgctagtagcttccatgaaactctatgggtgaacatgtctgcaactctttggcatttaaattttaggtttctgcccctcgtagcagactatctttctagaagcagagctgtaagtctcttttaacaccattttcaagcttggacaggctgacatttttattgaatgggttatctcaatatatatctacttttttgcatcctactttttttagaaaattaaaaatgatatgatgggtgtggtggctcacgcctgtattcccaacactttgggaggccgaggcgggtggatcacaaggtcaggagttcaagaccatcctggttaacacggtgaaaccctgtctctactaaaaagtacaaaaaattagccaggcgtggtggcaggcacctgtagtcccagctactcgggagactgaggcaggagaatggcatgaacctgggaggcagaggtagcagtgagccaagatcgtgccactgcatcccagcctgggcgacagagtgagactccgtctcaaaaaaaaaaaaaaaaaaaaaagataatgatgaaaataatagaatattgatgagaacacccattactctgctcattgttcaaatgaactcatttgagagctctctcctttgtttctgtctttctctcgcatcagcttgcatctgtttgcctatgctataaggcatcagtggttaccaggcagtgttgcattttttccatcccatacctctgtgtgtgttccttatctgtttctaggatgtgccctctgccccgtcacatcacactctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccaccatggtgaagccccgtctctactaaaaatacaaaaaattagccagctgtggtggcacatgcctgtaatcccagctactcgggaggctgggacaggagaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccatcctggaagttgagtgatggggaataaaaggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggtacttaaaaattgttagaagagctaaaagagtagttttgaggttgaccttcagaacggcttcctgaataatacagaagtgaccctccaggaaggcccttccactgaagctacaactggagctaagcagatggataagccaaaaccacctccgttgctgtggccccatctccaccacaaggaagctggagaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagaggcaggaagagggaatgaatggtggccaagaattttaaattcctgttcccggccgcccccggaagctccatctttgttgtgagggcttctctgcgtcagtagaggccagctgagctcttattcaccccttattctctggttccctttcaccagcaggtccagctctaaccacagctggagtttaggaaggccaggcagcgtgtgttgaatgccagccactcttctacccagggtcatatccttggatgtttttctgtgcatctgtctttcccgaccctcccgtgattctggaaggaaacacctttccaagctccccagtgaccctggttcatcccggaaatatgcaggaaaagcattatgagcattgcagtgccacatgctgcattggtgtgttacgttatgagaactattagggctgatctctgagaaacttaccagtggtgtgtgatcggaaatcatgtcaccctctgaatgtgggttatgggataaatggctaggtacacaggcttcagagtccagccagccccaggtttggattacagatggttgctgtactagatgaataatgtccccccaaattcgtgtctatctggaacctcagaatgtgacctcatttggaaataaggcctttttaattaaaaaaaaatttttatttaaaaaacagagatagagtcttgccatcttgcccaggctagtctcaaactgttgggctgaagcagttctcctgctttgacctcctaaagtgctgggattacagacatgagccactccacctacccagaaataaggtctttatagatgtaactgaaataaagatagagatgtgaatgtgatcgtactggtttagggtgggccctacatccaataagaatgtccttagcagagacagaacagagacaccgagagaggaaggtgatgccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaataaattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagccgggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagataacttgtgatggtttagcttatttagtacaacaaccctgccccttctagtttttatgataacctcattaattgccggtactctcagagccctgattttcttacctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaataaaaagggatcaagatatggattgtaaagtagaaaaatacatgtcaattaaatggatttacatcttaaaaagtggtgaggtagacacacaggcactactcacttcattccttctcatctcaacccgttaggatttggccttcaactgggtagtggaaaaaatatgatccttggcagtctactacgcaaaagcaggaacatcatctgcttttgggtagttaagagttaagtatcactttgagctacaggatcatgattaaaaagcattctgttatcttacttcacaactctccacttttgtaaaagtttaggataccggcagggcagcaaatacctttaaatgattttatttaaatgtcagatttaattaaatccatgaccagaagacaaacccaaaggaaattttcagggagctttagaattttccttttccatgttcaaggtgataaccgtagcataaaactgtcccaaccacatgcaaatgcaagcaggggcattcatcatgaaaatacagctctcaaggcggaagtgcttgttaactttgcactctatagccaagtgcgatgatcagaaaatacatacattgaagacaccagaaaatagtgtatggattggtgattttgactaagactggaatgtgggtgtgtgcactcctcatgttccggtttctgtgatcattcaggcatgcacaggtatcctgatgggtagccaggtcattaggcccagagtcggcagtgtagcatggcaagagaagtcattgcatctccaaactgtgcctaaattgcctgtaatgggttctttgcaacttgcagaaccagatcttaccatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatacatcctgataaatgctgtgccttcctccttcgtctctctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagcactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgttggcaggcacccattagtgttggttacgacttgctaaaagaaaatattaagataaaaattagatcataaatttggagccaccattacgaagcctaaagtgcaaattgccaaacaagtcaagagactcattagcattttatgtaaatcagttattactgttctccacttccttaattatccatgttatttcaatacaaccctttctttgatgtcccaattctatatttaaatagtgcaagatttctatcgtatcctcccgcagaggtttgtgccatgcaaaaaacatgccaagagcagctattttagagactacagggaaatgtttaattggttcatcccatttgagttatgagggtgtattactgagcacataaaatcagaaacatggaaagtactagcttggagaagtttactaaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcgcaacctcagatgtccctgggcactagcccatctgtatgtctttaaaaaaaataaattaaatttttaaaaacatgactttctggccaggcgcagtggctcatgcctataaccctgcacttagagagggcaagacagaaggattgcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgtttaagaatctcagagtaatccagacgttactactccataagcaaatctgggacagtaatcagacaaccagacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagttctcatcatttatactcgtttcagctaagtcttcttttattgaaataaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggtgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcagggtataggggtcaggcagctgtttgacaggattcttgcaaatgtttttggtttctctgtctactcattacgtacactctgccagaggttgaaaactcaatgttgagatcacatacatcctgaaaacactgtttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccaaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatgaaggcttaaggttttgtctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcaaggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtacagatctgtaaaatatgaaaacaggaaaacacatggagtcttggagggtagggaagtcttgatgagtaagattgggtctgagataaacctaaaagagggtcaagattttgacggagggctggaagggaggaacgataggaaactgaccttttttcagatctcttcttgtgcgtggcctggggttaagtgctttacatgcatcccctcattgacttctcagagcagctccataaagagtccctgtgcttcccagtttactctggagacgactgaggctcacagaggttaagccacctacccaggctggcaccgcacactttgttcagagtgggcctggcatacggcatcagttcagcctggccctagacccttttcctcccacaaccatattgcccccagtggagagacaggaaagcagggaagggggcaattgccaagcctgtttctagaatctcaaggatgccatttggtgaagctgaggctggtgcagttactctgtggagacaccagcgtcttggacctagggatggattcagggaggattgtgtcccccagtgacctgctttgtgaaaggtagagaatagattacaggtgcccgagatcctagaacccgtttcttaccatgatggcgttgaggtagaggtagaaagatgggtgaggtggctgggtgcagtgggttgcgcctgtaatcccagcactttgggaggccaaggcgggtggatcacctgaggtcaggagttcgagaccagcttggccatcacagtaaaaccctgtctctgctaaaaatacaaaaattagccaggcatggtggtgtgggcctgtaatcccagctacttgtgaggctgaggcaggagagtcacttgatcccggggggcagaggttgcagtgagccaaaattgcaccactgcactccagcctgggtgacagagtgagactccatctcaaaacataagtaaataaataaaaaataaatataatacagacacaggcttttctccccacctcttttaattcttgaaaggaacagtaacaagctcctattcctgtttccttgccaggagaagtattgttttcatataaatcatttgtgacagaagctccttatttttaagtggaaaatgcacatttaataacatgagaataatgtccaaacatcttctcattgatggctgccaagagaacagcagcactcttgctgcctgcagaaagagacactcagagtcaactgttttaggggccatgctgtcattgctgccgcatttgcttaggtgggctctgagcagcagcttcccagacactccgtaaccaatggcagctgagtgcttttgtgccttgcaaatcctctagtcagagcagacctggcttaggaccccagccctaccactaactgactccatgcgctcctatcggttctttattttacctctgcaagcctcagttttctcatctgtaaagtagggataacattagcttcagccctcacaggcttagagtgaagtttaaataagaaaaggtatctaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgacgtaaaaagacctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgctaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggccatacttagtggctcacgcctgtaatcccagcactttgggaggccgaggtgggcgcattgcctgaggtcgagagttcgagaccaccctggctaacatggtgaaaccccatctgtaataaaaatgcaaaagatagttgagcgtggtggcgcatgcctgtagtcccagctactttggaggctgaggcaggagaatcacttgaacccgagaggcggagattgcattgagccgagatcatgccacagcctgggcaacagagcaagactgtctcataaataaataaataaataagctggacgtggtggcatgtgcctatggtcccagctacttgggaggctgaggtgggaggatggcttgagcccagaggtagaggctgcagtgagctatgatcttgccactatacatcagtctgggtgacagagcgagactctgtctcaaaaaaccaaaacaaaggtcaattttttttccacattcatctataaaacaataaaggaaacatcctagacacttgaatcagagcccttttaattatgacttcaaaaaacagggctcgtgccacccaagatttcctccatatacaaaaaaaaaaaaaaggaaaaagggaagaagcaaaggggcaatacagggctctgcccattagaatctctagggacagaccgaggtttgagagttcctgctcctgatctcaggggaatcctgaattacaggtgttaacctgattatccccagcccagctcttcgttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccgcagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactgttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagtttttttgtaccagtgaggatgaatgtttctgcatgtgggtagttggcaccagtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaaggattgcttgagaagtttgagattggcctgggaaatatagcaagatcccaaccctattaaaaaattaaaaatgaaaataaaattttaaagaaaggtatttctccccttcacggtaatttggagccagtacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgattctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagcactttgggaggctgaggtgggtggattgcctgagctcaggagggcgggtggattgcctgagctcaggagttggagaccagcctgggcaacaaggcgaaaccccatctctactaaaaacattaaaaaaaaatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattacatgaaaaatagagacaaagtctcgctttgttgcctaggctggtcttgaactcctgggttcacgtgatcctcctgcctcggcttcccaaagtgctgggattacaggcacgagctgccacgcctcacctcttgttttcaataccattgataagttgtggtcttcagggacttgtgggcattttcaagttaaatatccaacagtcgtgatttagggcatgaagagctcactcatcaagatgtatgtaattcagattttctgagtgtttaattcggcgtctttggtcacaaggaacagagttttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacaattttggctcgcacatgcttcctttttagctcatgaccgtgcaattcaactcaacctcatggcatctttttatcagctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccaggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttccctcagatttattacgggacctggatgtgatgcaagcatgcccgctggctcaggctgtgcctcacagctgcaacatccctggggtggagaagccatgtgggacctcacagaacactccaccgtccctgctaatggctgagaaaggactctgccctcatggatggggttgggggacctgttatcttcttccaggttaatcttggtttcagctgctttaaactctactttttagtgggacgcatcatactgaactatggaagcaccatagttgtcacctagttgagcttctctttgttcccatatgtttcagtgaagcagttatagcttcagaaaagagggagccaggaaatacacttgtaattcatcactccttttatagtcagagcataggaacactcatagtatgtatcagaaactagtgaacacatgttgttttacagctctgtctgcaaaattgcatcgtgggcctctttggggagtgttctcaatgtgatttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggacagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtatcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggacccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctgtaatcccaggactttgggaggccgaggcgggcggatcacgaggtcaggagatccagaccatcctggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggaggaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcatgaagccacatagtaataaacagtttccatatccaagcagctaaggcttgtgccttgcaagttaagtggaacatcacgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctctgttcatgatataacagtaaatccaagttgctttaagtagatattggaaatatgaacccaatatgttcttaacatctccatgtcgtaattctaatttaaaatcaaaatctcatcaaattacattttagattaaagcattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacagattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaagtctcattcacttctttctatttttcctctctctattgcatattaacccaccatattgagagaatagaaacttttgccttcattatatcacctttacaccccaggacaggtgccctcctcagcggagacaactgtccccctccatcctgcaggagttttgcagccatccttccagccactgcttctctaccggggcaaattttcccccaagggataattgataatgtctgaggcatttttaattgtcacaacttggggaaggggcaagggattgagggagagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctctccttcctgctgccgtttgaagaaagacatgtttgctttcccttccaccatgattgtaagtttcctgagacctccacagccatgccaaattgtgagtcagttaaatctctttgctgtataaattacccaggcttgcatatgtctttattagtggcatgagaacagactaatacagtcagggatgctgcagaacatctccaaacacacaggactcccaccctctacttccaccccaccaacaaagaatgattcagcccaaaatggcagtagtgaccttgttgagaaatgctgttcaagccatacgtcaccattggaaggttgccaaactgtgctttgcacacacatgctgtctgcacgccttgtatttttctctttgcttagtcctgctcatgctctctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccgcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctggaaggctgagtcagaacgattgcttgagctgaattgttcaagactgccctgggcagcacagtgagaccccgtatctacaaaaaataaacaaacttagccaggtgcggaggcattcacctgtattcctagctactcaggaagctgagatgggaggattgcttgggccctggacgtcaaggctgcagtgggccatgatcgtgacactgtactgcagcctgggcgacagaatgagaccctgtctgaaaattaaaaaaagaagaagaaatgtttattgaatgaagacatgaaagcatttggtggaaatagggcacacacatgaatatattcacagttgcaaactcagaaggatactcccaacctggttctttgtcttgtccctccatctgggtgctttccagtcacagcctggatgcatgtatgaataaacttctaccattaagtccctgaattatttaagcactgccagtgattctatataaaccgttcagtaaaatgaatggcatatgcgtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcgttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacactttgggaggctgaagtaggctgaagtgggaggatggttagagcctaggagttcgagaccagtctgggcaacaacgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataataaagcactgtctctctctacccttgcagtatccctgtaggagagagttactattagctcccagtttataggtgagtgatatggtttggatgtgtccccacccaaatctcaacttgaattgtatctgccagaattcccacatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgaggcctccccagccatgtggaactgtaagtccagttaaacctctttttcttcccagtctcaggtatgtctttatcagcagcgtgaaaacggactaatacagtgaggaaatccatgtgttaggaagggagtgtggttgtacttcaacctggaactgtctaactcctaaggttttattaatatctagtccatttctctcaatctaatagtaaatggaagagaagcaacaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctcttaatttcatgcttcttaaactggggtatgagtggccccaggtttccctgttgggggtactgataccagagttcatttgaagtcattggaaaccaaggcatattttcttaaagagacaactgtttttggtgaataggccatgttgtttatagtaaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagcttgccagcaaccttttagatctctttccttggaaggttcagcaagatgcttgtaaatgtatgttgctttgttgcagacaatgtatatttaaaaagcaattatttgcccatctcttgttcaactcagatattgactgcctttctgtatttctggctgggcattgtttatctccacctcatggtttttactatggttctagaggtctagcctacaaagagaatgcttcccgtccccaccactacccacaggaccctctgcatatctcagaggaatttctcagtgttccagttaattttctctctgtttcctttattacttctaagttccattgcaaaaatatgctgcctgctctgtcagccaccctatatgcctatttagtcccagttttccagcttctatttttttccacataatccctaaccatgataatacaaatataatagaaataattatgtttgtttaaaatatacacagaaccaaatagtcatagagtagtatttcaggtggggggccctcctctagggcagtggagacaatgtcacctgtcgggaacatttggcaatgtctggagacattgttggttgtggtgcggtgacataactattggcatcgagtggatggagggcaggtgtgctactaatcgccctctattgcacagggtggcccttaccacagagaactatgcagctctaaacatgcgcagccccaaggctgagaattgttgatctaggggaagatgtgatttcattcttcatgcttgtaaattattatttaagctgtgaataccctctcttttcccactgaagttgtggttgtaagattctcagagttgagcagactcggcaacattacagaaaaaaaatcaagatgtaaaaaggatttagacgtctggacgtggtggctcatacctgtaatcccagcactttaggaggccgaggcaggtggatcggttgaggtcagagttcaagaccagcctggccaacatggtgaaaccctgtttctactaaaaatataaaaattacctaggcgtggtagtgtgtgcatataatcccagctactctgtaggctgaggcaggaggcagaggttgcggtgagctgagatcgcactacttcattccagcctgggcaacagagagaaactgtgtctcaaaaaataaaataaaataaaatggatttagaaatggtacagtcagaggttaggggtcgggtcaaagcgatccccccagagacctgtggaaagtgtggttctgtctacaagctgcgaccatggtctttactgcttctgcaaatacttgacaaaaagggccacactcttagctggacttttcctccctttcctgaaacaatgcccttcccattgtcaaggcagaagcagcctccactgagaagcgtcagacaccacgtcagtcttgctttccattgctttgctccagtatccatttgaaattcagtgcaaacccataaattccactttgcctctggtagcagcctgcatggtgtgtatattgaacactagaaacacagtaaatccagcccatttattcacattaaccagcaaaggcattctgcatgcccatgtaaatactggaaattactgacatggccttctagaccatgaaaagacagaagcatatggcagaattcatatgtgaacagattgctttttctcataagaacgctttattggaatatcaactattacagctttttgaagttactcttcctgctcttgatttaagtcctgaatcaccccactactctttttttttttccgctgcattctgctatgtatctttacatctgcttcctgcactttctaaatggcctacttaaaccttgaggtaggtccttcagtttcccataaattaataacacatctatgaatatttcccagccagtcttagaagccccagtctattccaataccaggattgtaaacacagggaatagatgaagcaagctgcttctttcaaatgctcttccaatatgaagcaaaatattattgatctagactgcctgctactttcatttaccatgttactgctcgtgggattacaggcacaaaggtttcataaatttcaaatgaaatatgaacatttgttgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagctgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagagaaccaagagccagacacagggaacctgtgacaaaaacgaaaaccaataaaaacatatattgagcattgaccaggtgcccaatattttaatgtcccatgggtgtgcatcaggtacgctgtggaaggacagatgtcattccttaaaggggctgcactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcctaagtgacttcagactctatagacagtccctgacttataatggtttgacttagattttttcacctttgggatgctgagaaaaccatacacatccagtagaaaccgaactttacattttgagtttcgatttttttttttcacctgggctagtaatacgtggtaggatactctctcacaatgctaggccacagcagcgagctgcagctcccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgcctttacatcctcatagcttagctcccacttataagtgaaaacacacagtgcttggttttccattcctgagttacttcacttagaataatggtctccagtcccatccaggttgctgaaaatgccatcagttcattccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactctccacactgttttccatagtggttgtactagtttacattcccaccagcagtgtagaagtgttccctgttcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagcaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaataccccatgaaggaggtgcaattacccctggcttagggttgagaaaactaagaggtttagtaatgtgcttgaggccatgctacctgtaagcaagaatcactccaggtttttcttgtttcaaaactcctgttaacaactgagttgctatactgttttagtaggtcaagatatactatgtgtttcaaagggcttataaattataaatgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttggggtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaatgtaattttgttatatccatatgataaaccttaagtattcttaagccaggtgcagtggaattcccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagacttttttttaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggctcatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaactggggcactcttggtcttggggaggggaggtggctggggacgcagagggtcctgcggtgggtggatacttacaacatagaaatgtcctggctcttgatgctggctacaccctcagtaagagatactgtcctagggtcatttttttcaacccacactagttacgtggactgtcttagtcagtccaggctgctataacagaataccgttgactgggtggcttgatttttttttttttctcccagttctggaggctggaagtcagatatcagggcaccagcatggttggtttctggtgagtgctcttttctgcatttgtggacagctgccttcttgctgtgtcctcacttagtagacagagagagagagagagagagagagagagagagagagaccatctctcttgtgtgtctttcattcatgagaactccacctttgtgaccttattacttctgagaggccctacctccaaacaccatcttattgggtgttctagtttaacatatgcatttggaagagagaggaacatattcagtccatagcatgaaccaaccacgtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctgcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacataaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctacttttctctttttcccagcctccccccgatatactcaacatatatctccctctccctccacccacctgcctcccccacactccttctttccctctcctctgcagggagagcttggaaaccaagagtctatgagctcgaagggagcatgcaaaggtgccaggcaggccctcaaagctgggaagctgcagtaggggttctttgggacccagttaagcagtgggcccttgctctgagatgcagtctgctgagctgccatctggggacacatcttgagtttctctccatgatggcgcagctctcagcgtaaagcagtctatggagtgagaagggaaaaggccccagtaataaaaggcaaaggaagccctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagtgagcagtgatgactccactatactccagcctgggtgacagagtgagactttgtctcaaaaataaaatataaaataaaataaaaaggaagaaatagccagtagtgctttcttgtagacagagaagctggtgaaatgatgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctgggaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactgcaggagagggggattatataggagcttctggaaacagatgccttgggagctctcctccttttccagaactcccacacttgctcttgtagatcatcataggataactctccgctccctttcctaagaaaattgatctaaaaagtaattatggaatcttgcagtgcttgttgggatcagagaaggctcctccgatgatgggatgttaggtagagggctgcagggaccttgcttttagtcaggaggcaaatcaagagccaagagagggaggggtggtcgtgagtttttatgatgttccttctcttctccgctccttcctgacaagagtctgtctcttttctctgtgtgtcataactacccacattcaccccggcagcccatctaccttgtttctctcataagtcagcttctctcccatctttcctgtgaaaatttctaacaaaatgggagttaaggccgggcatggtggctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcggaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgcttggttttatcttttatacatataatgcacaatacatgtagtgccaacaagaattatagtttctgtaagtagtgtatgattgcccacggatcttcagtaactcattaggcactgacgggctgacatgagcaacaacgagacttagtatctgttgcagctctccatacagtttacgaaactctaatccataaaagccgtttgaaatttccattaggagatttgcacaagtggttaaaattagtcatgcattcttggtctaaactgcaggaagggtatctttactgtgaaaatgattatgacatgttaaaactgtgtaatagtaagcagacagttttccgagctgctgggtgaattctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaagtaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggaaaggctctttcagctgctctttctcgatccttgcagtttcccttttgacctgtgggtacacatggtactgacgcaattggcacctcagatggttcttcctgacagctacccttgcaactgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgctggaataattgacatccaggttatcacagagccttcctatagtgttgattctgatcactcaaataatcttagtgttaaagggtttatttttatttttctaccttcttttaccaccccttactcccatcagagcaccatcagtcttttgggaataaaataattcctcagatatattaaaaagctatagaagcagaagttaacgtacatgcaaaaatctctacatttctcaacaattgtgtaaccactaaatatagggaaagaagtgtgcaaggtataagacattggccatgcgtccttgtctgtgccacctcaccaggagcattgctcctttttatgcacaagcatcagaggttctggacatcttcttgggctagttggtatagcttccttctcagctcattctgcaaggtttgctttggaaaagtctgtgcatctgagctctctcttgccatatcaggaaccgaagtcagaaataaaggctacagatgctcaaaatctgcagtattcaatctttttaaggcccagcatggtgtctcatgcctgtaatcccagggctttgggagactaaggcgggtggatcacttgaggtcaggcattcaggactagcctggccaacatggtgaaaccccatctctactaaaaatacaaaaattagcctggtgtggtggtgcacacctgtagtcccagctagttgggaggctgaggcaggagaactgcactctagcctgtgctagagagcgagactctgtctcaaaaatataaataaataaataaataaataaataaataaataaataaataaagtatctgtccccaagtcacaatgctattcggttggtgcaaaagcaatcgtggtttttgccattacttttaatggaatagtaaataacacttgatctttggtcttctgacctgaaatcccatggctaggattgtcagatagaatacaggacacctggcctgttacagtggctcacacttataatcccagcaccttgggaggcagaggcaggaatatcacctgagcccaggaatttgaggctgcagtgagctatgactgcaccattgcattccagccagagtggtagagcaagaccctgtgtcttaaaacaacaaaaacaaaaacaggacacctggttaaatgtgaatttcaggtaaataacatattttttaaaaatgtatcccatgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtacttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcccagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccacgctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggccaggagcagttgtttattttctgctatttcgtgtgtttctttttgctggcagtgacatactcctacagggatgtctgcctcatgttgacctgcttgtgtttaccacctagaggcctaagaacaggctttccccgttcaaatcacccagtggcgtgcacacttggggcacctggggactggtttcctgaatggcattgagagtcattactttccacacacagttaactgcagggagatttgtctctgaaagtagtcttcaagaaatgcggcagctgcttctagccgctccatccttccttttcccagtgcgcactaaccctccagagccttccgcatctgctatgcagcattggccacaccagtgggatgcaagaatttatcccttctgttgatgcaattaaagctaatggatctcatatatatatatatatatatatatatttatataaatatattttatatttaaaaatatttatattttatatatttttatatatttatgcaagtatatatctaaatatataaaatatatataaatatatacatatatgtgtatatatagattttgttttttgagacagggtcttgctctgtcactcaggctggagtgcagtggcgtgatcatggctcactgtagcctcaacctcctgggctcaactgattctctcatcttagcctcctgagtggctgggaccgcaggttcatgctaccgtgcccagctaattgtttaattttttgtagagataggatctctccctttgtggcccaggctgatctcaaactcctgagctcaagcgatcctactcactcggcctcccaaagtgctgggattacaggtgtgagccaccatgccaaagcctaagggaccttagaattttttctcctttcttttcacattttgttttgtgcttgcttatttattgaaatctggaccacaaataacttacatgtttgtcaaggccagatttcaggacctaaccaacacccgacaggcatcttagaaagtggagggtgtaagttataaagagagattacttccaacacgtttctttaaagcctgctggctaaattaggtgggaccttctttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatgctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggacgcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaagctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggcgggagaatcgcttgaacccaggaggcggaggttgcagtcagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataagaaaatattattcagaggtctcaagaggcaggctgccaagaatagcagttagaaatagctagtatcaggcctggtgtagtggctcatgcctgtaatcccagtgctttgacaggctgagggaggagaactgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcactttagcctgggtgacaaagtgagactctgtctcaaaaaaaaaaaaaaaaaaaaaaaaaaaagctagtagcacaccccaaaacttctagacagggcatggtgtgagctggagtagacaactagttcatggtaacaggaccagcagagctccgtcttgatgctgttattatttggtatctgttaggagctgaattatgtgtccccaaaattcatgtgatgaagccctaattcacagtacctcataatgttactctatttggagatacagccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcacattttcttatggcaacccctgtagataatacagtcccattctctggggaaacagatacctccgccagggtcctgatctgaatatgatttggggtgatggaacagaaacacccgaggactgtcgttggggaacaggaaacctgtctgtagtcctggctctgtctccaattggctacgagggcttgtgtgtactctagttctctttccgtgacactgcatttggggggaaggtaagggaactggggaaaagaaggcaaaatgatgacttaaagagactgatgaacccaaagctctcttgtgaagccccttctagaataagtccgtctcacgttacagtgcttaggaagtgttagatgtactgtcatttcttcaacatatatgtcctatattagtctattctcacactgctagtgaagacatacctgagatggggtaatttgtaaaagaaagaagtttaacggactcatagttgcacatggctggggaggccacacgatcatggcggaaggcaaaggaggagcaaaggggcgtcttacatggtggcaggcaagagagcctttgcaagggaactgccctttataaaaccatcagatctcgtgagacttattcactgtcacgagaacagcatgggaaagacctgcccccatgattcagttacctcccaccgagtccctcccatgatacgtggggatgatgggagatacaattcaagatgagattttggtggggacacagacacaccatatcatgtcttggcagccatctatattcaagacactattctaggtatgacataaaggatggcaaaaagtcagttacttaaaagtgtggaagcagagtgtcccaggcggaggaaacggtaaatgagacctctggtagtaagaagcagtgtagcatgtttgagacactgaagtccaatggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatatggtgtgatatatgaaatgacatgtttgaaatgatagatgacgtgattgtgatataatatcatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctttgtcttttcttgctgaataagaagctgagagggaggcaattgctgtcactggtccagccggctcagcaactgcacatttgtcaaagttcttcatccccagctttgtgattctctaggttattcattcttctgggatcgtagatggccaccacaggttcactgtggaaagaggggtaggaatttttaccagctgggtctgactccaccccacccccacccctacccaccgttttttgtttttgttttttaagatgaagcctcactctgttgtccaggctggagtgcagtggtgtgatcttgactcattgcaacctccgcctcttgggttcaagcgattctcctgcctcagccgagtagctgggattacaggcacatgccaccacacccagctttttgtatttttaatagagacaggatttcactatgttggccaggctggtctcgaactcctgacttcaggtggtctatccaccttggcctccccaaattctgggattacaggcatgagccaccgtgcccagccgtgtctgaccattttatcaggaaaagcaaaagcttttctagaatctatcaactcccttctgcatgtgtctatttggcatgggctgtgtcacatgacccctgagctgcaaggaatgctgggatacgatggaagcctgccagaggtagagccttgggaagggctgatagggcctctaacctaaatgtccaccaccagaggtattacagaggtttgagcaagaaattatggtggtcccagggatgatgcattctgataatcattatcatcaagaggaatgtctaaaggaaaggggaaaaaaaaaatcagacagtcacattgaaatgaggtccttaagataggccctaatccaatatgcacataaaggggaattttgggcacagagacagaggcagagatagagggaagatgatgtgaagaaaaacatagggccgtgtagaggcagaggcagagattgaaattgtgctatcatgaacgggggaatgtctgggactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccagtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccaggtttgctttacctgatctcactggcttcatgtttattatcttattttcagtttcaaaagggcatatcctgccccctttcccaagatcagaggataaggaatgtcttgatgttctcagtcgtaaaattaggctaataacacctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgcaataatgtaattgaaataatgtaatacaatcctgcttaatattacactgtatatattcattgacttatagactgagctccttatcttgttcattgctatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttccctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggccattgcatgtttatagtatctcttttttatggctgcccaagttattattttttattggtttgggtacttaatttgcacatttgtaaacaattatgtagttacacagctgttgtaccacagagaccatatgcatttccatgttaagagaaaagtccgtgagggattctcactggataccatcataaaagaattattgtggtgccaaaaaaatttaaaaaaacgactagctcagaagttatcattgtgtttttatagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggggctctcttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctgtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagtaattttcatatatacttatttcctctgaaatgtattagtaacatttgtaatttaccaaatggaaaatatcacttaactttaagcttcatcaagttaagaatgaatttgtaaccaggggtattatgttttctcttattataacaaacaccaatcaaaaacaaacaaatacatgacgggaaagaaagaaaacccagcatttattggcagtatttttctgcaaaatattatttgtttccctttgcagttttattcattttaagcacgttttcaccaaagtgttctattctaagctagtctcaattcaatttaaagtggaaggtttttttcagtttagataatttacatataaaagcgttactgtacattttatgaaatgactgttttcagaaaacaacgatttcaatttaatcgtattgttattctgcaagttgaaatgcctcactcttgcttcttggtcttactgacaatattccttcttgccctaattttaaatggtgagtgtttgaaaattgatgtgcttcttttagaccctaccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttctttttttttttatgacacttttcttctggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagtgcccaagtgccttcctccaaaagtacattagatactttcttggggagagaagaaattagacaggagctacaaagatggattaaaattaatttggtcctaactaaaagataagttcctcccccatcctcaggatgaaaccaagagcacttctccatcatcaggggagccaagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacaaagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcctccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgtcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgatcctgacattccagtcccaaaggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctgaaaagtgaccgtatgaaatgagcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcagcactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaacgtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttctcttttcttttcttttcttttcttttcttttccttttcttttcttttcttttcttttttcttttcttttcttttctacctctcgggattctgagagcatcctgtaatgttggaaagctttctgctaatccgggcattggagtgctctctgggttcactcctgacagttctttattgctttcccacctctgccaaggtcaaaaatggaacttgcttcttgttctcgtatcactcagactaagcagttgatgtaacagataacccccaaatttcagtgatttcacatttaatctgtaaaaaatgaggatttgtttatagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttaccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcagctcgtcacccttgagattgaagctcgcactctgtaagctctgaataaatattaaccatctcctgaaccctgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggagaatattgaatcatgggggtggttcccccatactgttcttggggtagtgaatgaatctcatgagatctgatggttttataagggggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatggagtttcactcttgttgcctaggctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatgtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctccttctccttcttcttctctttgttctccttctagttctcctcctttcttctttcttacttttactcctccctgcttcccttccctccctccctcttcctccctcnnnnnnnnnnnnnnnnnnnnccctcttcctccctccctccctccctccctccctctctccctccctctctccctctctctttttctctttctctctttctctttctgtgtctctcttttctctctctctctctttccttccttccttccttcttttcttccttccttccttttttcttcttttttttggaaacagtcttgctctgtcacccaggttacagtgcagtggcatgatcacggttcactgcagcctcaacctcctggggtcaagtgatcttccccacctcagcctcccgggtagctgggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttattccagcacgtggcatcgccagtcccagtgcccttggcagaccatgcagaatgcatccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggtttcagtgagctgagatccagcctgggtgacagagcaagactccatctcaaagcgaaacaaaacaaatgagggtcctcatcagcgtgcctttgacactgtcctctggtcctggtgatctgaatacatcaccacagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcccttatgtcaagcttctttcagtaacaactgaaaggctaatagtagtgctgtgtggggaggactttggacttggggattggactccatgggagaggtcagctccttgtctccctggtggtgagacagggaatggtagagtgtgtcctacctatgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctggagtgcagtggcccagtcacaggttactgcagccttaacctcctgggttcaagtgattctcctgcctcagcctcctgagtagctgtgactacggacacatgccactacacctagttgatttttgtattttttgtagagatggggtcccactgtgttgcccaagctggtctcaaactgaactcctgagctcaagcgattctcccgccttggcctcccaaagtgctaggatgatgataggcaggagccaccacacctggccatggataacatttctataaaatataaccatattttcaaacaaagagaaaagtggcgttgtgctacatttcttctccagtgcttggttccctagaagacagccagattctcacttcttttcctgcattcagtctcttgtgatatcacatggcatgtggcctctgaaaaactccgctgtctagttgtaaaagaatacaagtaagtagtcaagtgacaccttagcattctgatgaaaagagctttgacctcacagagcttctggaagggtctcagagacatccctgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaacggtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcaatcccagcactttgggaggctgaggcaggcggatcacttgagctcaggaattcgagaccagcctggccaacatggtgaaaccttatccgtaaaaaaaataaaaaattagccagacatcgtggtgcatgcctgttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggaagatctcttccagggcctctggaggaagcacagtcctgctaactcttaatttgggacttctggcttccggaactgcaaaagaacaagtttctgttgtgtgtaggcacccagtttgtggtaatttgttacagcagacatagcaaactaatgcaaatgggctttgcttgaagtccctcagctgctaagggtcagaaacaggatttgaacctacagttttgaggcctgaacctgctatgcagtgctttcttcctgatagtgaaaccactgtggtcccaaacccacagggctctatttagatttaaacaagactatgaatgtaaacagacacagtgcaatgccagatccagagcaatcgaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatatggtcaagttgcttcccaaaaagcgtctctgtcaggatgatcttatgaacgacgttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaatgatccacccaacctagcctcctaagtagctgggaccacaggtgcatgccaccacgcccggcaatttttttttttttttttttttaagtagagacagggtcttgctgtgttgcccgggatggtcttgaactcctgggctcaagcgatactccctccttatcctcccaaagtgctgggattacaggtataaaccaccaacccagcctcaggagaaataaatcttttaggaaaaaaaagtgacacagttttctcttgtggcttatcacttggaatgtggagagtcatttccattagggaaccaccaggaatcttggcaacttagcagccacaggagatgcagaaactgagtagtgatttaaaaattcagatcactttgtttgttcccctagaataatacattattatcattaacaaagtaactcaacttacagtatcaaatcaactgcagagccattgatattgatgttaccgtactatccaacacattatgtttagtgttgatttaagaaaatgttgattttatttgatgtcatgggtgggaaattgcttgcttttgttttttgagtgaatctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcattccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggataaggccagggtgcagactgggcagtagttccctgtcatgaatccactctgcagttgttttataacatgcaacaaaaactaaagtctaatagcactccccaatgccaattttttttctttctcttttttttttttttttttgagagacagggtcttgctttatagcccaagctggagtgcagtggtgccttcacagctctttgcagccttgaactctgggctcaattgatcctcctgcctcagccatctgagtagttgggacaacaggtatgcactaccatgcccagtgaatttaaaaaaacaaacaaacaaaacactttttgtagagaaagggtcttgctatgttggtgaggctagtctcaaactcatgccctcaaatgatcctcctgccgtggtctccaaaagtgctgggattacaggtgtgagcccccaaccccaaaacttgaatctgggccacctttactgacttacttattactatgtagaatatggtacaggtgacgctgcagactcttgaagttaggtcataaaagatgatcctgcttccgtctggttgtgtctctcactcatgggatgcttaccctcaaaatttggccaccatgccatgaggaaactcaatctagcgtaggtaggaagaccgtgagaggcccaaatagagaggaattgaggccgccagtcatagtcagcttcagtcatcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactcccttggttaatttaaataaaataaaagtaaataaggggaaattgcatactcctatctggactgttttcttatggttttggaatctctggcaggtagaagtaattatttctgtaactcttaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctaagcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgccactgcactccagcctgggcgacagagtgagaatccgtctcaaaaaataagtaaataaaataactaactaggctaggcacagtgggtcatgcctgccatcccagcactttgggagtccaaggcaagaggatcacttgagcccaggatttcgagaccaacctggacaacgtacagagacctcatctctacaaaaaataaaacagctaggcatagaggcacacctgtggtcccaggtagttgggaggctgaggcgggaggatcctctgcacccaggtagccgaggctccagtgagtcatgatcatgccactgcactgtagcctgggtgataaagtaagatcctgtctggaaaaaaaaaaacacaaaaaactaaataagtcgtccatccgtccatctattcatacacacacgtaaaatgaaaactaaagcaaaagagtagtattaaattctagttagagacttaggatttccagtgactgaaattggaatgttaggtgttaaagacacacatcaaaatgagactcttggttttttttataagtgcaaggattgcaagatacctgaaaagggagtatttttcccccacatgcatctcaggagggtagcctcagatataagcttaggagtcctgaatttatcatcaatatttatatcgctgtttggcccctaacaccttccctatgatagccctaattggaatatagtaaatgtttgttgcatgaatcaacctatttaacctgtgcgtccttaaatcttacggtctgcgggttgacatttctagtgaagggagacatttctttacctacctgggacctcagaccttggacctcactgaacttgagagcagagctggtttatgtgtaactgaacctgatggttagtttcctgtttcaacttgattaggtcccagtcacagggtgcccacatgtttggtcaaacatcactctggggtgtctgtgagtgtgtttctgggtgaggtgaacatttaaatcagtcacctgattacagcagattgttctcaagtgcctgagcttcgtctcatcagctgaaggtctgaatagagcaaatagactgaccctacttcaaagagaactccttctgcctgatgactcaggtggggacttcagtccttttttttttttttttttttttttttttttttttttttttttgagatagggtctggctctgttggctaggctggagtgcagtgacgcaatctcagctcactacaacctcagcctcccaggttcaagcgattctcctgcctcagccttcccgagtagctgggattacaggcacccaccatcatgcccagctaacttttgtgttgttagtagagacagggtttcaccatgttggccaggctggtctcgaactcctgacctcagatgatccacctgccttgacgtcgcaaagtgctgggattacaggggtgagccaccacgtctggcctgacatcagtcttttcctgccttcagacttgaactgaagcatcagcatttcttgtgttttgatcttgctggagttggactgaaactacacatcagttctcctggctctccaccttgcctatagcggatcttgagactttttcttattttatctatctatcaatccattggtcatcaggttctccagagaatcagaaccaataagagatgtcatacacaccacacacaaacacacacacacacacacacacacacacacactaatatggttctgattctctggagaaccctgactaatacagaggcaagatcctgttttgacgtgcttgaactcgaggacttatgccgatgttaactctgagtgttcctgttttatactcagccatacagatgctcagagcatacctgcacaagtcaactttttgtgtctgcaggcatgggcctgccctgtacatgaggagacagcagacagttcctctccctgctgctggcctcttcatcttctcctggcgtcaccacggccaccgtgatgcctggctcaagtactagttctatgtcaatgatggtaccaatggactctaactttagaatgttgttgactgaaggcccctgccccctgccttgctttaggtggaggatctggtcaaggctttgtgaatcaggggatgctccacacctttctgctctctgcaacagggccagggatctgagtcccttcttgtctatccagaaaccgtatacccagtgttctctttctctcacctccgaataggtgggccttcccaatttacctgtgagaaaactagtgtgccacctcaagcgattctggcctctgttgactgtctgaaccctgtgttttgttgagtggtgcagactagagatgaagacagggattcggcttcgcttgctttatcaagggaatgttcttgggacaaatgtgtgacaggtgaggaaaacaacataggaaaggagacagaagtgaagagaagatgtggtctcaaatgaagtctggcttcaggtttatccttggggggctctggaataaaaatcacacctcaaacttgacccgcttgaggccagaaggccgggctgtggtaccttcgtgtcggacagtcataggctatcctcatggggacctgtatgttgccaggtgtcttgggcaaggtggacaaggatgccagcaaagtgaaattttccagagaaggtcacaaaagctaggaaatggcacagcagctgctaaaaggggatctgaccaggccaccaacagcttctgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggcactacaggcgcatgcctccacatctgactaattactaaatttttaaaaatttttttagacactgagtctcaccgtcttgccctggctggtctcaaactcctgggctcatacaattcccctgcctcagaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcaagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatatgtagtcttttattcctcaccctactcccacccttctccctgagttcccaaagtccattgtatcattcttctgcctttgcatcctcatagtttagctcccagtctacagggttatattaaaagaggaaaaggggtataagaatctaggtatcatggatgatgtcctggtcctttgctgagtcccatttttttcttcctcacctgatttcccccatctggcagaaacttttacagagtgtttgcagaagagaagcctgtaaactctggagtgtgtcctgggtggtttgtccttgggccactttattccctcaccgatcccttccaaaggccatgagttcccagtcagtcatttccctatatcagtatttattgttttaatcaattttccccatcccaagagaaaggcaccaacatgagtccatgtgttttaacatagcaggggtttccctgtcagagcccggtggacttctgtggccataagcaagtcaaggtgggctcctaagtggcagctgcccacttccagaaagctagaggttctaattatgtcttcctgaaaaacagttcaattaggtaaagtgacattttttaagcccttgtgtgtgtccgactcataaaagttcagaaggttgttactgagaggagactgcagtcattttaagatttcagtagctgctggagttgagtagataatttttcccctttctaatattatatattaggtgtgctcttgtgtctgggtgaaacagagcaatcacaatgattgttttttcagtatggtaataattaggcataaaatcaatatttatgtgtaatgtgccatttgaagattctccctgtgtatgatgctgggttttacaaaggaaaatctggattcaggtggccaatgaagtgtcacgatataaaaagagaattttgaaataatgagaattccactcctttgggagtattggcatatgttaaaatacaaatatatctgtatttttctcacttttattagaagagtgcaagtttgttcaaaacaactgctggattatctagtccctgaacagccatttatatttttgttacgcttgtggtttttaaatcatcctcatttccttgatcgcatttgcttctcctggctagaatgtgtaggagacgggtcggggagactgtgcccatttgacaggtgtgaatgcgaacagaggctgcagctggttagaccagggctgtgcaaccctagagccattgccttgaccacaaagccacagtctcctagtcctaatattaagaggtaggaggtagatagagattgtcccttaagccacattccattcttcatatttttgtacccattagagtagtgctgatcatttgccttcattgctggggtcccctaaatgcaacttctcatgctgccaatttagtcctggccctaggaagacgtaggtgataggatagaattcaacaactagaagccatggtttcctggttggatagacttcctctgccaccagaataaaggaatagagggttcctcactgtgccccatagctgcaaagtcacaggaagcttgcagcaggccagtggtaacctctgagtgacttctgagttcccagagctaggaccatgacttttcccctggattcttaagtacccggctaaaattgtgtttgccgaatgaaagtgtgatcctggaggccatgttgtttgtggttcatggaagggtgcttgttcagcttggtcaaagcaagatggtcatactgggttttggtgcccagacgttcccaacactcgcagcagagggcattaggatcatgtttagccaacaattttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcctggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtcgagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggaccccggctggctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttacctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtcttttccttgcaatgttttgtaatattacatgtagattgtacatcgtttgtcgataaatcagtgtacaaatactaggggtgagtgtgctcaaaacttatttttactgataatagtccatgatcaaggcagtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctcccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcagaacaggatctggaggcagggaatctaaggctgattcacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaacctatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcctccagtaacataatgaatgtctggatgtggtatgaagagtattggggtacaccacagcagcgtgtgctctgagaacacagtaaacaggcatttgatacagatcagaaggtccgtaaaggtggtatttgaactaagttttgagagctgggtaagagtttgtgaaaagacagggcttaaggaaggatatagtaagctgaaggcacaggactttagaaacacataggctataactgcaaggtgtgtctcagaaggtacatgtgacgtttcatttttatttgtttgcttttttatagtgactgcatgatcattatatgcagaagacgcttgaaggggccagattaggaagggcccatggtccacactgctttttttttttttttttttttttttttgaaacggagtatctgtctctcacccaggctggagtgcagtggcacagtcttggctcattgcaacatctgcctcctgggttcaagcaattttcttgcctcagcctcccgagtagctgggattacaggcacctgccaccacacctggctaatttttgtatttttagtagagatgaggtttcaccatgttggccaggctagtcttgaattcttgaccttaagtgatccacctgcctcggcctcccaaagtgctgggattacaggcgtgagccactgtgtatttctattaccagcctgcactgcatttctattacccgaaaacagtgtggaaaatattaattacaagggagattaaaaagtaaaactggttggttggcctgaagacccacatggtgacttcactaaagtcattgggtaagcaaagaagagcaacactctagttttcctccaagcttcaacgttttctgtttcctcctatgtcaggtcttaatttccctacctgattcaggctgcgctaagctgacttcatcatgactcctggcttccccagtccctgcttcccagcacataccatttattcagtgttggccagtgacgcctgccactgcattttattgatgaagaaatggagatctcaagaggtaaaaaaaactgactataggagccaagactagtttagagtggagtttgaatatgaacatgcctctgtctgtgaaagccagtgtcccttcagccaggatctttcctggaagaactcagtattaaggcacttgattagttcttcctgttggtggactgattgattacatttgaatctttcagcaagcttttggctgagctgggcatcttccccgccttcctccacctctgccttcaaaagcctgaatttccaaggctttctgccatgagtacttagctttgaaaaacatgagcatatttttcattcttcttgccggcctctccctgtgtcatgcctgttattcttttctccctcaacattgacctaggtcagaaggaccctattttaatgtttagcgtttgggggtcactccatagagaggggtttgtggaaatcctttttttttttttttttttttttgcttctttctgtggatctgtttggaaatgtaacattttaaagcccttcttggctggaggattttttatggtaaacataaaacgttcattgaaacattaaacattttacagctgtttttcagcacataaattttcatagacatccaccccctcactgccacaccccctcatagatttcttcttttcctcctccttctcctcctccctcttcctcctctttttccccccccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctcaggaaagccagagctaagatggtgcaaaccagcatgtgatttgtccaaggacatcgttttgatatgatgaaccatgggtggtttgggcatttgtcaaagcagggtcagcagaaagctgacgtagttgggtctaaagtacaacaggactgagcatggtggctcacacctgtaattctagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcctgggaagagtggtggggggcactttcttgcccattttttttttttttttttgagatggagtctcgctcttgtcatgcaggctggagtgcagtagcacgatctcggctcattgcaacctctgcctcccgggttcaagcaattctctagcctcagcctcccaaattgctgagagtacaggcatctgcgaccacacctgtctaatttcttatctttctaacacagtttaaatatcactttctcagaggcctaccctgaccatcctacttaagtaacaataataaaataaaaatacccatcatttatgaagtgctcattatgtgccagcgttcttagcatctcccaacaaccctaggagacaggcattacaatgagccttcgtaatgttcagatgaggaaactgaggctaagagagccttggcaagctgagttacttagctagcaaatggtggagtcgaattcaaaccctgcctctcctcacccactctgtttcttttcttttgagcacttaccactttctgaatatgtatacaattgtttcctcgattactgtctgcctcttcttccctagagcgtcagcccatgagcttatccagcctacagaggagatgctgcagcttggcagagcatggattgctcaacataccagagtttagtcctacctctgtctccaagctgctccatgatcaaggataaactataatctttctctctgcctcagtttttccacctgtcagtggaggggcatgctcttggatgcctgagtttttcttagactcagcatcctgcagccgaaataaccatgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccaggcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccgaatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcatagtcctccatgaccaagggctgtctgcatgggtacgcagataaaacatgcactgccatggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgttacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctccctccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctcctgtggtctgtaagaatgggaccaggactcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctattgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttgtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagaaagccatttctgcagagttaaaaaatacgtaggttcagttccttaccaacacgtagacatgttgtgatgaaagaaggaaaggaaggaaggaaggaggaagggaagaaggagggagggagggaaagagagagagagaaaaggaagagaaaggattttctagaaaaagaaaggaaggagggagggaaggtaagaaagaaattaattcccattttagagtaagactggaggcagagtggtcacccagatgaaaatgaataacccaactgtgtctttcttctggtgcctccacgtggaagtgggctgccacaatacttctaaagagaattggcatttttctttaaataaggaggaggatgaggagagagacgacacaaaattcactcacagaagtgaacataaattctaacattggtaaaactttgtctttgttttaaataatcagtcagttgtctcaatccataaaagagtatctcttgtacaatgtctgcttttgagtgattcacttcgatgcgtactgaaaatatacctttaagtagttgagtgacttgaaatattggtaaatgttctttaatattttgtctgtcagtgttagagactatcaggttaaaacaaagatattctttctttcctttttgtttttgacggagtctcacactctgttgcccaggctagagtacagtgatgcgatctcagcttactgcaacctctgcctcctgggttcaagcgattcttctgcctcagccttctgagtagctgggattacaggcacacaccaccacacctggctaatttttgtatttttagtagacacgggatttcgccctgttggccaggctagtttctaactcctgacctcaggcttcccaaagtgctgagattacaggtgtgagccaccatgcctggccaagaatattctttctaatatgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtgtccaataaatttaatcacataattacttaaatggcctggcgagccgccttacctagctggccaggaattccaggagtcaggcttcctgatctaaatctgtcctggtcccatcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccagctactcaggaggctgaggtgggaggattgcttgagcctgggaagtcaaggctgcagtgagcaaagatcacaccactgcagtcaagcctgggtgacagggcaagaccctatatcaaaaaaaaaaaaaaaaaaaaaaaaatatatatatatatatatatatatatatatgtatatgtatatgtatatataaatttaaggaagcatagaattgaagaggctattccaaggtcacatgacttttaagtggcagaaacagggggaattctgtctaacacaatccaatttatccatctcaagaaaagagatatgccaaagagaatgattattaaattatcattaatgtgaactcttgtaattactctcataattttctttaggcttatcccattgggcattgctaagtattattagattgtgattataaatggattccgccaggcatttctcttttgctctgtggcagctctttctctagagaacttggtccctggggatgccatcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagtctttggatgttttaattatataaaaaaagcatggaaactgggcattttaattagcaagtacagccttgacacaaataaaggcatggctttggttatgcagtgcatttatttggttttcttgaaataagaaaaaaagatttcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactattaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccaggtaaagcaggccttgttgctattcccctggaccatgatattacatgttgggatgatggggtcttgtgatactgattaatttaaggctgcatgatgatgagggaggaacaaagatgttcttgagtcagtacctgccagagtggctgtatcctggtgttgtaatatcaaataattctacattatttagtaaatagccctgcccgaagcctctcagtgccacacacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcataggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgacacatacgctttttctccctttccagctggccctgttgcttaaagtggcagaagtagatgtcatgttggcagacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatggactttagccagaacacactgaaaaacacgagaaaagttggaagaaggaattatttttagtgttctgagaatgctttattgatattcctatgagagtttcattggttactgacgctgtgtactgattgggtaaattctagcatttttacactcctttgtttcaccctgtttgttcattcattcttccgttaaactacaattaagcaactaccatatctaattttaaggtggtggacaaagaatcaaacctaagttggggaatgtggcctctggtgattctcagttcttggtagccatgtctcagcatagtcttctcggacacctaatactactgacctgtataatcgatagggtattgcagacatcagagtatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctaccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactgaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaacacaattccaagtgctacctctgcatggcagaaactgtcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattgtaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcaggccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatcaaggtccttaacttaatcacacttgcatttgattttatcatgcaaggtagcatactcacaggtgggattaggacttagacaccttcagcaagaaacattactcaggccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccgggagcaaagctgctgtgggacatgagactctttgaggcagaatacctctcatgcctggagagcattacaggctgcattagtctgttttcactctgctgataaagacatacccaagactgtgcaatttacaaaagaaagaggtttaatgaactcacatttccccatgtctggggaggcctcacaatcataatggaaggggaaaggcgcatctcacgtggtggcagagaacagaagagagcttgtgcagggaaactccgctttataataccatcagatctcatgagacttattcactatcatgagcatagcacaggaaagaccctcccccatgattcagttatctcctaccaggcccctcctacaacacgtaagaattatgggagctacaattcaagatgcgatttgggtggggacagagccaaaccatattacaggctaatgactgagcgggggctgtttcttgttgtgttcttataagaactattgcattttctttttcttccaaatatagttaatggcctcatcttttctggactaggtttgtagtagaccataagcaaaagagttcagaaagcacggcctccaagaagtcggatctgcttgtctttatcaatctgtttggattttcctggcccatttactcacaaatttaaaagacatgatgagttttcagggagaactctttagcatttacattttaatttagttttgtttacctgtttagtgccctctcggttcccagaccatcaaactcaccattgtcaccggggagaaatttgtgttggctgaaatctgtagtggttggtctgctgcttttctttctctgctcatctaccctgatagtttccctgtggtttgtggtgggctcacagctcttgacctcaggactctcgctggtctagaggagattggtttgtgggggcgtctgacatgtttgggttctttgtgacatctgggccacccggttgagtctgacaagaaacacttaatacctccttggctttgaagctctcctttgtggcactacaaggtcctctttgaaatcccacattcttttttggatttaggtattaaccccttgctgtgaggagaaagataattgtcaacacacttaggagagaaatcatgcagtaaagctgacccgacatagactaacttaaaactaactagttcattagtgctaacttagttcattagtgctttatctccttgtgtgtgtgagtgtgtgaggggatcaattatatacataagacaaagaccacctaggaaatgtttgagaaactgtgcagtgaggatgaatcaacaagtaaatatcatgagaatttcttagattgaagaaatattactcctatttggtgtcaactctgtgctggccttttcactcaagttctctgatgtaactgcccacagtaatcctgtaaggtatggctaatcatttccattttatagattaggaaaccaaggtccaaagtggtgaattgatttgaccaaaatcacagacccaggaatttcctcagccaagagcctacagcagctgtgtcttaagactgtgccctttcatccaccctcttggtactcaaagcttggtccatgaaccagcagcttcagcatctgctgagagcttgctggagatacagaatctcaggcctgactgacccgaggcctgctgagtctgaattttaaccagagtctcttggtgactcgtgtgtactttagaaggggaactgctcaccgcccccacttcccactgagtcgaatagacattaagtgagccttccttatgtgctcagcctgtggtgaggctgcaaagacaatacgacccagcccctgtaatgcaaaattcagagcatagggcagcacactgctgccatgagtcgaggtgacacagtactaacagtgggcacagggggctcggggcacagaggaggggtgcttcccagggagactgcccgttggagcttactcctaagctaattgggaggcaggaatccactgtggctgagaacagcagctctgaatttgcactgtctggtttcaagtccaaattctactacatcccagctgtgtattgtggggcaagttacttaacctctctggcctcagtatctgtatctgtaatatggggaatcataaaagcacctacttgttaaggcatattaaatgcaacgctactttgaaggactcatagtagttaacacccagtttggtaagtgttattattgaaggctgagaacagaacgacaaacaacaatcacaacaaaaggctggggaagattttcctggtggggggaccagatgagcaatagatctccatatgcagaggggtaactgagtacgactctgggacttacactagaacattcatattgcaataaagcagatttttcctgagcacctactctgtgccaaagcactattgtaggctgtggagatagggagctgaagtactgaaagcgttacagtcaagggccagaaaaccattgttcaagcaattggcgtatggcttgatctgtgtttattacaaagcgatacttttccttctaagtactgctttacctgcatcctgcaaattttggtatgttgtattttcattctcattaattcaaaatatgttccaatttcccatgtgatttcttcttcgaccctcacatgtttattacagcatttacttgtttctgttcatccagaactcattgaatacctgctatctaccaggcagtggcctggtcacatcttctgacctcaagtagtttatagtccaaaaagacattggctctttgggatagaggcactttttgggggagagaaacatgaatgcaactttttacatagagtatgaaactctgttccaaatctctcaaactcaggttctttgattcttaaggtatttttcactgccgagttgctgtcattgaaacaaaatctgtcctggtcaccactgtatgcccagcacgtagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgccctgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgggtaggacatgtgaaatatttgctcagagagatccagaagtgttgatctgagtaggatcagctggtgctccaggataaaaatcgtgtcaccacttttgccgaaaagtcactgtgtttctcctgtactcagcaggttacagggtgccatattgttttcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcctaattccctgtgagcttgacacaggaggccgcctcctcctccaggcttacttggaagcattctgtcctcttgttggaagggaaattggtatggtagggaggtgcttcttctgggagtgggtttgtaaaatcaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagtggcagtctaagcctcagtttcctcatctgcaaaatgggtgcaattctagtacctccttcctaaggctgtgaggattcaatgaggtactgcttgcaaagtttctagcacagtgtcttgaacacggtaaacaacttacctaggtctgatctcatttgatattgttgctcatagcaaaggtttgttgagtttactacggatataacacttgttcttttttaaaataacttttaaaaacgcaagtgttgaattatctgcattgtgcctttagggcatacacatctgcttacaatattttttgagctttcagaaaacttaagatatggttgagggatgcaggaaggaacaggacaagaacccagatccctgcccaacaggacagtggaagggaagtctcagcatctcgaaatgagtgcctggagaggatgggtggcggctgtgcggggatgtggtagggtgatggtccttgaaggatgctgcagatcacagtggccccacagtgtggggattggggtgggatatgtgacaacaaaggcatccctggcagaggatccagcacgagcaaaggcagaaagtccaggaagtgtcaggaatgagaagagcccagtagaggatgggcttagggacagtgatgagaccttctggtagaggcgttgaacactagggtgagggctttgctctgacttcaggaagcaggtgagaggccctgaaatttccacgtaagattcggggccgggcacggtggctcatacttataatcccagcactttgggaggctgaggcgggtggaccacctgaggtcaggagttcgagaccagcctggccaacatggtgaaaccccatctctactaaaagtacaaaaattagccaggtgtgatagcgggcgcctgtaaccctggctactcgggaggctgaggtgggagaattgcttgaacccgggaggcagacgttgcagtgagccgagattgtgccactgcactgcagcttgggaaacagagtgagactctgtctaaaaaaaaagaagagttggatcacagcaaaggtgagctttaatgagttcactctggcagttgtgccgaggagggactggcatggagagaaaacagaggcaaaaatcacaacctctgtcagagaactcatcgcactatttctgtcctgccctgggatggtggagcctaagggaacagagaggacagagtgggtggcacaggcattgcggaggcagaaatttacgtggcttccatgcccattggtgtgaggagtgaggggtgatcagggatcccagtggcttgaaagtataacaaaagtatgactagatccaggaaatacagctggagagacccaagtctgcacagaaaaggtttacagagcccaggcacacagatgacatgagcagttccaaaggagtgggacggggtgaatgatttgtggtcagaggtgtggtcacacataccgtcccctgatagtcggtgggaactgggtcaggttccatttgccaggggcaggacatactgcgtgccttggccttttctgggctactcaaaaaaggattccaccaggtaaacttgaatcacctagcgctggtagaaagccttgctcttcgtcatctctcctgtgtatcgctagccttattaaaatgtgcagaggagaccgggcatggtagcacacttgtaatctcagcacttggagaggctgaggtgggagaattgcttgaggctatggcttcaaaaccagcctgggcaacacagcaagaccccacgtcttaaaaaaatttagccggctgtcgtgtctcctccgtgtagtcccagctattcaggcagctgaggcaggagggctgcttgagctcaggaggtggaggctgaagtgagctgtgattgtgctgttgcactccagcctgggcgacagagggacagcttgtctccttgtctctaaaaaagaaaaacatgctcagaggccttgtgagttagctctctccaaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacttccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcctcccaaggagctagaggtgcatgccaccatgcctggctttttaaatttatttttattattatttttttatttttagtagagacagattttgccgtgttgccctggctgatcttgaactcctgtgctccggtcatccacccgcctgggcttcccaaagcgctgagatgactgcgccaccacacctgccacaaaatttctttgttatggctgaataatgtttctgtgtgagtgtgtgtgtgtctgtgtgtgtgtgtgtgtgtgtgtgtgtgtttgaataatactcctatgaacattgtaccaatatctattcagatctctgctttcgattcttctgcatatatacctaggagtgaaattgctgcgtcgtttcgtatctgtgtgcttaaccttttgagaaactgccaaactgtcttcaacagcagccgcatcattttacattcccaccagcagtgcatcaggattctagttgctccacatctacccaatacttattttacttaaaaaaatagaatagccatctgagtgaagtgttacctccctgcagtgttgattcccatttccctaatgatgttaagcgtactttcacgtgcctactggccgtttgtgtatcttctttggagaaagtaacatccatttttgatactcacatggctttttggttctatttttgctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcggggggtcggttattttataagcaaagaagtacagccagtatgattttgaagcaactaggccccagtagaaaaaagttggagagtgaaatctcaagcaagccaaaaagtgatagatgagttaaaaaaaaaaaaaaaaaaaaaaaaaaaaaagttgcctggcttggtgcagtggctcatgcctgtactcccagcactttgggaggctgaggtgggcggatcatctgaggtgaggagtttgagaccacactggccaacatgttgaaacccgctctctactaaaaatacaacaattagccaggtgtggtggcgcacgcctgtaatcccagctactcaccaggctgagagtggaaaatcacttgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaattgcccagcgttttaattatcggcgtgttttatgcttttgtgaaatgctcatttcacagcttgctggtgggtctttttgtggaacgagaaagtgaatattcacaccagaaatgaggtactgaccctgaagggctttccagtcaaagagaaaggagagcatgacccgccaatgccgttgtttgtaagcaggaagctgacgctgcgccatggtgtaggggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatataccaggcgctgttacagcccgtgtaatgccacctgggagttggggggagtcaccatcgtccatccgtctgtccatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttttaccatgtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgttgtggagcatgtgggggtcccagctacttggcaggctgaagcaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaaccccgtctctactaaaaatacaaaagttagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggatctggactgggccatggcccattggatggcagaaaggttctcactgaagcccccataaaggtgggactcactgggaaaccgctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagccgagcaatgctaaatgtgcctggtactgagacgtcatctgtggacggttggcaccgatgctaatcagtgctatgggaaaataggcagagcgaggagcgtaagaattattatgtgtgctgtttgatagagactgtacaaggaagacctctctaaaaaggtgacatttggagcagagacatgaaggaagggattgctggaggcagaacattctaggcagaaggaaccgcacgtgcaaaggccctcaggtcagccggcatggcatgcaagtaagccacctgcaacacagcaggtgtggatgaagggaagagaattagcatttggccagagcacgcattttaagggatggagatccatttggatagtcttgaacacagaactgaccggaactgacttactctttgaaaagatcgctctggctgctgtgttgagtggattggtaagggacaggtggtgaagactgaaacagggtatccagttaggaagctaccacagtgatccaacccccagcttctgttgaggttgaagaacctgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggaggtggaggttgcagtgagccaagattgtgccactgcacttcagcttgggcaacagagtaagactctgtctcacaataaataaataaataaataaataaataaataaataaataagagttggatcacagcaaaggtgagctttaacgagttcagtctagctctctcacaaaaaaaaagttaaaatgacaaattttgtgttacatacattgtactacaataaaaaccatttttttgaaaagaatagtacaaaaatgatacttccctctcagtgtattttaccaagggattattagtgtatatgtgtgttcttactggaaatgttaattggacttgtaattctttttttaacttgtattttgggttcaggggtacatgtgcaggtttgttatataggtaacttcatgtcacaaaggtttgttgaacagattatttcatcacgcaggtaataagccttgtatccaatagttatttttctgatcctctccttcctctctccctctaccctcaggcaggccccagtgtctgttgttctttctttgtgtccttgagttttcatcatttagcttccacttgtaagtgaggccatgcagtatttgattttctcttcctgcattagtttgctgaggataatggcttctagccccgtccgtgttctcgcagaagacatgatcgcattcttttatatggctgcatagtattccatggtgtatattcactactttttttttaatccaatctgtcatttgtggacatttaggttgattccagtagacgtgtaattcttcttggaaatgttaatcttgatcatttggttaatgtgatgacttctgggttctgcagtgtgaagttattatcttcccttttgtaggtaacaaatactttggaagagattaaacaaacaaataaaaaagtggtgattgttattaccagcatggctactactagctaattccaggcttcaagccactggggcataggcatatgtttagctcattccacaggaggggaacagaggctcaaagaacctaggtaagttggccaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaacaaacaaacaaaagaaacaaacaaacaaacaaaaagaaattaggtaacttgctcagtggctagtgagtggctagattgtaagcttcatgagggcaggggactttgacgattttgtcggtatcctaagcccctagaacagtgcctaaacatttgttgggcagttaatatatatttgttctattaataagtagagcccgagtttgtgttctccgattccacaccccatgttccttctactacaacttctggctctggcttctggactgtcagtcattagcactccctatccctaagatttcaggaatgttcagctgttgcctagcttggaatggaccatcctctggtcccacccatgggtaagtcattggctgcagagcgcagacatttggctcccttcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttttcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccttctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccgagatcgcgccactgcactccagtctggtgacagagcgagacaatgtctcaaaaaaaaagaaagagttctgaatgatgataggtgttggaatccacgttggtgtgtctcatgtcattttttcgggcagtttcttgacagacccattttgtgtgtgtgtgtgtgtgtgtgtgtgtgtgtgtgtgcgcgtgcgcacacgcatgagcctgtacgtgtccccctccccccccacacatatgcacataagatagcataaggtagttccctggcacatggcgttgttcttaaccatgaggtgctcccaggctccgggcagttccttgaaagactcattgtctgtgtggggggaggggaggctgtacatgtccccacccaacacacacacatacacacacatgggcacatatgatagcataaggcaattcctggcacatggcattgttctgaactgtgaggtgctcccaggagatcttgtgcttcctatcacatgcccattctgcaagtccatccccttattgagcagatgtttaccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctggctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcaatggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctgtgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctggagtcctgcctctgtgacacttgcttactgtgtgacctgggtcaactcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcatggtcggggaagcctcagaaaacttacgatcatggtggaaaggaagctagtgcaccttacatggcggcaggcaagaggggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattaggaatgaagtttaggtcagaaaagtttcagtgattattttttcagaatcattgtttcttggtttctagggtccaacatgccattgttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctggacttttagtttaattttttgtaatttaaataatttaagtagctgatgtgtctagtggctgtcgtattggaaagcacagagtagacattgcaaatacagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgcctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccatctgaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatgacttaccatctactcacctcctgtttgagttcaagggaaggtttgcagattggcctgaaggaagacttctcttgaaaaactcaaaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcgcctaaaattctctcttctacatatctcactgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactacaggtgcatgccaccacacctggctaacttttatttatttttagtagagaggcagttttgctgtgttgcccagactggtcttgaactcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcagtgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccaaggaaggaaaggggaaggagaagggcctttgggactgggtggatgtaacactttctgccacctctactcttcctgctatagattaaaacagaagctctgaattgcagccacaaatcaataatgaaaagctaccagaccaagccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagccctcacctggttttctcttctccttccaagaaaaaacacccataccattcttaacatctctggaagctgggggtcaggagagggagatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatgcgggggaagaagacaataggcaagtaagcaagtaaatatacaagataaatagaaactgtgatgagggagttaaagaaattaaactggtccttgtggaagcaacttcgggggaggaggaaagacagggaagaccattttaaggaggtgatgtttgaacttaagaatcaaaaacagtgcaagcgctgcatgggggagaacagtctaggcaaggtgaacggaagtgcagggtccctgaggcagaaaggagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatttggaagattgttttgcagctgcaacctcaaaacagaagcctcctaattaccaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctgtccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgaatattgggccgggcttggtggctcatgcctctaatcctacctgaagcaagagaatcgcctgaacttgggaggtagaggatgcagtgagctgagatggcacccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgcaatgttcacaggtctttacatgtaaaaacaaccctgtaaaataaataacattattctcttcattctccaagtaagctgaggcagaggattccagcacaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctggggcaacgctaccaacattggtattccacagcattccaacgattctaaatactctcccagagtagggaggaaaaatcatccaaactacttggtaattgaattcaagagtgatggaccaaaaattattaatgcattcccttccgtccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgcaatcaatcattgataagatgtactgttattttatgtttcactaagagtgcgaagaacattgttaattatacaatgatccaaaaatgtcttctctctcagaatgtattgttttatatctattagaaaggctcttttgacttaggcatagatttctcatacatcaggccatttctatgcctgcctgtgaacacagggattttgaattacaatactgaatcctagtgtgatctttctgaagtcattttaattatcacttaaactcaatatggaaagcatcagcaatgcacctatatgcacaaaaatgagcagctatgatcaagttatcaggaaaaaccaaaacaaaacaaaagcacatctccatcatttataatggcccatcatttataatggctgcctgataattggagatacatgcaccagacttgacttaactgttctcttagtcatcagacatttagatttcaacatgctcctgttaagctctccttacagtgtgtgtggcactgtgcagttgaatgaaacatgccatggccagtggaaacaggcttgggctgatggagagggcctacagggccaggccttgaaggggagggaaattgttagctacacgaccaagagacagaagagaggaaggagtttgtacccacaactcagctttattttatgtaagctctttctgtaaagggaaagtagctctttgtaccaaagcaagggcctctgaatgagagctgggagaggccagaatgggcctgtaagaggttgatgtgtatgagacctgaagccctatgcctttgggaaggagaggaaggactaatatttgtgtggtacaaaggatgtgcctggcataccccatatcttttacaaagacataaatgtcttctgaataaaagtatgatgatgatgatcatggtgatgaagatgagggtgatgatgttgatgatgatgatggtgatggtgatgatggtagtatgataatgctgatggtggtgatggtgataggagggtgatggtgatgatgatggtgataagatgctgatggtggtgatgatgatggtgatatgacgctgatgatggtgatgacgatgataatggtgatgatgatggtgatgacaatggtgataatgatgtcgataatgatggtgatgctggtgctgttggtgatggtgatgctggtgatgatgataatgatagtggtgataatgttggtgatggtgggatgatgttgatgttgatgataatgatgatgatagtgatgatgatatcaacagataccatgtactgagcacttactttgtaccatgcaatgcttatggttttttaaatgcatttacaccaaattcttataacaaccctataagtcagtgccattgcttttcccatgtaacgtgcacatcattcaatcactcaacccttgtcataggtagatactattatcctccttttatagatgaggaaaccttggcttagaagggataagctcaagttcacaggcagaaaagagacagccagtcaagccctgactccttttgtgaccctgatgagattacaggtcctcagtctcctcattgtatctgaagactaaagaatcagaaatttgtgactccacttagtttttctccacccaggagccctcaggccgctggtgagtgaagttcttacccattagggattattaatatactagataagagtacagtctctggagctaggcttgtgactttgaacaaattattttatctctctgagctcagtctcctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaccttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttacagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctcttaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatatttcctttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggccaggctggttttgaactcctgacctccggtgatctgcctgtctccgcctcccaaagtgctgggattacaggcgtgagccaccgcgcctggcctgaattaatattttctaccccactttcttaagtcgagacaatcaataaagcaataaatgacacctggatttgtagcgaatgtctatttccatggtgtaaatagtggtaccctgagcaattttaagttataaatatgagatcactgaaagtggagttggggaacacgttattatatagtattttcaccacacacaggatacagtcaatgacttcaagagcataggtaacagtaaaatgtagtaaaacaatttagaagtcatgagttttgagtacttagtactttttagtatgatttatttaatagtaaccttatataatgtttttcttttaattgttttattgagatgtatttcatacactttccaataagcccatttgaagtgtaacattcaactttttttagtatattcgcatggttatgtaattttcatcaaaatctaattttagagtatctttttgtccccctaaaagtaactctgtgcccatagttggcagtttgtcatatcactcaatcactgtttcctttaaagagcttatcattaaagacagcaggcagttacacaacatcttctacatgccaagaatgtttctaatacatgctttatggatttttaaattgtggtaagatttacataatgtaaaatttaccactttggggctgggcgtggtgactcacgcctgtaatcccaacactttgggaggctgaggtgggtggatcacttggggtgaagagttagagatgagcctgggcaacatgatgaaaccctgtctctactaaaaatacacaaattagccaggtgtggtgctgggtgcctgtaatcccaggtattcaggaggctgaggcaggagaatcgcttgaacctgggaggcggaggttgcagtgagccaagattgcaccactggactccagcctgggcgacagagtgagactgtgtctcaaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatagatttgactattctggatatctcatataaatggaatcacacaatatgtggccttttgtgtctggcttcttgcttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcatattttggggagtggcattgctgggtaatatggcaattttatatttaactttcagaggagccaccaaattgttttccacggaggctgcaccattttatatttccacttgcagtatatgaaggttccaatttctccacatccttgacaacactttattttctgttttctttgaaggtatgaaattgtatcgtggttttgatttgcatttccctcatgattaatgatgttgagtatttttatgtggttattggttatttgtatcttttttaaaatagaaatgttgattcaagtcctttgcccagtttttaactgggtcatctggcttttgttgttgagttgtaaaagttgtttatatattttggatactagacccttatcgtataaatcctttgcaaacattttctctcaatctatgggtaggcttttttactctttttatagtgtcttttgatgaacaaagattttaaatcttgatgaagtccactttatctattttggatgttgttgcttctgtttttggtgttgtatctaagaatccattgccaaatccaaggacataaacatttactcctgtggtgttatgatatatatagggttcctggctcataactctcatagcccttgttgcagtctattgttacaatattgcgtgtgttaggcatcaggaaacagaatctctttgtctcctgtccttctttcacctgccccaaggcaggactctaatctttcccacctttttgattgtgagtcttcagaccctccccagagagtcagtcctgccttatgccctggggaaaggaatgctgacctcatgaagctcccataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaagtggtagcaagtgttttcctgagttctgtcatctgctccagcaaattaatcaaacccaaagagggggttatgggaacttccacctgaagcccctcagccagacattctgaagtctctgacttgctattggtgtctgggggtatggggggcagtcttggggactgagcctccaacctccaactaactccacgtagacagtgtcaggattgaattggaggactcccagctgctgtcccctgcttagtatgtggggaaagttgagttgtaaaagttgtttatatattttggaaactagacccttatcatataaatgatttgcaaacattttctctcattctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacccctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctgtccttatgccattgccacactgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttcgttaattcctgtgaccatatggcagcatggttaggatcttgggcttctaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaaatttattttatttttttgggacagggtcttgctctgttgcccgggctggagtgcagtggtgcgatctcagctcactgcaacctgcttcctgggttcaggtgattgtcctgcctcagcctccctagtagctgggattacaggcgcacgccagcacgcctgactgatttctgtattttcagtagagatggggtttcatcatgttggccaggctgctctcaaactcctgacatcaagtgatttgcccgccccagcctcccaaagtgctgggattacaggtgtgagccaccgtgcccagctcagcattattatttttagtctacacacagtgaacttaaatctcctctagaaaagtcagaaggtctacgtacaactttaagagttcagccaaaagagaccagtatctactaccgtggacaaccctatttaacatggaggagataagcagaaactgaaaagaggagcctgttttctctctggcagattaattttctttctttcttcacccatgccttggacatgaaacacaagtacaaaggttcagagaaaatcaaaacaagactgtggtttacaaataagtagtactagtaacatctcactgttggctgggcacagtgactcatgcctgtaaccctagcactttgggaggcagaagtgggaggatcacttaagcctagggttgaagaccagcctgggcaacatggtgaaacctcatttctacaaaaaatacaaaaattagccgggcgttttggtgcttgcttgtggtcccagctactcaggaggctgaggtgggaggatcacctgagcccaggagatggaggttgcagtgagccaagattacaccattgcactccaccctgggtgacagatccagaccctgtctcaaaaaaaaaaaaaaaaaaaaaaagtgaaaaaaaggaaaatcttcgttgttcttcatcagaagcctccacacagggcccctgaaggaagggcagggaagaagggggttggaggtcagtgggaggaataactctgtgactcagtgctttcctgactaccatctggatgtgggctgtatctgcgtaaggtgccgggacagggcggcctcatgaactcatgggaagcaaacacacaccctccctccgatccaccaggcactcgggtttcctgtgtgtctggtgatgtgctgggtgttgtggatctggactgaacggcagtctcaggtttatgtattaggaagcattcagcaggcaggagcagccgatctgagactggcatgggcagtggagacatcattcatctcctgaaacataatttggaggagactgttccagggctggctgagtgactccttgatgtcagcactttgccctgtcgtggtcttggcctttctcttgtgttccccagatgggtttcactgctctaaggatcataccttcgcaggccatctgaagttagtgaatctgaggcatacagaagggctgggtgcggtggctcatacctgtaatcccagcactttgggataatgagatgggtggatcacctgaggtcagaagttcgagaccagcctggccaacatgatgaaaccccgtctctactaaaaatgcaaaaaattagctgggatttggtggcgcctgcctataattgcagctacttggaaggctgaggcgggagaatcacttgaaccagagaggcagaggttgcagtgagccgagatcgcgccactgcactgcagcctgggcgacagtgaaacttttgtctcaaaaacaacaacaacaacaacaacaaacaaacaagaaacaaaaaatacataaaagaggccttctcttcacaagtttttcttattgttttttgtttttttaagggaggaaatttctttcagaagtcagtactggacattcccttatttcaccttgagctacacatcccatagtcagcttagccctgtccctggtgcgggggagcaggactgttgcctgtatcccttagtcattgccgcaggcttgctgcatcacaaaccaccattagacctcagtggcccgcagcaataaacattcgattctcgccatctctgggtttgaggtgaccttggctaagctcccctgcattgctctgctcatctttctcacgagtctggcaatggggctgggaatgggctgatctaggctggacttggctggagtaacccagccccaccttggatctctctcctctacttcccacatgtatccttttcatggttaaaggtagaaacagaaaaaaacaggcagaaacataaaaagctcggagatggcttcctattgcttcttcattctgggccagagcaaatcatatggtcgtgctccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcacacccaaaccttgataaccatggcaatgcaataggaaatctctttatttcgttggtgctcaagtgataccattaagtcccttaagatgcggaatttccttgcccccgctgccccctttctttctttcatcttatctatatatctgtatctatatctaatctattttttgagaaaggctctcactctgttgctcaggctggagtgaagtgatgcaatctcaggtcactgcaactgctgtctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgctctccactcaagaatacaaattgaacattgactttcctcattttttatccagttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacacagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatatagaagaggatgtagggcaggtagggctcagaaggacccatgccatatagcaaagttcttagtaacacaggctttgggttacagcaggctagattcaaatcctgctgtggtcagaatgtctgtgtcaccccagcattcatttgttaggagatggggtcttttgggagatgatttggacatgaagacagagcctgcataattgcatgagtgcccttataaaagtgaccccagaagctgccttgcttcttccaccatgtgagaaaacagcaagaagaatatccatgaatctatgaggaggcgggactctggccagacattgaatttgctgcttccttgatcttggacttcccagcttccagaaccatgagcaataaatttctttttttcaaagctccccaggagtctctctcggtctgttctggctcaggaagctgccttatttgtaacaaacaaataaacaaaaaacaaaataaataaaagctacccagcttagattattttgtcataaaagccccaaaagactatgacaaatccttctatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaccttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgtagacacagggcacagaactgccaactgtggctgctgacacctgtctgactttgactgggttagtgacaaagaaatgactttccttttgtatgttagccctgtgcctggcatactgcaaatatctatggttgataaattaatgttatcatcatcacgtaagcatcttgggaagtctgtaagtaatgggagttggaggcttaacactgatctttgagctggcgatttttccagccaactcattttggacgttggtgcttaagcatatcctgttttcgagggtggtgttggtggtggaggaggtgatggtgatgatattgataatgacagcaagaatgtcttacatttatagagtgttcaaaaggtgccagatattgtgctaagtgctttgcgggcattatgttattcacacttcacagatattctctttctacatgtaaggaaaaaaaggcataaatactttatataatttactcaggattttaagtagagggtagattttaagtccaggcagtccaaccccctgaaagctgactctttaacaccatatgcttctgtcttcctggctgttttgtgaatgagtaggatggaaaggagatccttgaattgggaaggctacccatggactacaactagtacttgtcttcaacctccatctagatggagtgctcacaagatcctctacatcaaacctggcttcttagtccactgctgagtcttcccaattctgaaaaaaaggattcagggtataatttctcacacagatttctgggacagtgctttcttggagcaccacgcctcactaatggaacactcatgtataattctggcttttgaatttttatttttttattaacatacacagtcagcattgggtgtggctctggggattcattctagtgggcaagtctcatatttctcaacctcaggtttttcatctgtaaatggggacaatactgacatctacctaatgtccttgaggatggaatgagatattgagtataaagtatctagtagagtggctagcgtatagtgagtacccaataaatgcaatagatgttggcttttattactgtcaagtggaaacaaaagtataaggtttaagtaagcgaacgaaatggaagataattgaggaagaaaatcagatgatgtctaagataaggcaaagaacattttgtgaatgtttaaatatcctaagacccactaaggaagtttgtggcaatatttgctcaaagacagtatatataataaatactttagactggttaagagaatggctctgaatgtctacctagctatcacatttagaaacgccccttgccttccttccaggactttcttccttaatcaggattgacttaactgttaactcctagaactgtcgttgattgcttggtgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggaggcaagagaaatgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctctggctggtcagtaagaacctttgatcccatgtttctttatcttcttctttttttttttttttttagccatagtctcactctgtcacctaggctggagtgcagtggtgcgatctcggctcactgcaaattctgcctgctaagatcaactgattctcctgcctcagccttccaagtagctgggattataggcatgagccaccatgcctggctaatttttgtatttttagtagtgccggggtttcaccatgttggccagtctggtctggaacacctgatctcaagtgatccacccacctcagcctcctaaagtgttggggttgcaggcgtgagccactgtgctgggccccaactttctttatcaatagaagtggggaaatcgtacctgccctgtctgcctcattggatgtggaagaaatgacataatccatgagagtggcttctgaatgaagagaacctgctaaagggaagacatgatctcaagtcagccacctctgacccaaataagaacacataattacaagactgtattgtataatcatgcaggacacaaggtatgcaattttaagggtcaaagtggtaaaaaaaaaaaaaaaaaaaggaaaatcaaatataaaaaggcagccccgacaggtacgagcttgtagtcatttccccaaatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattcgtccagtctcaaggaactatgataagtagcaaacaatatcccagaaaaatctccagtcaaaaatccactggaggccaggtgcgttagctcatgcctgtaatcccaacactttgggaggtcgaggcaggaggatctcttgaggctaggagctcgagaacagtctgggcaacatagcaagtctctgtctctacaaaaaatacaaaaattagctgcgcgtggtggcgcgtgcctgtagtcctagctactcaagaggctgacatgggaggattgattgagcccaagaggtcaagacggtagtgattcgtggtcacaccactgccctcaaccctgggtgacagggtgagaccctgtctctaaaaacaaaagcaaagtctactaaaaattcactggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgcgggaacaaaagctattttatcattaatatgccgcttttttgttatgtactcatgccccagaaattattgtacagcctgtacttgagtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagctatgggatgtacagcagagtataacaatgataaatgatgttgtgtgtaatttttctactattaacataaagtaatataaactgaaggacactggtctattgagagacttagaagctaatgttccatatcagatgcggccaatgtcaggactgaatacagattaggcagtgtccttttctccccaggggaattaaagtttgagacaccacttgctgccagtggttttatggcattttgttggggccggtggtgcctttcttggtctattaattcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgctgtctctttaacggagagttcatgggcagggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaagattttcttatgaaactgattttactcaccagggatagagtctcaaagttggaggtattttatgttgttttaaataatatcgtcatcacatgtcattttagaccccaaaagtccactccgaatctctgcttatggaattgaggaggggtgaggctgtcagaagccgagggacttggccaaggtcacatggctttggacggcccccctgaaccttggagctcatgttctgtggcactttgcatactgacctttctgctcttttatgctgcctgctctctaatattgtccaaaaaccttctctaaagaaagtacacaaatggagagagggggaattggacatgccattgggagaacaaatttatttagatatctttggctgtgttgacagaagctgcccaattatacccaatatacaaattttaaatgcatattagtcaaagttccagttatgtagctttagaaaaatttctatgtgaatgactacttttccctgaaatacgtcctccatctcaggcactagttaggaacttcccccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcactaaaaacagggttagaatatcttcaatgcaattataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcataattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattgtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacaccactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaaggctagaccctatctcaaaaataaacaaacccttgctattttagcttccgatgaggatatttatccttctagcatttgaatgcagccaaagtccttactgggcaaatttttgagctctcaccccacattaacaatttctctccttaactttgtttctgaatgaagttatccacagagttttaaagtgagtggtgagttgtggatacctcttccgagcaggtgcacccccatcctgccattgtccctctccttagtgtatatggattgatgacatttcagtttcagacaaagggacatttcattttttttaggagattaaagctgtgtaagatatacaatttaaactgaatgttgatattttatagattgttgagtccgattgtcctgatctaaaattaactggttttgtgatttggtgtaaatcgcttaacctctttcaatgttttttcagcaaaatggggtaagaacagaatctgccttgcagagaattaaccgagatgatgtgtggaaagggcctatcccagaggctggtgtaccatggtggcttctcctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatggaattgaacaggtaggttgaacaagataaatgccgaggaagcaagtgtatttaaataaacagtagtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcactttgagaggccaaggcaggcagattacttgaggtcaggagttcaagatcagcctgggcaatatggtgaagccccgtctctactaaaaatagagaagttagccaggtgtggtggtgggcgcctgtaatcccagctacatgggaggccgaagcaggagaattgcttgaacccaggagggagaggttgcagtgagacaagatgatgccattgcactccagcctgggtcacagagcaagacttcatctgaaaaaaaaaaaaaaaaaaaaaaaaaaaaaaaaaacagaaaaatgaacgagtgagtggcaagaaagatgaaatgattttcatcaccaggcctgccatggaattcatggtgccttgtactgtggccagtaggtgcaagagtatctagtaggtgctttatttttaaaaaatgtcttggaatcagtcatagtttaatatcaattatatataaattagtcttgcaggatccaacagttctgatttattccactcacacaacaagtcagttcttaacacaaaccacataggttcttccttaaataaaaagctgtggctatgaagaagtgagagtttttttttttttcctctccaaaccaccacgtgctcttgtgtgttattgtagtggcttcgcagagtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcattgaccttgtgggctcaagcaatcctcctgcctcagcctcccaagtagcttagaaccacaggcatataccaccatacctggacatgtttttaactttaatttttatttttgtagagatgaggtctccctatgttgcccaggttgctctcaaactcctaggctcaagcagtcttcccaccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatagtcagagctcaaaaattgagtactgcttcgtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacccttctttccttcagctgacttccctctccttcattcccaaccaagtttgaccccgccgcagtggagattgtggcagatgggtcagatagcatgtgtcctgtcgctgtcacaagtttttaataagggctgggggtcctcttgaagagcccaggaactgcagtccctcctctatgccttcccctgaacacagtgcgccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatagaaaagaaaaaaaaatcctgtttataccttaggcattctgtgatccttaggatgtagccatgacagtattacgggttttaaaagccacccaagtaatctaaatttcctccaaactaacaattcctgaaagattgaaatattgctaccaatgtgtacggatggtttccattgatatttgggaagtttccatttgtatttgggaagctttgcatgagcaaaatgcccctttctcctgatatttgcaacccatcttaaaaataaaagtacttttctgcatgtggtcttgtacatgaaattaagaatatcactaccaaaatatcaaaatttaaggactagattgtgaaatgtttaaggtaggcaaagaatatttaaccaagaaaggaaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatgtttttcgtagagtcagggtttcacagtgttatgcaggatggtctcgatctcctgacatcgtgatccgcccgcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccagcaacatttttctcatcttttgaacattagggaataacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttctacaaccaagaccttgaactttttcctctcaggatttctttcatgagaacccattttctggccatttggatatcattgatgagggaattgaagcatttccctattctttagagtttcattaaagtttgactatattccagtaacaattgttgcataacaaaccacccccaaatttagtggcttaaaacaacaacatttattttgttcaggaatctgtagtttcagcagggctctcaggaacagcttgtctctgctccagcatcagctgaagcagcttgaaagccagggtctgagatcatctgaaggttgttcactcatgagtctgaggaatgatgctgactggtgggtgggacccttgctggagggtctattggctggaacacctacacattgtctccatgtaccctgagcttcctcacaatatggcggctgggttccaagggtgagcgtcccaagagaaagaaccaagcagatgctgcattgccttttatggccttccatagaagttacatagccctaggttttcctgcattctattttttaggctgtcagacccaccccaaccaggtttgcagtgagaggaaatagaccccacctcttctggaagagaatgtgggactggacatactgccatggccacttttgaaagatacagtctgccacataagcaaacagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttattgtgtcctaatctatgtcactgagtacatccttgctgtttttcatgaattttccactgagtcgcaacatgccactggccagtgaaggtcaggcaggaaacagattaacaacatctcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaaatgacagctataacatcaagggcccgggtttattttaaatgtttttgcttctacatggattctaattaacgacagtggctaaaacctgattcaaatgtggcaaatgtggagtgccatgggatgaagccagtcaatttcatctaggagcattttatggcttatggaaagaaatattctcttagattgaagggcgccagcctgtaatgggcatcagctgattctcagaaagaagaaacaacgtactgttacataattggggcttctccaaagtggcctgaccaaactgtagagctgcttgtttgtctgatacggtagccattagccacatgtggctatttaaactgaaatgaattaaagttgtataacatttgtaaaaatcacttcttcggtttcattaactagcctcatttcaagtgctcagtagctacatgtacctaacacattggacagcacggttacagaacgttttcatttcatcggacagtttaactgctttggagactggttctcctttttctttttccatgttcactccagaattaaagtcaaccagttcaaatgtcccatctttccccacagacatttgtgctcaaaggcatccccttccccatttggagactctcctagggcctaggcccaagcaaccaggactccctgtagtcaaccccactcctcaatttttggcacccatgttattccacctcaagatcatgtcctcttttaacctctctgaatatgctcctcctgtgatacccatagggaccctgaacctctagtcctcaagagcagtcattcacccctttggactatggatccctttgcaacccaggaacaactactgtatggccacttcaaacctgtatatgctgcaagtattttatactaggtagggtaaataataggtcttagatataggtgcaaataattttcaaatatgggtaaatgctattgggatgtgtaaagtagaaatccattttaaagcgttattgaatccatactaacctgatcattacatatttactaattgatgattactaaaaatgtggacctttgtgaatttccgatgtcatagaagggtgttcttaactggaaaagtcagtagccaacattctgggaagtagaggcctcttcctcactgcttcattggtttaaaataaactccaacagaaaaacatgccatcatctttaatttcctgcatcagctaagcatttatttcatgtagtcctcacactagattgagtggttccatattaatatcctacgtcaaagatgagtaaattgagatgcgtaggttctaatttgcccagtgtcgtggtgtgtgatcttgaccactagcctaaactgctattttatgtccacccatcaacctctacggctgcccctcatttgaacacacaaaatatagttgtgcggcttggtggagccatctaaattccgttaggccatttgccaatgctgctattaggggcgaaatgtcatgcgcttgatctaaatgtacttaggagaattctcaggacctgatgaattattattcggaattttatggcctcacaggttgcaggcttcataccaactgcagctaatgagctatgggccccgagaaacactgaggacacacggcgttctgcacacagagtgggctgtttctgtctgttctccccctgcacccttctcagatgcaatctcaagtcataggagaacttgtgcaaatgtttctcctggatggtttcctttagagcatgtgtcctataacttgaaatggttgtctgagcagaatgtttttagaagttagatttttttaggggggaaacaggaaccaaagcaaagccaatagagatcttgaaaaaaaaaaaaaaaagaaaaaaccaccgtggtattctaggaagaaaaaagcatttttcgaatgaaaactttttattatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactccagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccagacctaaaccagtgaattaagagtatggggaagaggagccctcatacagttctgttaaatggtcctttaatattcttcttcagagtgacgggtaccccttgcctatacattttcaaaactacactgaaaatttcaaaacatttctatcagaacacagtcttattctcagctgatctgcaatttccacctggatctgttaaatggcagcttagctatgaaatatcatgttctgcccaatcacctaccctgcctcatatgatcagccggtatatttatgtggacacatgcagccacacttgtttttaacatttgagaatgacagcgtattggcagttcatataagctatcaaatattacatgtcaactcagaaaacatccctaggaagtattatgggaaccccctgtatcacttgagattcttggatccatatttgctgttaacaaaataaattaatagtcaacaactgattaaagcatttccctgctaccatgattgccttgacaaattctgcagtgctggagtattttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaatattgcaggcagagctggggattccgtggccagagcatatttggtgaaccgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtatattattctgcaattgctgagtaattgatgatccttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggccaggctggtctcaagctcctgacctcaggtgatccacctgcctcagtctcccaaagtgctgggattacaggcatgagccatcatgcccagcccccttgtcctcttcttataaggctactaatcccctcatgaggggacccatcctcaagacttcatctaaacctaacaacctctccagggtcccacacccagataccatcccactgatggtcagggctttgacatatgaatgaggggtagagggacacaaacattcagtccctaacacttggtcaagttacttaagcttggtaagcctctctcttcttactgagtcatgaggataataagatatacctgttagggttcttttgaggaataaatggaatttttaaagaattgtgccagacatgtaataattacttgataaactatagctattataacaccatcaaagctgtggttcttaccctcatcattgtttaccctctcacacagtaagatctttctgaaaaggatcaagtctcattctcttttgaaccccaaagtccccagccaccacagagaccaaatacagtaggtaccaatgcatggcaatgcataggaactaggtgtcctaacttggcactgtatctgccaattttttaaaagacaagatgacatcccaaagattggggcatatttaggataatgccccattctgtgagggtggacattatagaggacatcagcagccagccacaggccatctcttggtgccattgggttttgagaccctcagggtgacaccgatttaacatgacaggtcttatgttcttgggtaatgtcaaacaacttcttgaaaatatttgttaaaaaaaacccaaaaacagaaacatatctgactgggcatggtggctcctgcctgtaatcctgacactttgggaggccgaggtggacggatcacctgaggtcaggagttcgagaccagcctggccaacatggcgaaactccttctctactaaaaataaaaaaaaaaaattgccaggcctaggcgcaggcacctgtaatcccagctgctcgggaggctgacgcgcgagaatcacttgaacccaggaggcgaaggttgcagtgagccaagatagtgccactgcactgcagcctgggtgacagaatgagactccatcctcccaccccctaaaaaaaaaatctatccaaaggccttgactaatgcagaatcagcactaatttacaagccccataaactaaagaccccatgtttgtgttataagttttcaaactttttaaatattttcccctgtcttattttctatcatttcacatcttcttaaacacatatatttttaaaagaggttttgactcactggtgaatttgtcttaaaatggaaaaataaaatcaaatataagaattttgttatgaatctttggggaaacacaattagggaatctaccttaataggtaaacccatgtaatttcttatttccgtctagttataggaaaatactgagatacttgtgagatgttttctttttttttttttccaacttgtatacacgttgttctataagtggttgattgtttttcaggaaaaaaaaattcagcatctcaaatgtacctttaatattgcttctgatttttgttgttttgctatcatagcgttacctacctcacagagatgttttaggtcataagtatttttcatttaattttttttccccttaatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcaggaatgtgtgtgcgtgtgtgtgtgcatgtgtgagctcctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttagcaagcatgtagctgcttgcctgagcaagccattaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttagcaatactgcccaggcacatgggctgtggctcaagttttcagtgcaggacagtgtgtcattgcaggagaagacagaacccggccagatcctcccgctgccggcaagcggagtcagttactgggaagccataataattctttcttctagagaattttggcaaaaatgtgcctccatcttacatcaacaatttttcatctttctggaatttttatttccccttcccctcttgttcctttttatcctcctggtgaagtatctccttttccctaaaaaactggaaaaaatgcacttttctatattaattcaaatcatattcaaaaaatactatatgttaaaaaatacgatgtttctgtaatccttacatcccctaataaaaccactgtgtgatgaaactaccaagaagcctctcttgaaaaaaaaaaaattaagtgaacctctactttagaatgttggcttttcatatatgtacaaaacaaaagaggttgcagtgatggcgtggataaaggcacctgtgtacttttccaacctatccaatttcaagatgtatcctttgtggattacattggttcttttctatggaatcatgcaccttagacctgggagaaaccagcgtgacatccagggtcaaggttttccaatcaggtattttgggggaaaaagttctgccttcatgtaacaactaatgtgacatggcagtgtataagacattacagccaaggccttctggttgaagttggggaactgtgggcgttgtccccactagtcctgtcatctgcccttgcaaaaccacccttgggctctctcgcgtgcggtctgtgcaccagctacctttgtgctccccacattcttccacctggcctggaagctgaccatagttggctctcttgccctttcttcttctggttggatttagcaatttaattttcaggcttgctccctgcagggtgtcacttcaccaccttcctctgtagaaggtttcgtccaggccgggcacagtggctcacgcctgtaatcccaacacttcgggaggccgaggtgggcagattgtctgaggtcaggagtttgaaaccagcctggccaacatagtgaaaacccatctctactaaaaatacaaaaattaaccaggcatggtggcacacacctgtaatcccagctacttgggaggttgagacaggagatttccttaagcctcggagatggaggttgcagtgagccaagattgtgccactgcactccagcctggctgagagaatgaaactctgtctcgagaaaaaaaaaaaaaaagaaggtttcatacattttagctgacaagggcaggagctgttcctgctgttactaactggagtacattgcatgaaaccttgctgtttccttaaaccctgcaccgacctttacaaacagtgcctttactaaacactttttacgttacccgttttgagtgtaccatctgcctcttgccaggaccctgaccaagaatttgaaatctcagaccatgatgacctccttgcccaatgcgtaagctgtcctccaaaacacacatttatgggggcagagggagtctctctggaaggaaacttcgtctgagccatggctccttttgcttcccctgggttttaatccttccttcccttcctgttcttttaaggaaatctgaaaaggagcaaaagagctttagaactgcaatgcatctgtctgaggccaaggacagttgtacgcagacctctctgccagtgtttcagtgaccctcctcttgctgcttggctgcctatgagtccatgctgacatctggctctgtctgcccaaatataaacttgagagtgacttccaagatatatacagggctcagaggttctctccccaacccattcactggccctgctctctctcgatgttcccaagtctcctgggtgaccttgtgtgtccttcctgggatattgctcaatcaccctagaactgtaaggccaagtggtcatagccagaacatggcagaaacattcctgcttctattctgcttttctagcatggaatcccctctgccttaatgtgaataaatactccccaaaatgaaggcagaatccagtatctgttgtttaaactaaatccctaactggaccccctctgataaaccctctgataaagaattgatgtaaaatttgggacgctggataggaccaggaagccagagaaagagggcacccttttcttttctagcatttgagttcccaaagaagtaaaactctgtgaatgttcacttcattttttcctgatatatcgaggactccagatgtaacctcattgatagtcttggtgtgttcttcagtatttgtgcttttaatagatattgcaagtgtgtttaatgtgaaaatagaaatggagggcttttaaaagagcttactcaaaatcctgccaattactgaaatctaccagacaagaaggagccactctttttttttttttttttttttttttttttgatacaatgaggggaaatgtttcttccacaaaagcctggccgtttgtctttaaaaattttcatcttttgggtactgagttgtaatagtaaatacagatgtagctgtgtcacattaaaagcacaaccaaattgtagtacaatgttcaggacacttttatgtcactttaaaatgtagagtatcatctaaaaatgagcaattgctgtgaagaaactggggttggctctgattttgtggctcagttttttttggtttcttgagaagatcatctttaagtcaaaagttatgcaatgccaagtactcatctgtgtaatctatttcagtttccaaaatttttcatcacctggttacaaacatctgaaggcaagaaatagccaagattccattgcaagtcccagagtaagttattattagacagaaacaaacaagtaaataccttgggcctgagctattgcccaaaccagtcctgacttggcttgggttctgaccaactgtttttgatcccacagtctgaagtacgtttgtggaaatacaaaggtcaaaccttcccctaaccctctgtaatccctggtggagctaaggaatgaaaagttgcttaaacattttcctgttgccagtttttcttaaacattagtgctattcttttttttttttttttttttttttttttttccttcttcaaccctgactctgattcacaaagaatagggaagcttagccaactgcagtttcaaagtattgcttcttaagcctgggccaagtgtgtagacttgatagaattctgattaatgcatcttattacattaattttagaagaaaccagaaggcatttctcctattcctagtgcaggccagcctgccagaagcatttgcctccttaaagagctaatatcttcagctaccaacaatcataaaactgaaagatctatcggaagagttggcttctctggatgtgcataaggcacactgcaaaatagatgtacagcttggctgaactttgcttcaaatttgccaatcaaaattcacgaacccatgccaagttggctacaaaacctctcgcttggagccagcactaattatgtcaacaagtagttcaagtttagcccctgttaagtcctgtactcctgggtattggggatgagtctttgtgtggtggcaaacgggccctgtcttcgcttggcttcctcctaaaattcccaggacctcttcgggtcccagccctttctgttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatgcagtccagcaagggtctcagtcaaccttatgaagctaaaagggcccatcagagctaatccctattgggctaatgtggccaggcttttataaacctgccttgactcgtgattgggtgggctgccccaggaaggatgtgcccttgcagaaggtagtctctgtgttcaggtactccctggaaaggctaatggctgaaggctacaggttaccctggaagggagacctgggctgcacatcagagcccatctactttccagtgtggacaagttccagctcctgccccagccctgccacaccatcaccctctccagcacacacagcccttctctgttgattagggttggttgagctgttctaccaccttcattgactcaggccttgaagtgcagtagaaagccctaggacaaggcaggcccagttttgaggctgggtgcagaggctcatgcctgtaatcccagcacttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctggtaggtcgaggctgcagtgaactaagatgccacaggactatagcctgggcagttttgagtgctgcctctaccatgtaactagcttgccagtcaagtcattaactattcggggccttagtttcgtcttttctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcaggcccatagtactcaggtgttcattccacagaaaagcgttcactcttctgcactctttctcagtcagttggccactgctgttcagttcacttcttttggatcttctcagccccatcaggttcccaggtgaaatgagccccggctcagcaggccagttgtcttcagtgacccccagtgaggcagcaggtgggacttgattctggaggcaagactcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcagttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacataagagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttggtgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcattggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccggtggctaataaagtagatgagtttcaggattgcaaaatattgtgatcctggcctttgtccattgtgtaatcttcacagtgaccagagtgtttgcagttcctaggaagttcacccattcccaacagtgtcccagggtcaagctcagatgacctgtggtatttttatacccatatatgtgtcaatgtttataacttttaaagttgttttcaggaagcactgaggcatgtggtcgttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactctttagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaacaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccagcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggtaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactacaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttctgcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacatgattgagttacctcgccctgggtccctcccacaacatgtgggaattctgggagatataattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagccataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatataagagaggcacaatctgctttccttttgatggtgtgcagcagcatgatggccgcgcgaatttccaagaagaggatgttggtcgctgatggcatcttcaaagccgaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctaggagactctgaggacagagggtcaaatccatgagtttgtggatggcctgatgatccccagcggagaccacgttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggtgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttctctgtaagtggaagtggtattcattgatcacacactacatgccggacaccaagctattacattttttgaatatgtttcttctttgcctcttgaggactaaccagccgggtttagattatttcctccccgtgtcgctttcctgcccccacatgttaaagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaaaccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctattggacacatgtcctaataataaacgtgatataatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcctccccaacctaaggaaactgagacccagaggttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggacaggatgaaggaaagaagcagtgttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagacaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggccccctgggagtcagagcgttccctccctccttgccactgtaaatgactatttctgtcgtttgcagagtgtccttttctttctcctacagccccatccttaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttgctgagcatctatctgtagcactgcatgtcaagccaagctagagtacagtctcttaggagacacaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaacagttatccattgctgcctaacaaattaccccaaaatgtaagcacttagaatctcattgtctttgtgggtcaggaattagggagtggcttagctgggtgattctagctcagggtcttttctgaagttgccagcaagctgttggctggggctgcagtctcagaatccttgactgaaggggaggtttcgtgtccaaggggctcactgatgtggcttttagcaggaggcctcagttcttcaccatgggggcctctctgtacagcttcaggagcagcctcacaatatgtcatctggtctcccacagagtgatgatctcagagagagtgtgaggaagatgtggcatggccttttaagccccattcttagacatcatgcactgtcaagcaccgtaactttagctacattctattgattagaagaatactagtaaagaccatagttaggagaggggaacctggctccaccattgcaagggaggtctatcaaagaacttgtgggcatattctaagaccaccacactctgccactccacacaccctgactctcctaacacctgctcgcttcactggttcggctattggcagtggcatggagtgtgggaaaatgcgtccctctctccttcctggattagaaaagtcatcatcctgctagtgtgaatccatgtcctgtggtggccctctcaggagggattgtgattaaagaatggacaacccaagggaatcatgtgtcatggtggagcatacaggccagcaggtgagttggggaggcgcctttacagaggaaaccttgagcttcttctgtgatattcattacagaacttcccccaaagacagatgacatccatttataattatttcaccagtgacttttgagctcatgcagttctatttatttttctctctgaaagtaagaaactttctttaaaggatttctgccatttggacaatgtgctatgtccccattggtgttaatcagttggtgggatatagaaaagcaaagtggccaggctcagccttttctctcgatctttttttttttttttttcctttcttaagaaagggtcttgctcttttgcccaggctgcagtgcagtggtacaatcagagatcactgcagcctccaactcctaggctcaagcgatcctccagcctctgcctgccaagtatctgggactacaagcatgcactcctgtgcttggttaattttgactatttttttgtagagatggggcttgcttgcttttttctccagtctggtcttgaactcctggcttcaagcagtcctctcacctcattctctcaaagcactgggatgacaagctctttctttataccagtcctcaacttgcactctttcctgcatacagcttgtttctctaatgtggctgttctcatgtttacttaatggcccagccatctcctcctcctcctcctcctcctcctcctgctttctattctccttcctcatcattgtcctcttctgcgagttcagaaaattgggttacaatacctacaacgtgcagtgaggacactcttttatcataaccccagtaggcttatggtgcttgtatctgatttttcatagtctttcgcttgttaatttactgcacatatgttcctttctcttgtgcattactgatgtgtttaagaatcttgaatatctatatggtgcttagagatttcacagcagttgattgaatgctgttacctcagcatcctctgtgaaactgggtatgactacacccattttgctgatgaggaaactgaggcataagaggatccgataaattacccagagtcacacagctcacaagcaagtgcaggcttccagccaaggtttgctggctcatgcgtttcatgccttctctatggtaccatacaggcactttgtctcccagtggaatataagttctttgaggccaaggactgtgtcttattctgtgttgcatccctttggcttcagcctcattgtcttgagtttattaagcatttggaacatttcagctgaatgagtgaatgagtgaatgagtgaagccatcagtcaaatcagaacactgctcacacatgcatcccaagtccagctgtcgaacgtctggaactgagcagtatggagcctgttaagaccagtgatgctgtggcctgaataacaacaggataggaacattcccttcttctcataaatcttgtaaatttgcattgtttgtgccgaacagggcccgtgtgttctgatagcaaacatggagaggcccaaaaggctgatctgggaccatgtccccattgaacactgctctgtgctgagtctgcagaatatttaaataaggggttaatttataaagtgagctacgggaaagtttccaggattgtcgtgcgtgtgtctcataaatcggcacaaattgaatctaggtttctaggtttctgtgcccctcagctcctaagtaaaccaaaatttattgagaggtgtataggttgccatccaaagaaacatagtaagtgagaaaagtgtatcctcaggaggtctgtaaacaaggtctgaaggctggcagaaaggaccagggtctgcaatgtagaatccccattgccgatgatcagaaagtacagcgtagtttgttgcagatgaagacagggttccaggaattcttgatctttcttgaacattccactgacttcttaacagaataaagattttgtatattgcagagataatttatagatacaggtacaaaggggatacagacaaagagaaaggctaacttcaggatgttgcgtatgtcaaatcattacattagtttacccagaaccaaaaaaattatgcaatatataaatatgaagctttagtttttcatgattgttcgtaatgacattattatgataatgactgtttgtaataatcatgcgtaccaccttagtctgagcaatcatattagcagttcgtaattattgaagggctgtcaggaaccagacactgtgctgagtgttctacaaactgtatttccagtcttcttttttgttcaatttccactcaaatttttaaaggggtttggagggcgttagtgtgcccattttacagaggtggaggaggaagctccaaaaatgaagcccaaggatcttaaggtaatatatgggcttgaatccagtgtatcttgctccgaaagccttgcttttgtcattatccaacattagctgtctttattatagtggccttcttaccacctacaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggggaaatattccttcaatgttacaagcgcccatgagcatgttagtagagcagttgtgtgttgaagaaagagaaggtggagtgatactgaataccccgtaaaatcacacaatcagcacttaagaatgttcacacagttgttcacaaacatattgatatcagaccttatagcagtcctattggctagatcagttattatgaatgtgttttatagagtaggaaacagagatgcgacgtgacttgcctaagaacacacagcagttctgaaactcaccctgtgctaatctgacctcgtgaagaaattgagcaaactaggctccagggagaaacgaaaacaacaacaacaaaaaatgtattgccaaaaaattgctagcagacatctagaaaaatgtcttcaacttcttttggtaggaaaagaggaaaaattcaaatctgaattcaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctagggagggacaactggcagggccacacaaggaggtaaaaccttatgctccatttgcaaagccagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcagacacttctgccccttgccatgtttagtaagtcatctatgttgtttgggaggaaagagaatgagcattcctcagttcctgcactgcaccaggccttgccaatacagtacctcatttaattcttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcccctgtggtttggattcctaatcacgggactgagatgaaacagaatctcttagcatagggggccaagcagtagatgggcttttgcgaagaagttttttcttttttcagagtcagaggttggcagcaaaatatgagagatggaaggtcaagtgcagcagaagagagaaacagggagagtggaggttgttctctagaacatagaagccgcttcttcatcccacacaatggaaaccagagcccagattatattaacgagaagttccagaattgcagatggccctttgctgcttagggaggggggagaagaagaaggagaaaaagaagaaaaagaaaaagagcaggtggaaacttaaaaaaatgtttagctgcatgtagatggcttttattataactgctaggctgaaccagaagacttgagctatgtaaaaatgtcacttgctcttatcacggttcatagagattacctttcaacgcgagtttcattttcatttcttccaacacttagagaagtgaacgaggcagtgactcctttattccctaaccctcacccagcaacttgctttttcctctgtgttttgtgtcattctgtgtgatattgcatcaaggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatccaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcagagaaagcttgaatgagtaaatttactttgtgttgttccaaaggtttctccaaaggtctttgcacctcccaaggctattctcattttgagaaagactggcacagttagaggccaggaacccatcttggctgtgtgccttctgctttgtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggtcattcccaggaagcaaagcgagcgtcaaaaaaagacagggtagttgggccatggcgttgcagagtgacagtgaaccaggaaccagaagagctgacttcagaggaggctttaggcgctcctgcatgttgattcttagagaactaaagacacagttgcatcttaaaatgttgagacttacacgtatacacaataagaatattttctttggctgcaaatgtactataaaagagtgaaaaagccaatcccaaaagattacattggtaggattccatttacataatgttcttgaaattagaaaattataaaaatagaaaacagatggctgggcacggtggctcactcctgtaatcccagcactttgggaggccaaggcagatgggtcacctgaggtctggagttccagaccagcctgaccaatatagtgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatataaaacagcaactggaggatcctggtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctctattttgatatattttctcttcctcccttccagtctctctcttctgttcctagatataaaatggagaggttttaaaatgtaattacatctaactatcccctggcttggtaatatccaaccttttcatgtcctcagagaggtccaaaggctttgctgaaacttgttggtttggcattgattttgacaaaagacagcaacaagatcccctttctaggaacccatgtggattactatggattcagaatggatgcattttatgtacagggctgtgactttttctttccccttcctcatgctaataggtgttaatactttgcaataaatattacttatgtctatgaaatgaactgcatcccagcctgtcagcacatatttattttctcattttagtttctccaggttctcactgttatggagggtggggagggggtagaataaggttaggctggagggcatatctgatttggaaaatacatccctggtgatgttcctaccaagtcacaggcttggttggtgatgctaaattgggactgaggaatgggttaggagaaggcttgaagaacccacctcctaaaaccgtctcatcatcgtctagagatatttctccaagtgcttttgtttccagtgacctcccaaccccaggaactagcgaagccttcaggcaggtaagcgcacaaatcctgcattttctagttaaccatatattattagctagtgacttgagcaagttgcttcattttcctgatcctccattcccttttctgagccacagtttcttcgtctttgagtagagttaacaaattactgggtgtttgaaagatcaaatgagttagcacatgagaacatgctttgcacaaacaaagttgtatgcaaaataagttatcattatggcatgggagaaactgtttgtggacattgcctcccagttgaccctcagtgtgtacttgtggaataattttttaatataaaataattaccatcactaatcctaactgtgcacattcttgactctgtgacactgagcaaaatcctgaacctctctgtgccttgatttctttcacgtcttgttctagttttgaagagcgattcttgtgtgaattcagggagaggaggcatgaggcatggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtcttaaaactcagtatctactctagtagttgctccaaatgtgatgtcctcataaatcaccgagggatcttgttaaatttggattctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatatttgtggtctgtgtttcttataaattggtgatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataagaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctaaatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgcctgtttcttccaaaatctggattcagtgacatcgtgttggtagcttgaaactgaccgtggtgagaatatttacaccatggaaagtggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggcgaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacatattacttttgctaattatgtgtgtgggtagattatgttattcatgaattttatttcaggaccttggtaaggggttatacaatatttcttttgaaacgagggtctcgattattgggcttgagtatcctgatctaattaatgcactggacagagctggcagacgtgtgggacacccagctattctctggaagggaagggggatataagagacacactataaaggtgaatggtaatcggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcccttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggcggatggattgctggagctcaggagtttgagaacatccagggaaacatagtgtgaccccatttctacaagaagtaaaaaaaatcatctcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattcttactttttgggctggtaaagccacctaggtcagtgccatgtccaacccaatctggaaaacgattattgtggtgcctgttttgttgacttaacaaagccagtcgcccattcctatgctgctaagatgcgaatgcccagctcaggggatgagattactgtcagctttgcctaagctttgggcattagcaccctccatatgcaacaaacccacaaatgaaatgttttgactctttgacacagaatggttggaaatcacttccttggccagagcaggggtccggtgtaaaggaggaaataaaaataaaaaagcataaatgaatgaggaagtgagcaaatcacactcatcgaggagcaaaataattcattccctctccgtggctcagcatggatgcaaataatgtatcattaagtaagtccccaaaacaaagacagccagcataactgttgcatcaaatatttagccagagccaaaagcaatttattatgttttttaaaataagtttgatttactaaccttcagcacaatccctatttttagaggttggctcatatttttaatttgttttctctgaagcgctgcatccttggtagcgtttcagctgtccactcggttcctaatggcagagcaacaccgaaaagcgtaattacatttcctaattatgtgtaattaggcaaaacccagatgatgtattcaacatgctctgagaatagccaggggttaaagactgctggaatttggtaacatttttataaataagctggtgcgttatttaacgtggaggtctaaggtgacgctgggtgccttgtagaccgatactgtggttgaaatctatcgtatttgtttatttagccaagtaaaactgtaagtgattccccacctccataccttcccctcttttggaaaccagagtttagttgtgctattcttagcccaagagaggccctctaaacccagaaccataaagttctgcttactgacagcctaagtgatatttattttttcaaagcttaatccttttgaaacatggagaaataaatacatcctcttatctaccatatgcctgggatgggaaataaattcttattttcctgccgtgtggtaccagtgggttacgatgaataatttgggcagtctcactgaagataatagggaagccttctctattaccagtgataattatgaatctcataatggaaaacatcccgagcccgaacatcaatcagggaagataaacaatgggaaatgataggtgtacaaaagggaaaatggcaacagcacatgtggagggaaagaccgcagaattctggcggggttataaatcatacagtcaaataatttccgtgcaattaatatcctcaaattaaaacatacgtttttaaagaaagattttgcagacttttaagctgggcaactgtctgccttacaagatgcgtctggaaaccccagtgccatcctccttttttagtcttgtatatttatgtatccccggccagagttggctggggcacagtctaacagtgtcaccgtgtaagctgacccagtgaccttgctctagctcaccagggactgagcatacaccaaagtggccagagctagtggttgctgactctcaggatctttggccctgacagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcctatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatgagaagttttccattccaaaccctttttaggagcggcctggaaactggagtcaactgtcaaatatgtccttatggccacaaagtatgctcatggattctcttttacaggcttagcataatattttataaaacatatttttaaagaaagtgtaattttcccccaaaagcaagggttttccaatgccatataatttactaagtgtggctttgctgcgtaatagtccataatttatagtcagcctccacaaggcaaaaaataactccaagctatgattaagtaagtaatggacaaggtaactaatatttccggaagaatggccttccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgcctaattgtgccaccagtttttcccataaaataattcatttggaaggggtggcctaatccagtctgaaccaattctaagatggtagcgtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagcttcccctaatactaacatgatacatttttcagcactgagaagttaaccttgttatgatgctattaactacactcagactataactgaccaacagactttatttggatttgacggtgtgtcctcttccttcttttacaaccagataccacctggcatttattatcatatctctccagtcccctctggtctgggacagtttctcatgcattattttttttaatggccttgaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattgggggaggtactttgggactacttctctaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggctttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgtttctttgtttttttctttttgtggagagcagggtcttgctatgttgcccagctcagtctcaaagtcctgggctcaagcgattctcccgcctcagcttccctaagtgttgggattacagacttgagccactgcatctagccacaactgagttcattattctgagctttctttgggatgttatttaactctcagtttcttcttctataagatggaaataataacaactaaaggctaggatttggggaaggtatggtaaattgtaaaaatggtagcttgtttaaaaaaaaaaagaagaagaaaaaggaaaacagtatttccctcaccgcatcaacacctgtcctgtatgactggcattgcccagtggaatcttagcagcagaggcatgacaagcggtcagatactgggactttctgtttcgttgcttacaaccctgtgaccactgcacgaacaaccctgagctgacctgctggagcatggtggccacataaagggagagtggttgccccagctgatagcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatgtggtgttgcctaagggtacggggaacctggcctggtgttgggaggaaacagggtgcagagtgggaagggcaggagtatctaagtggccaaatttagcctaattaacagatttgcctagggctgaccctgaagcagaaagcaaagcctagatcagtctgctctcctcctaccaacagggtaatgatgaggttgaaccaccagttctcaatgccatacatgagattcccaaaatagacgggagttacacagagacctttttttttttaacctcctctgagattttttttaacctcctctgagattctgtatttccttaatgagccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgttctgcccaaacatacaagagtcaatgtaagtctctgggagcactcacctttgggcgtgttgctacagagtcactcattcctagaaattgcgaagtcacgaagttgtcaaaaaacacaacgacaggccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaagaaagaaaacaaccacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctgtctctacttaaaatacaaaattagccgggtgtgatggcacaggcctgtaatcccagctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaagagaaaacaataaaaaaatagagaaaataataataactagccaatgtgtcatcactccagacaacagccatggtcagtatttggttaacccattcagattttcccctatgaatgagttttttcgcctccataatattagttataatacattgatactacatcccgagtgtttcacttaacattatagcacaagtgtcttcccctgttgtaacatagtgattattaatgtcaaatatcagctagataaaagctgtcaagtgatagaaagtccttatagctcataaactcttcaataactgggaatttataccgtttatagtttttttactgctaagaataatgttgcaatgaaacgtttgtatataatgctgtttagtcccctctcccccattgtttacgattccttggagttccactgctacttcatatttaccatcaccatccttgttcaccattgttgaagctttatgtaatgacgagcctcatccaggacctacttgtgtctctgtgccagtcactgcctgtgaaccaggggtgtgtggactcagggctcaattcaaaaaagaacccaatcttattgggacaaacagatattgatacccctggtctttgagccccactgtcttttcacactaatgagttcttagtgtctatttttggtgattgagtagaacttggtgccatattggctcaacatggaagatttctgtgatcacttattgatcagtcatgaataaggaatcgggatggcagtcgggagtgtgccaacacctctctcagtattctgggtctctctgcatgtagtgtttcttttgcagctcctagagataaattttttaatgtattacatgtgagttatttgaaagagggtaggtgtggacagtgaggccaggtgacttaatttccagaagcttgcctgtggtatttaccttgatgagttcattaacaatatggctttcaccctcaaacttgctcattcagaaattagactttgtgagcccactaagagtaggtctttctgttaggtacagactctacaataaccaaattcacagaaactgatgtgtaaacccagggtcataaacaataattttcaacaggagctataattatcacatagtttgaaatgctcttgttaatctgagtaggaagagaggatgagaattttcttataggtggaactacagaaaaagagtttacttataggcagaagtacgggtactgagccaagtgacattgtaagttatttaattggcaaatgattaaagcaaaggtcattgcctatatgactcaaatgcttggttgcctcagaagataatgagcctgatactttcacagtgaagctgtattgcacgtttgtgtttgtttattttccatctttcccactagacggtgagggactttatctgtctcattcaccactttgtccaacctaggacagtgtccgacacatagagatgctcaataaatcttggctgagtcaatacgtttcaaaatacaaggtgactccaaatataaaacaattttttattttcaaatgaagtggacctcccctaaattttgtgcccagtttataaactttaggggctgtagatgaactgttcaaaagttttattgtaggatttcacttgctaatgcattttcacaagtaatgtatttattttaaaagactggagtttttatatatccttacatttatgaaataatttcatttaaacccttcatgcccatcttcagcatcattgctaaagcctcttggtttctgtacctgtaatcttcattcattcctcagctgtttgaaacacagcacttttgggatccttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtctagagaaagggagatgagcttctgtggtagccagaggtcaagatggcctctagtgaccctcacttcctgggttttacattgcagtatatttctcttctactctgaacaggattgtcctgtgtaacctacagggggaagtgatagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgctcctgaattcttgacccagaaaatctatgtgagggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaactgcaatttatatcttgcccccacccagtgttgatttgcccggggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccaggctggagtgcagtggcgtgatctcggctcactgcaacctctgtctcctgggttcaagcaattcttctgcctcagcctgctgggattacaggcgcatgccacgaagcccgactgatttttgtatttttagtagagacagggttttgccacgttaaccaggctggtattgttttcattattgtggttatcattatttatttagttattgatcatcaaaatccagaaatccagtttcagcaaacattccataacccggtgtgctaaaaccccctcactgctctccattactcatgaatcttcttgaccatgaggcagaatctttgtattttcttctcatcaaggattttatctgaaaaacctgtagtacttcgcctttccctgggtggagaagaggggcggataaatacttctaaagtaatgtagtatgcactctcctgcgtggtgggggtgtagtgggcttcctgttatgaaacccagcttgtaagcatgtatctacatcccagggaggttttcactgaaccaagagatgccataagcagtccttgttgtaataatttaatagcgaagccctcagcaatagatcttcaggtaaaatggatgctgactgtctatctgtcatatgaagattcagacattgatgtaatttaaaatacttgtagtatcatggatacaaacatatgcctttttatttctgaaggaatttccagaatgttcgattaaaaaatgaacagaggaaatgaaaaataaaattgtctgttgtaccaccacctgaagataaccactactatcattttgctatatttctttctatatttttctcagcatttacacgattgtttttacatagtagtgactttgccgaacagttatttcatttcgcatcttgatattttttctcaattaaaataataattgtgaacattgttctttctactctaactactcaggttgcttataatgagcttgtattataataaaacttcattttattttagataaaatgaaaagatgttactatgcaggtaactttatttattatttgcatgcagtttatcaaatagaattccttggttcagcaaaatgaaacctttaagtcttttagcaccaaatgtttgaaattatcatgaaacacattctaatttggcagtgagttcaggagatgaagactgtcctttagttaacatcaatagctttctaaaatatgtagccagttaatattttacttttgcctatgcatccctcaaattgtaacacccctggaacataaaaattcctctattgagattaacacctaacgatacctgtatttgctaatttgtttcttttttttctttgaagcagcatgttgctttgtcacccagactggagtgcagtggcgcgatctcagctgactgcaacctccgcctcccgggttcaagtgattctcctgcctcagcctcccaagtagttgggattacaggcacatgccaccactcccggctactttttgtatttttagtaaagatggggtttcaccacttttggccaggctggtgttgaacccccgacctcaggtgatctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattattacctttgttcttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccaaagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggatgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggctcacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacccctgtaatagcagctactcaggagtctgaggcaggagaatcccttgaacccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgccaccatcatagagtatacctatacaatcctagatggtataacctgccatactcctaggctaggtagagcatattgctccctggcagcaaacatgtacagcatgtttctgtcctgaatactgtaggcaattttaatacaatgctaagtatttgcatatacaaacatagaaaaggtacagttaaaatatggtattacaatcttctgggatcaccattgcatatgtggttcattgttgatcaaaatgtcattatgcagtgtgtgacagtgcttaaataatttatctcacatatgcaaagagttttggctaagggaaaagaaaaatgtgaacctcctaatagaaaaatgggcaaagataatgaacaagaaattcactgaaaagaattggcaaacatgaaaaaattctcaactttatttttaatcataaaaatggaaattgaacaatgagatactgtttttcaccatgacattggcaaaagttaagaaggcagataacttccatgttggtgagcatgtaagtataaaaaggtataaaaaagaagagttgtcctgaatctggtctggaatagaacctttttttccatgatgcatgatgtaattcacagcctcattcctgataaattgcttaagcaattttctgataaactttaatgcgattaagacttgttctgagaaatcagtcacccatctacccaagctgactgtcggtcaagagtctagtgaccttaaaccaaatgttattttccttttgtatctagcctaacattgactatcttgtcatttcattttcctataaaatgcctccaccaaggctgaatctttgaattgatcactagaggccttttccctagtagtaacattataataaaactttgactcatgctcataactcgattttccaaaaagttttcctttacaggagaaaagaacagctgctgtttataggagcatacattgtttttggttattttgaagaacaagttggcatttttgaccgaaattaaacacatgccttttgatcaagcaattccattctgtaccagaaaatacagaaatatttgaatgaatgtgccaggacacccaattagaagaatgaatgcttttttagcattattttgtgtgcatacatatttatttagttatttgacctattacattctaaattgatattaataaagaggtatttgagttacagtttttccaaagttttaaatactctatagcaaaaaaaggaaaaatgaaagaaattaaaaagatacctctatatacatacattgtgtgtttgtgtgtgtgtgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtgtatgtatatatatgtgtgtgtatgtatatatatgtatgtatctgtatatgtataatggctgtacatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtcttacttcatcacccattctgtagtgcagggcacaatcacagctcactgcagcctcaaacttctaggcttaagtgattctcccatctcagcctcctcagttgctgggaccactggcatgtgtcaccacatctggctaattttttgaacttttttgtagttggggtctcaccatgttgcccaggctggtcttgaactcctgggctcaagttaccctcccacctcagcctcccaaagtgctgggattacaggtgtgagccaccacggctggccaatatctactagttttgaaattaaaaaaaaaaaaaaaaaaaaatatatatatatatatatatatatatatatgaaaaaaaggacaaacgatttcagttgcacaactataatcgatgaagtggctccttgatgttctcggggcaatctgagacactggggagaaccctccacctttgcagagaagcaggatgaaggggcctaaaatgagttcaactgatttcaactttgtttcccagcataaagcttgggctgagctgcctgaaagggaagtggagaaggcaggaatggaattgatttttcccccctgctgaattccccttctccctactcccttcctgcaatttctaataaattagaagagctctgccttccagaaaagagcagaggtaccttgcagtacttttgggaatcttaccaggaagaactgggtctactattgcaaaggaaaagctttttttacagtgttaaaaattaattaaaaatggaatgtgttatagctcgatttttatcattagcacccattccagagggcatgttgctgttagtaaaacttcagatttttcctgtcattatggatttggttttagggaaaataccttcatgttcagcattttatgtgtcagtccctaaaactcatgatcttctgtgattctcttggtttaagagcagggcgagtaatgtactcaaaaatttctccatagccttctgggttagaggatataacagctggcaaacagaacactaatagctattgatggttattttcaaaggatggacatcgatagttaagttttaaggaagaaaatgaagaggaaatttaatgtgatttaacagtgatttttttttaaagacattatttgcatctcctattttcacttacttataaacaggtggtttccaagtagacatattttttgcttgcttgaatgagaaagcataatgaactttgtgatttggtgacatatccagatagctatagcaaatagctataatgccttagataaatagcattttcacgagtaaactttttagttctcaaaagaaaaattgtaacaattttctagccgcatattagcattatgcacaaacacataaacttttggctggaattgtggaatatgaagtagctcccatccttattccatcgcccatatgctaaaatgtagattgtattagttgagaaattttaccaaatatttacttatactgtgctattatttatactatttgtcaattccactatagtagatgcttaataaatatttgtgaatcagtaaatggatggatgaatgaatagtggcctacttctgtgaaggtaattgaagaattcccacacttggccccctttggatataacgtctgttctgagcacctcccattcactatcttgatgcctcacataagacctagtatatagtaggcagtcaatgaagatcacaatgaattggctagactttgatttattcatttatgcaaattgcctgacattcaaagaaaaaagaaggaaaaaatggacctcttatcatgtgccagacattgttctaagagggaaagatactgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagaaagggtctcactctgtcacccaggctagagtgcagtggcctcaacctcccaggcccaggtgatcctcccacttcagccccctgagtagctgggactacaggcgcatgccgtaactcgcaactaattttttgtatttttttttgtagagatggggttttgccatgtttcctaggcttgtctcgaactcctgggctcaagcaatgtgcttgccttggcctcccaaagtgttgggattataggtgtgagccactgtgcacagcctcagaggtcctgtctgcctgcctgcctttcctccctctctctctttcttcctctctttgcttctttccttttttccttctctgttgaaggcctgaataaaataaaagactgagtaagaaagaattgactccctctgcctgacttcaagctgggacgtaagtcttctcccagtccatgcatccatccatccacctatccacctattaacttattcacactggctttaaaattatttttggctccagcttattattttaaaatgtaaaatgatttacagaagttgacagagagtataattaaatcccatgagtctaccatccagattcagtaattattacatgtggccattgttgttttatctctctccacccacttcccccatgcctgaaaatttaccaaagtaaacgcaagacattatatattgttattcatagacattttgagtaactaaaagtaaggtctctttaaaaaatgataattacagtatcatcatcacacccaaaaacatcacaaattatttaatatcatgaagtgaaggcccatttttccaatcattctctaaatattataaatgtcatctttcattagtttgtttgaattccaggtaaaaacctttaactcatttccttcttttgatttttcaaaagttggttgaatagtttctgtcttaaaaagtccagaaattgttgaaataggtaaagcacaaaagaaattaaatacaccatgtttccaggcctctaatgttttctattcaaggttgtaatatccagtgcaaggctaaaattgctttctggtgataaacatttgagaaagatttggttgttggtgatactgatggttgtagtaggagtctctggagaaattgaactaatactatatgtgtgtgtgtatctatgtatagatatagatacacacatgtatctattatatatatagagagagatatatgcatatctatacacacctacgggtgtgtctgtatctatacacacacctatgggtgtgtctatctatatctatacacacctatgggtgtgtctgtctgtatctatacacaccgatgggtgtgtctgtctgtatctttacacacctatgggtgtgtctgtctgtatctatacacacctatgggtgtgtctgtctgtacctatacacacctatgggtgtgtgtttctgtatctatacacacctatgggtgtgtctttctatatctatacattatatgtactaaataatatatataaacactatagtatatagagtatacatatacacactatagtgtatgtactatacactgtgtactaatacagtgtataatgtatatatatagtattcaatatagatctataaacacacaagtgcatacacacacacatttttctgtatatatgtataaagatatatataaagatttttaaataaggaattgactcatgaaattacagagactgagacatcgaaacccaggacaaccaatggtacagttcatgtctgagtctgagcagctgagaagcaggagataaaaaggcatcagttccattccatatccaagtctgagtccaagggcaggagaagctgatgtctcagcttgaagtcaggcatagagaggcaattctttctcactcagccttttattttattcaggccttcaacagattgtatgaagccacccacactgggaagggcagtctgctttactcatagtactaatcgaaacgttaatgtcctccagaaacgccttcatggacacactagagataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcagcctcccaagtaggtgggattacaggcgccaccaccaagcctggctaatttttgtatttttaatagagatggggtttcaccatgttggccagactggtctcaaactcctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaccaatggaccactggtccctgctgatttagtgtcacagctcaaaaccatcagtagtcctcgtgatctttcggcattgtggctccctttgtgagaagggcctaagagtgaatctcccaaccataagctgtattcaggcaggcacgaagtctcttatttactcagtgtttctggagcccagcatagtgcctcgcacacagcaagtgctcagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctattgtacaatatatggtcttttgtgattggcctcctccacttagcgtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagacagaatcttgctctgttgcccaggctggagtgcagtggtgcagtcatggttcactgcagcctcgatctcctggggctcaagccatcctcccacctcagcctcctgagtagatgggaccacaggcgcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttggtaattaaaaacagagctgtgtggctatttttctccaactcctttttttttttttttttttttttttttgagacagtctcactctattgcccaggctggagtgcagtggtgtgaactcggctcactgcaacatccacctcccgggttcaagcgattctcctgcttcagccccccgagtagctgggaccacaggcgtgcaccaccacacctggctaatttttgtatttttagtagagttggggttttaccatgttggccaggctggtcttgaactcctgacctcaagtgatccacccatcttggcctcccaaagtgctgggattacaggcgtgagccaccgcgcctggctttcaaattccattttttaaagttaatgctttaatatgttaaacacccttattaacatattacatatgttaatatgtaaaataaactccgtacattttaaagtgctaaaggttgtatgtttgtgcgatggatatgtttaagagaatgatttaggatgcgatcagttttttttccttgacttactctcttcctttatttttttcccttcttcactttctctgttattccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctctttctcttccttgctgaggcttttgacaatttcaaatgctccctgaacctcagtttcctttgccacaaaatagcaatacaaatttataattccttagattgctgtgagaatgaattgaggcaaggtaggtaaagtgcaaggaattgtgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaagaataaacaagaattgtgtctggcctttgtgatagttactcaacaaatcatatctgtgattgttttggttttaacaataatggtttttaaaaaccgtaggtgatcacatactacgcagaaagggaagcagttacagcattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggactgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctgtttggctcctggcggtgtttttgttgccctggcttgcaacgtagcctgattgttctaagtaaatggcagagcacgcaaatcaaggacattggcaataaaccaggaatgcactgtttccagccacgggctatccagggaattggggacagtctgtaatgtatcttgagctaggaccatatccaaattactggcctttccagtttttctttaaatagtagggtcagtaggtgaccacactcagaagccaagcctgcagcatcagggctgaggagcaaactctttctttggtctgaagcttcaaatatgaacccttgccaccagctgcataaatatgatagccaaagggtttcaaatttgtgatttgtcataaacgctcctattgcaggctgggtctagtccttcttgactttgtggaaggagaaggcttgaggaagtattcacaattggagaagggcgccttctgttatgttcttagctcactaaaagtggttaatgatgagaaggggtgggtcaatgacaagaaaagtggagaagatgagacagacaaaactgcaactcatcttcatggcacactggtgagtgggggagtgcaagaagtttaggtgcaaaggaaaatggagtgaacatcttggcttggttaacagaagaaaagaataccaacgccgtctattttcatatccctttctattttatgtacatatttatcaatatactttttgttccagaaataaatgggaacttaggcacaatcttttacacatcttacctcaactggtgactcttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtgagtttcttaaagtcctacaactggtgagctgtgagctgtaaattgtggaactaatttttatactgccaatctgaggccttttctgacctcatcgctgccactgtaaaatgaattctagccccagaccatgacatgcctactagcttagctctaaccaaaaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgcttatacaaagtcttgttcatgaatgttcatagcagcatcatccatgatagccaaacgccggaaatacccaaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaaaatgttctaggacaagactgtggtgatggctgcacaactggataaatatactaactatcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaacgttggaaccaatgctgatgagccattcataggctctggctcactatatatgtctaaaattcacatgcccctaaccctcaaataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctatggtgggtggggtccaagcctccctgaagcagatctctatcctgtcaccctgctggaaatgaaacacttaggggttagaaggggatcaaggaaagtccgagagttggttgtgattatcttcagtcagaaagtgcctacttttccaagcatccagactgcaacctgtctttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcccccagatagcctcttagcagagccaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagggggaaattgctttccatctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctaggaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaaccctcactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattataggcatgagccaccatgcccggcctaatctaatcaattcctttaaatctgaaactgtccgcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacagaaagaggggggatttttccccccatggcttcgtccttattcttataacctgtatgcactgctgaacctgctgaataaccatgtcacagtggcaggagagggactgggtgaacttgagtctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggagccagttcacgcttggatgactctggagctgtggtgacaatctaaatcctaaattgaggcttactaggaaatgcactaggtgacaggctctagagaaatggctattaccaggttgctcaggctggagtgcagtagtgcaatctcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgggcccctcctttctggcccctcaacctattttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggaattataaaggaattctggttataattgcatgtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagttaaaggaaagaaatgccaggctgagagatgagacagtgaattacagtgggggataaaggggctgtggtgtcacacaggcctggcatctgtggccttgaacaagtgcattaatcactctaagcctcaatttctttgttttaaaaataattaactaaaataccttagggcacatggtaggaattcagtaaatgctcactgtctttctcatccttttgcttacctcacatttgcttgcagccagtgctcaaaaccatagacaggcagtgtccccaaccactccctgcgtttctctttctttgccttccgaagctgccatcttggtggtttttgaagcatcaacacttacttcacatgcagaggccccttttatttatttatttttaatttttttgagacagggtctcgctctcttgctcaggctggagtgtagtggtgtgatctcagctcagtgcaggcttggcctccagggctcaagcagtcctcccatgttgacctcctttgtatctgggaccacaggtatatttcaccatgcctggctaatctttgtgtttctgtaaagatgaggtcttgctatgctgcccaggctggtctggagctcctggcctcaagcagtcctcctgctttggcctcctgaagtactgagattacgggtgtaagtcaccacacccagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaactcagctgggcatgatgttgcatgcctgtcatcccagctacttgggagactgaggaggacgattgcttgaggccggaagttcaaggctgcagagagctgttattgtaccactgtactccagcctgggcaacagagagaccctgcctcaaaaagtaaataaaatagtaaaataaaacgagatatttggaaggctatgtttttttgccaggccatgtgcttagtccctgggagtatagcgaggggcaatcacaggtcaggtcctagtgtctctgaagacttcattctagtggccattgaaaatgtgtaactacccacagtaatcaagttaaagaaaggttctggctgagcacggtggctcatgcctgtaatcccagcactttgggaggccggggtgggcggatcacaaggtcaggagtttgaaaccagcctgaccaaccctgtctctactaaaattatttaaaaaaaaaatagctgggcatggtggcacacgtctgtaatcccagctactcgagtggctgaggcaggagaatcgcttgaacccaggaggtgaaggttgcagtgagctgagatggcgccgctgcactctagcatgggcgacagagcgagactctgtctcaaaaaaaaaaaaaaaagcttccatttgagccgccaggaaaggaggccctgagttggggagttgaatagagagctgcatcctgaacagacatgatcttgggtgagtgagaggctaggagcggagggaaagcagacgcagttgctaaagctgtcaagtcccgctcccttggaatgcagtcctggttctgctacctccaactgggtcgatttcaaaaaattatggacttgtctgagcctgatgtggtgcctggccagggctcactgcagcgcctggtatacaggaagaacttgatgttattcatggcaaaagatgtctggatggtctccactacagattctgatggcaagtgacttaaagacatgttggcaatgggtagtggacaaaaattgaaacaccttcaactgtgtctgtgaccagaagatttttttctttttttttttttttttttttttggctgactgtcatgacttagtaaggccatcacaggttgccagaacatctactcaactgttccaagcataacctcctacacaggccttctacataggagtatatttggccaagactcaccactagaagtgatttccactggactttcctacagcaagtggtaaatgatccctcagataggcccaagagctccccttcaagcatagagacacaaccctgtgaaaacatgcattggaaccaggaaggcctgcccccatgacttcacgttgcatacatgcctttgaggacttggcctcttaaaggaatctttcaatatcctatgcttctgagaaagttactatttcatttgcagcaggacaactcaacaagctagctcttcctgcccagcagactcggtggattctgaagagggtctcgggctgactctctacttcatgggtttgaattcaggaatgttgcaagattgcatgagattaagccgctgaaacctttctgaggaagagccagctcaaatttcagtgttggatgttcaccgcttctttagggttctaccactcccagtaaatcaagtaataggtttctgttaaaaaccccagtgtgctgatctcagtggcagccatcttgctttgtaagccttctctagctttatgatgctcccagtatataagacatttccagtgtctagtccaaattagtatttctctaattctcgagtgtctgatctgcctggctagaatgattaaaacaaaaaaatagcaaatcagtttgacagtccacttcattaagtggaggacagtgttttgattgctatttaatctgtttttccttctgtctgttcttggctatatggaattcactttgcctctcttcccgactcttcatatcccttatctcaaggtgagtatcgtcagaatcccggtacatttcaccagccaccttttatagaagcttagaaagatggaggcaaacccataaacaagacttggtttttctaagccacagtggcaatttcctagtcgattacaactgtgtctaccctttcaactggcctgtcagtgtaggctctgcatgtcctggataatcctacaattggtgacacggttattgacttacaggtttctagggcatctcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctggatatttcaactagtttacatgactttcttacctatgctaccttataatccttttataaattttgctttacgttttaacaacggaaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccgagactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccagtgtctttaatttgttaatgctttcgacttattttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgccttaaacacctcatctattatgctgtgctcaaacagatattttcatcttaacagcttggcaaacccagtggaacgctctttctagtttggggcataaaataagataacactctgaattcctacaggaaatcttgtaactctacttaaaattaaggcataaagtaggaaaatgtgtttcctctgtatagtcttattactttgcctgttaagttaactggttcctatttctgctggttcgaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcttcacagtaggacaccaaaccctctgtatgccctgcctgcctccccccctctgacccgcctgcctcccccctgtgagctttttccacctactggcctcttgttcttcttcagctgttcctcagacatgccaggtgtgttcctgtctcagacgctttgcctttgctgctccttctgcctggagtattcttccacgtagcaccatgagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtataatgtccaactcactctaccacacagcaacataggtagttttatatacattttatagctaagcccagcagcccaaaaagctaaatgacttcagcgcccacagatactcctggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgcatgctattcaggaggacagaccatggatgggaatcctgagccacaactccttagcctcatgacgttgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaagcaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagaggaagtgaagattgcatctcagtatgagacaccgtaagagcttgataaatggtggaccctctgatgttgacaacatgatgtcaaagatggtgtttgctgttgtttcaaatgtcttatttcaaattcccaattagtttcttcatgccataaggacaaaatccacatctcatactttttcaggatctgctctcacttccccaaacatgtaataccaccctggtcttcaagtccactctcaaaaaaaaaaaaaaatttggcctttggcctcgtgaccaccaaatctgatttccatccaagaggcaacattgtttgtgcttagaaggaattcctggctgggcatgatggttcacgcctgtaatcccagcgctttgggaggccgaggcaggcggatcacctaaggtcgggagttcgagaccagtctgatcaacatggagaaaccctgtctttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttacatttgtgaataagaaaactggggtctatttggtggtttatttcagagatgttggatcaaatcagacatcagaaaagacaccagtaccaaacgaagatatctttgctgtatttgcagttttctctcttattaacatgaaaacaccttacatagatggaaacatctaaaggctattttttattttattttccattacttcactctaatgctttcacccgtacctgtggaaattagactgtcacctgcttttagcatcctgttttctttcgtgtttgtaatgaagccctccgggaattatgcgattacaaaaatgagttacaaatcctcattcggtatacgaaagtatatagctgctttccttctctgtttaaatagtctacaaaacaagaaataattagtcaagcactatcggtaattaagcacataagatgaacattaaacaaactgcaatcttgcatcattttgaaggtagataggcaggtttttgcatttggaatccagccaaaatgcccatcttcattccctttgctccttatttattattggtgagggaattcacttgccgaacttgctgatgtactcttgctggcggtccatctgagagttcacataagtgtgagtgactattttttgacaacactacctttgggagaagatggtttcaaagaacttactgtatcaaatggaaagacaatgtgttttcccaacatgggagtatgtttctaagttgggatcagttcacgattcagagaaatgctctgccttcttgtctatgatatcagatcaggtcagacgtaggtataagaccctgactcctgttttccaagcacttttttttttcattatgagtctatctttcggtcccctaaagcttctggtaattttttttctttttttttttttttttgagacaaagtctcgccctgttgccaggctggagtgtggtggcaggatcacggctcactgcaacctttgcctcctgggcgcaagtgatcctcctacctcagcctcccaagggagctgggaccacaggggcacaccaccatgcctgcctaatttttgttgttgttgtattttttggtacagatgggattttgccatgttgcccaggctggtctcaaaactcctgggctcaagcgattcacgtgcctcagcctcccaaagtgctagggttacaggcatgagccactgtgcctggccctggtaaaattttgtctacatagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaatattcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacgccaaaatggttcttctgctcagttggtttctatagtgattttatggatataggcattttcttctcgaattagaagaactgacagtccaggcacggtggctcatgcctgtaatcccagcactttggtaggccgaggtaggtggatcacttgaggtcaggagtttgagataatcctggccaacatggtgaaacctcatctttactactaaaaatacaaaaattaggtgggtgtggtggcgcatgcctgtaatcccagctactctgaaggctgaggcaggataattgcttgagcccgggagacggaggttgcagcgagccgagatcacaccactacattccagcctgggtgacagagcaagagtccatttacaaaacaaaaacaaagaactgacaataaatagttttctccgttttgtgacttatttttaattattaagaataagtgtcataaagccaatactttctaacatgtgtatagtatgttatagttttcaaagtctttgacaattatacctagggagccaggacagtatttgtatcatcatttcattgttcctggaaaacaggttcagagaagttaagcgacttgcccaaaatagcacagcaatctgacagagccaggattatcttccatcctctattttattacctgtgcctcccattaaatcatcctaagctccactacagctggagaaggttctgttaacacaccatacatcttttttttttttttaattgagatggggtctcactctgtcacccaggctggcgtgcattggtgggatctcagctcactgcaccctccttctcccaggttcaagtgatcctctctcctcgcctcccgagtagcgtagctgggattacaggtatgtgctaccgtgcccagctaacttttgtatttttagtagagacaggggtttcaccttgctggccaggctggccttgtatttctgacctcaagtgatccacccgcttcagcctcttaaaattctgggattacaggcatgagccaccgcacccggttatacatcttaaatataaagtttttacaatgccaccatttaaaaaaaaaaaaaaagggcattaatgcatttagcaaagacttcctgagtgtctgcttggtcgagtgacacaaactggaacagagcatagcctgtcttccaggaaccggcaccagcgatgtcgtaggctgagggagaagccacagaactgtgagtgacatgtttctttggctgctcccgacacaaggaactgcaactaaattgaaggcttgaggacaggaagcaccttagcggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaaggactgtagtgggaaactcgtgaaatcctaaatacagtctgtcatttacttaatagtaacataccattttcataagcataccatgggctgggcatggtggcttatgcccgaaatcccagcattgcgggaggctgaggcaagctgatcacttgaggtcaggagttcgagaccagcctggcgaacatggcaaaaccccatctctactaaaaatacaaaaattacctgagtgtggtggtgcccacctgtaatcccagctactcaggaggctgaagcaggagaattgcttgaatccaggagatggaggttgcagtgagttgagatcatgctactgtactccagcctgggcaacagagcaagactctgtctcaaaaaaaaaaaagaaaaaaaaagtaatgcaataagcgtaccatggtcatgtgagatgttgacattaggggaaagacaataaacagcgtggaggaactctgtgtactctgtttgtaagtttcctgtaatactaatattctaaactaaaaagataatttaaagggaaagaaaacctctttatgatagtaacatcagttggtataaccattttggaagacttgatttacataggatcaaatataagtatatctgatcccctagaaatttcacttctggccaggcgtggtggctcatgcctgtaattccagcactttgggaggccgaggcaggcagattgcttgagcccgggagttcaagaccagctgggccaacatggtgaaaccctgtctctacaaaaatattagtcaggcatagtggcgtatgcctgtagtcctagttactcgggaggctgaagcaggaggatcacctgagcccagggaggtcaaggctacagtgagctgtgattaggtccctgcactccagcttgggtgacagagtgagaccctgtctccaaaaaaaaaaaaaaaaaaaacaaaagaccatttttaagactatgactggtcaaaatgtgctcatacatttgccaaaagacaagtacaagagtgtgtttagcagcattattcattataacacactgaatcattattcatgattactcaagacatctggtaaaccacccagatatctatcagtggtggaatggataaataagttgtaataaatccacacaagaggagactactcaccaacaagaatgaatgacttagaactaaattcaacaatgtggatttatcttacagagatgatgttgagagaaaggaggaagatacagaggaatgtatcctatgtgattatagttacaatgagttcactaaaaagcaaactattcctattagaagtcagggtagaggatggatgggagcatgaagtgtcctccgtcatgttgctaatgttctgttgcttgttcaagctactgggtgtgttcagtttatgaaaattcatttagtgacacatgtatgttttgtgaatttttttgcatgtatattttactctaacaaaaagttcatggacaaatacaaaatcatatctgacagttgttgagagaattaaaggaaataataataatataaagcacaatcaatgcattccatttattcttctgcttttcccatcaattcatgttacccagtcattaatgcataccctctgagaccccaccaagccatctagccctcagctgtgtcactgggcagttgtttcttccactgtgcagtgtttcgttcttaaccaacatggcaccccaggttcagtggtgagagtgtcactggcaacttctgaaataacatctctgttagtttgtggagtgggctaaatggccagcccttctacgagctccctcatggttgcgggggactaccaatcactctctactttttttttttttttttaataggtcttgtcatttgtaaatgcagaaggaacactgaaaaaaaaaatactcttgccttcttccatctgtattttctttactaaattatccagtcttataaatatttgaataacatttggtcagtataaaatctttcctgtcagctcagtacaagaacactttttggctcctgagaccacaacagtcagataaattaatattgatttgttagaaaatagttttcactctgtctaaacatcttattctgggctcttgaaccaaaattatgaatttaaaagcagcaaaatagttcttcacagttttcccagtgaaactaattatgggcagattgtgagaaatgtgttggatgtgatttccaacatagagttctgctaaccaaaattcagagaaactagagcctcagtctctgatttatttgagcaagttgcaatttggtagactggagaatttatgtaaatagtttttgcagtttccatagggataactcaatacattaatatctcacgaatggcagaagatgaagggggaaagttttttttttaactgatagtttgatttacctaatagaaggatcggattcttcccccttcttacttaagtctatatattaaagaacagctggcttacctgctgtataaatatgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcggattacaggcatgaaccactgcgcctgactgtacttttttttttttaaagtatacccatacccattgtacacatttggtattttttctttaaaaaaaaaaagcatttactttttgcctcatgaatctctgagtacattttgtgcattctgtattctactttatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattacaaagaaaaacatatatatatatatatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcgtattgtcagtctcaaaccttttctgaaattggaagtgatgaagtgacagtctggctatatgtgtgtgtgtgtggtgtgtgtgtgtgtgtgtgtgtgtgtgtgtgtgtgtgtgtgtgtgtgtgtgtgtgtgtatacctagtctagggctaggtttgggaactattttctcccgtaagttaaactgaactagactgtatgtcaaaaaagagtctcaatgtcaacttaatccattgtcatgactgtaaaatgctatttcattataccagcaattcccctgtggatttctcctgactctctatgcagcccaactctattttaatctgttgtagcttttctttcccctctctcccaactccccacgttttggaattattcagtgcattcgcttccaaggcacctgtttgatatttacacaaattatgaaagtaaggtgggaaggcaatgaaggcaacaaagtatataaaacacacacacacacacacacacacacacacacacacacacacacacacacaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaaagatagtggttttccagatgtgacaaaacaaaagaagatttccaaatcaaaattcccatttgcctttcgggatgttgaattttctccacatttgtgcaattaagagttttgctgagtgagcttaggactctgtctctttaagtgtttaacagtaattggttcatgtcctggtgttcattgaaaatcctagacatttcatgtaaaatcttcttaatgaggggatgaatttttcattcacattagaaagctcactctgacaaacaatttctaaataaaactttggcgacatgacatcccacattggacttgtcagagaggacaggtgcattagaatataactgtatggcgatccttcaagctgtcagccatgaatattttatttcttaatgaatcatctttgtgaaatcaactttcttgttgtagtgtcagtgccatttacaacaaaaagctggctccttttaaaaggtgagctccttaaagatgctgattcctgcataaaatgtttaaccctacccaaggtgttgggcaactgggggctttgtgctttgcttctcccttctgaaagtgacttgagaacccactttgggctagtgtgattacagtgaggagaaagctttccttgatttgttgtttccttctcagaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctgtcattctaatgaggacttaaatgtgtccctgctgaccgagccagaacttatttttatgttgccactaggagtcttctgagatgctcttgtggctggatgtagaatcgctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaataataagatgataaggattcgtaccagggattggcaaatgacagtcattttctgtttccttaagtaaaattttattaaaatacagctccactcattcatttatatattgttcatatctaattattttcacactgcaatggtgcatagtcaaatgctttctatctggctttttaagaagatctttgtccctcccccaccccccgccccgatttatactatggatcagcagcctaaaccctgcaaactgggtcccccatctaagagtctgcagtgaaacgcgagccgacttgatgtgtctcagagtgatcattcttgcccttggcggttgatgctagactgttgcagcttcaaatataatgtattttagtgctatacgacagccataagtattggcctgtgtccactggtctccactaggagaaaaccgagccaagcttgaaagtactaagcgtgcccaggggaaatggaataagctagaaatttgttgtttccttttcactaggtttaagtgagaatatttgtgagcaaactctcagtgtgggcaggtgacaatttctgcaggtattttccccccattttaacttgtgcgatatagttccctattttgttttgttccgcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacatatacacactgacacatagattttgtaaatgaggcacatctattcttgaaatgcaattgcttaaaaatggaagttctgaaaataaataaaaagaaacatcaataaataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctgggccttctgagactgttcccccagccccagtcaggagggcttgtccacaagttgctgtctgaactgggcaagcctcctggcttccctgaaatggtgctgatgtcttcacttcctgccaccttggcaacctttgtagttgctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttacatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttccggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctcgctaaacattgtcacttgccaaaccatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgagatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatactataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgacagcaggaagcccagcttctctggtagcagagcaggggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcacagagtcaggcctcgaaaaataccagtcctttcgcctgtcccctctcacatggtttgaatccaagaggctgtcataccaggctcccccattcagtatattttctttatgtttaaatagtttggattgacttctcttttcttttatttttctgttgctacttaggaaaccatctccaggctagaacaagtgcctgaaatagagaagggtgaggtcactgcctaagacacttcctcctccacccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcacactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattattattattattagagacagggtcttgctttcttgcccaggaaggagtgcaatagtgtagtcatggctcactgcagccttgacctcctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttgtgtgtgtctcaaggtggagagaggctgtggaaacaatagagagaatagcatggaaggccacgttgcaattaaacaagattgggaaagaagacgggactaaaatcatgccttgaagatgtttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaactaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcttaattatgcattaagaaaataacttaagtttctgtgcatacaacatcttcctttctcattcccagtaccctagaaacacagccgttcactgaagaggatttgagtgttgtctcctctgtggggtcaaaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatctattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtaaatttgcttagtcattttcagagacaaaaatttgggaaaaggattgtagaatgactggcttcccaaaaccacttggtgtttacaaagttatcaaaaacgggctgggaccactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtaaacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtctgggcaacagggtgaaaccccgcctccactaaaaatacaaaaaaaagaaaaaaaaaaagaaaaaaatagctggccattgtgacatatgcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaacccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatagaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgagaaacgctatctcttgctagttttattttgcattttcctagtgactaatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtatcttttgaaaagcagaagttataaatactgatagtgtccaatttatctttttcatttgtttagtgctttcttgttctaagaacctttaccaatcaccaggtcacaaaaatattttcctatgttttcttctagacactccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttgtactccattgatctaattttttttcttatacttactgctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctgttgatcaatttgaggaggatcaaaatcctgaaagtgttgagcgttaccatccatgagcatgcatctctccatttatttaaggcttctttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaatatagttttacttcttctccaatttttatggcttttgtttctttttcttgttttaatgcactggctatagcctgtaggacagtgttgaacagaggttttgagacagacatcattgctttattcaggacttctctattatatgtgatcctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaacgggaacattggccacatccgccattgtcaattttaaataaaagatatgatgactagttggtgagttgatcttgtaagacttttacagatacccagaacggctctacttcttcatattccactttttagttttaaaagtttaagtagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgaactgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaacccacagaggtccctattcacataagaattttctaagcagaggttccaatttggatatttcgtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagaataggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctctttttttcctgttcttttccctctccccacaaccacttctgtttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgccatggtctcccaaagtgctgggattacaggcgtgagccactgcgcctagcgaggtagtcagtgttctaaacactggtgtacaatccaagtctgtcgctgcccaggatagaggagggatgacgtgaattcacacgggcctctcctacaaatctgagtgtacatcaagtgaggggcgtccctccgcacctcactgttgggctgatcaatcccattcccactccattatgtgtgtatttctaagtggcagatttgccttaggaaatggaagaaggggatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaacgcttttaccatggctaaaccattaggccggctctgcagggagggcaagaccacagcagctcagtatttcctgctcagggaaaaaggccaggtcttttgttggtggaaatccacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagaggtttcccattggccacttggggtacaccccttataaatgaagtggtggcctgcaatcagtcttattggttgcagaaagcaaccaatcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtgaagttacaaagttacactcctatgcaaacgtctgattggttgcaaaaagcaaaaccactcagaggtactttcaatttcccatctgccctgcagaaaaggtaaggggttgcaaaagagtagcccctcctccttttgttacttaggcgtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagattccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcaattacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggatggggagcaggtaattatgctgggacaataggcgtatgtcaagatatctggtcaccctatctatgatctgtcacacttagtactttctaaaattctcgggcctttgcaccttctttttatcaacgcttagttctatgttactgaatatttcttaattaagtgcaggaaagaaaataaccattttttctccttttaaagaagcacacacacctttcttttattggtattacattccttttccctgttggtgcccctgttggttttccaaattgtcttcccatccttgtcctacctcccaatagagtacctcatcctatagtgttattataactacagaaaatatattttcattccttccacttcatgctttcagctagaaatgtgagtctctgagacttgtattcttggggtcacttaaaacatactgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtgcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaagtgctgggattagatgcatgagccacctggcccagccagaatccttccattaataaaaggatggaccatgaactcccttttatgatatgagccgatcaaatgtgagcagaatagtatcctatttatacaatgtagtttaaaaccaacttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgacgcatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaataatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagccccgcaaagacgagggagcagcaagttccaaagcccgtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccctatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgaggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagagtgaaactctgtctcggaaaaaaaaaaaaagagtttaattcatgcagagctggctgtgtgggagaccagagttttattattactcaaataagtctcccccaaaactcagggatagagatttttaaggagaatttagtgagaagggggtcagggaatggggagtattgattggtcaggtttgagatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcagcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaataacagccagtcgttcatgtttccttgtgccacgtgattattttgtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctctttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcgtcaacttagtccaaatgtagagggtcaggaaaacaatgatatgagaaaagggccggttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgctttctcctgacatcatgatcatggactcacatgacaaaatggatcctccatcttccagcatctctgattgagactaacaagggccctgacagccttttctggacttgtagtatgtgcaagaattaagctttttctgtatcaagtcaccgtgttatgggggttgttcctcactgcagcagaaccttgttcatccgtattagaacagtgtggtgtttcatgttagcagagtgtatcaggatcttttgtttttttttttttttaaattaaggatgctgtatgagtcttttctcatactactgagaaagacatacccaagactgagtaatttataaaggaaagaggtttaatggactcacaattccacatggcggtggaggtgtcaccattatggcagaaggcaaacaaggagcaaagtcacatcttacatggtggcaggcaagagaacttgtgcaggggaactcccctttataaaaccatcagatctcgtgggacttactcactatcacagaaacaacatggcaaagacccatccccatgattcagttacctctcaccgggtccctcccatgacgtgggaattatgggagctataattcaagatgagatttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaattaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggccctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttattgggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccaacactttgggaagctgagacaggcagatcacttgaagtcaggagtttgagaccagcctggccaacatggttaaaccccatctctactaaaagtacaaaaattagccagacgtgatggtgcgtacctgtaatctcagctactcaggaggctgaggcaggagaatcacttgaacccgggaagcggaggttgcagggagctgagatcacgctgatgcattccagcctgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgagcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttacgtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccgctcttccctgagtgccttgttggagacaaaaccagcaggattatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccattctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccatacgcaagctggatagagccagggtccctgagttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaacttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctattttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgccggtgagtgaatgagggagtgaatgaatgagggatttgcagcttgaacgctgtactttgaaacagttccagattcatgaaatttctttttaatgcagaagatttcttatgtgattaactgaatgggaattgatgctttgtggaatgaaatggattgagtacagagtgtgggatcaagaacttttaggcactgtgagtataagagggaaaccaggccgggagcagcggctcacacctgtaatcccagcactttgggaggcggaggcgggcagatcacgaggtcaggagatccagactatcctggctaacacggtgaaaccccgtctctactaaaaatacaaaaaattaactgggcatgctggcaggcgcctgtagtcccagctactctggaggctgaggcaggagaatggcgtgaacccaggaggcggagcttgcagtgagccaggatcgcgccactgcactcccgcccgggtgacagagcgagactccgcctcagaaaaaaaaaaaaaaaaaaaaaaaggaaccagatggccctgcccttgagcaggctgtggtctggcctggtggagagacagagaatcagttaattccagggtcatgtattaggtagtaagatagtggttcacaccaaaaacatagaaaatgatcacttagcctgatccagaagttcaggaaagggctctgagcaggagatggaagacctcttggctggttaaatggagatcaagtggcagcttggactcctgctgcaattaaaaaattactctccagttttcttcatgtgcctccccattcactccaccaccactcaccccaaatcagatcatgattcatttgggttgtaccgattaagagggttccctttacatgaccattccagtcatgaaacagagaatctggtcacctgtcctttatcttggctggtccaattccataagaagtaaatgctgtgtgtctgcaattcaaaagacccctttcacgggaggctgggagatttttccatctaaatagcttaattgttactctacagggcaatcataaatgtaaatcgacttaatatgacttgattgttagtaatgactgtgcctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccattttaaaaaaaaaattgcaccagttctcatcccatcatctgccttgatcaaacatttgcttattggaatcacttcgaaaaggaacttggtatcgttcacatgtgtttataactctcaaatcttcttcttccaatttttaatcttgatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgttatcattgtgtttacagaggtggtcagattcccagcacagtgtactcccgcacagataaccgtcccatcttgataaaacaatgctctcagccgaatcctaaacacgctgcacaaggaagaccttatgctgacagtagggaggaagcgacatgttaacaaacaagtttgccggccaggaagttttaatcagccctttctactgcagggggtatgatggatggagaccctgtttcagaggggtttcctttagataaaacaataataccatgctttcaagaagctcgttcgacagctgtaaagctatgattaatcccccaaaagtcaaacatgggaagactggcaagatgagattattcactgggtataattagccacaattatcgctaaagagaatttggggagattctgctctaaagggaaaagctttgtaaaggagaattaccagtagagtgaccttataatttaccatccaatggattttgaatacttttgagagagaaatgagatactgataataattataccaagacaacagacataaattgggattggcctagacgagcaaagatgaatggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttcgatagcaagtagaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgcccactctcaactaatttttgtagccatggagatttggaagtctggcaagtcttgggtcacatgatctaccttacagctgttactgcagacctcccaaagctcacgaactgagagtcaggaggcgtggttcccctaactcaaatcagaatttcgttatcaaaagaagagagggatggttctgtggtgtcccacactcaaataaacatcctttaaatacctctagatgcttataattcctgttgcagccttagtcagtgggagccactgacctgcattcgtgtaggaactgagcaaggttcatctagtctcggtagctagctaccccgagagctggctgattttttttttcttaaatttaattcaagacttcatgaagtcaacaaaatggtctgttggaaattattcctaacccccaaccactgtcactgccacaatcaaacatattttcattcttttgcagctgcagcccttctacttgaactttcccactcattgcccttataacttgccatttaatatctcttgctttcctacatggctgtgactactcgtgggcagggactgtatctcctgtttttggtagtgcctccagaaccaaacaccatatgtcataaggtctattaataaatatctgctagtttttaaagtttgagaaaaacccgtattgtggaatgaaaatgatactgacaagggaatacatctagatcagaaatactgatatcgtaagtgagatcttgttttttaaaacaaaaaaaagtttaagaaattgtcatataggctgggcgtggtggctcacacacataatcttagcactttgggaagttgagtcaggagggccacttgaggccaggagtttgaaaccagactgggcaacacagtgagaccccacctctacaaaatattttaaaattagccaggcgtggtggtgcatgcttgtagtcccagctactcaggaggctgaggtgggaggataggaggctgaggtgggaggatcacttgagcccaggaggttgaggctgcagtgagctgtgattgcaccagcctgggtgacaaagtgagaccttgtctcaaagataaaagaaagaaagaaagccctatcaaaattttaaaaaataaaacataagaaaaaaataaatggatacatgatatttgtacttctaagaggcatcttctatacatttcctgtttctctcttccttttcctaaggagtccttgttgatttgtggccatgaaacctctctcctttccaggctggcttcttacctaggtcgtgtcctatccctttattttctggcagggctggactgtcacttggttgttctcggtttcaggacccacgtcttttgtctctgtaatgaatgtgttcagaggtctctgcacagagaagctggctgttaggaaaactatttcttctttccgagacaggctgcaaaatgcttgttactattttgtgtattcctggcaggatttgtattcttagttttattactaatgataataacagttaatgttgaaatcagcttcatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagagtacctttctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagagacacccccccactcttagcccacttttatagatggctaagcagaggctcagagaagtcagacaactcacccaggatcaagcagagggcaagtggtagattctagaatttgcatccaggcagttgagtctagaattgtctttgtgtattttgctccatggtctagcacaggatcaccattggtagatcatcacttagaatgccatcactaccttctaacagcaatcagtccccttaagtggctttcttctcttttttttcttttatctttttgttttttttttttttttgagggagtcttgctctgtctgccagatggagcacaatggcgcgatctcagctcactacaacctccgcctcccgggatcaagcgattctcctgcctcatgctcccgaatagctgggattacaggcacacaccaccacacctggctaatttttgtatttttaggagagaggggttttaccatattggcccagctggtctcgaactcgtgacctcatgatccactcgccttggcctcccagagtgctgggattacaggcatgagccactgcacctgactaagtggctttattttcttatgtggggatcctggagacacagtgtgtgccaaagcgtctgcagaccagtctgtacagttgattatagatatattaatgaccacttctgagctaaaaaatgatctagaataatagactaccaaacacataagcttatttacggtttgcctccttctcatgcttttggaagggaagcactgagggtcattgtatcagtcagcgtagactaggtttgccgcagtaacaaacgaccccaccatgccatagcttgcaaaaacaaagactgagttcttgtctacactgtagggccgtcaagagctggctctgcttgctcttggtcttctccatgccaggatccagagtaaaagcacagcttctctctaggactccaggggaaagagaaaagacaagttcttaaagtttcttccaggacgtgacacctgacatttcactggccaaacacagtgacctggtcactctggggcagggatgtgtaatctccccatagctggagaagtaaataataatgcacaataacattgtctcccatgggtgcagatgtgatgctttcctccttgtgactgttttctgtcttgctgtcccaagtcctaaggtcccagccacctatggttctttggacctgtgattttcgctgaccccgaatgactggaggaactgctgcctgcatccccaacccagccctccttatcagtcacgtagaaagcagttattgtttccaagttccctgcccttgttaaatgtcagctttgagtgaaaatgttcctaattttactcagagtgcaaagaacacccaggtcaggtacctgacctgcttgattcatgtcttggaaacactcctttgtctttcagagaaagtaaagagtgatggagacagagagagaaagtgtgacctactttttattatcagcaccatttcatctgcaaaacacgacttttctcttcttgttacgctgagcatgaaaataaaatgttttccaaaagacctggctttggctgttgtgaggaaggccagggacttgttcaaaactctgatgagctcgatgagcaaatgattccaatttttaaaaactgtaattgactttcaaactgctctcactgtccacacataatatgtggtacttttctgcaaataccagcagcaaggtaggacaaaaccagctcccacactggctgtttgcttgatattaagctttgccagtccaatataggtcacatttccaaccagattttgtgcttatctctacattacaccttgtagcaagggggaaaaaaagagcttcttgacatctttttgaagaatggcgctctttaaaaaaacataagggaactttttttttcaaacactgtaatgagggtattcaagtctgcaggcaaaacagagctgtttgaaaagacattagcctcgaaaccgcactgtgccagaatagatacagctacgtcaaaatgccgcatttattttgccattacttttcactgactaaaaccatttgctaatgaaagttctagctgccataatttcagcacctgctgatggaaaggtggactcactggtcatggggagtacagtaaaattaggagagtagatagaatcctgaagcatttgagctgcaaaatcatagtaacaacagctcttaatatcctataattgaaaaagagattgccattttcaaagacctttcacagtcattctcttaatcaagtctcataataaagatgtcattgggacttagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctattgtatttacagttacagtttattacagggaaaggatacaggttaaaattagatcggggaagagacaaatggggcaaagtccaagacaagtaccagatgtgaagcttctattgtcctctacccatgacatcaggacagaatacttttctactatctatgtgtggcagtatgcatggaatattgtcagacagagaaactcacctgagcctctgtgttcagagtatttattgggtcttcgttgcgtaggtgtgattgggtgattgcccacatatttgatctcagcctccaagtcaactgataactgtggtacagtgtccctaccctaagcaatattgttggtcctttaagaatggttcatctgcaacctaaggttacatgggtgtagttaggccccaccctaaatcacattaagagtctccagagtatgatcagaggtgcccaagcaaacaaagactctttttttcaggaatatattctgcatatatttcagtgatttttttttttttttgagacagtctctcattctgtcgctcaggctggagtgcagtggcatgaccttggctcactgcaatttctacctcccgggttcaagcaattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttataagaaaggattccaactttcccatttacagagaaggaagctgaggctcacaggtttcactcaaaccataaagctcaggagtaactaaaggaactggagcttgggggtcccagtcctgggcaccattgctaagtaatgtggcctattttcaataagggcttattaatcatactaaaaataagaacttaaaactaaatttttatttgcctagaaatctaacatctttagataaaaatattccatattcaggaggcataattctttctcttttctttttttcttttttttttttttgagacagagttttgctcttattgcccaggctggagtgcaatggcgcaatgttggtccacctcaacctctgcctcttgggttcaagtgattctcctgcctcagccttgcgagtagctgggattgcagggatgtgccaccatgccaggctaattttgtatttttagtagagacggggtttctccatgttggtcaggctggtctcaaactgccaacctcaggtgatctgcgtaactcggcctcccaaagcactgggattacaggcttgagccactgtgcccggccatctttctttttcttcctctccttctaccttgcccaccatggcttaatttcaccagaatatcatcattatcaacatcattatttctagttcagatcattctaaaaatagagcagtcattttcttctatataagtcccaggtccagcctgctattttttgagcctacctttcctaatatctagtttatattttgttttgttctttcttgggattgggagtcagaatatcaactttttcagaaaagagctttggaaattctacatacataatatatataaattttccattcatagtgtgttagcagctttttctacaaatctcttggcgggtggggggatatttcactcttctatgaatcaaataatatatggctttttcctattggaaaaaattagtcgtgtgaactttattcttcaagaaaaagtagtttttatctgccttggaaatgtcaaaaggattcacaagtttcacaagtgatgatctgggttgattgctaggaactgtttttagttagtttttttttttttttttttttttcagacggagtcttgctctgttgcccaggctggagtgcagtggcgcgatctcggttcactgcaacctccgcctcctgggttcatgccattctcctgcctcagcctcccgagcagctgggagtacaggtgcccgccaccacgcctggctaattttttgttttattttgttttgttttttttagtagagacggggtttcaccgtgttagccaaggatggttttgatatcctgatttcgtgattccacccaccttggcctcccaaagtgctgggattacagacatgagccgctgtgcccggctgctaggaactattaatccatagacaaggctctggttagagaagcagaaagaaggctgggtagaccggggaaggtagctgggaggtctctgaagcttggtcttgaagctgtgaattcatagacgtcttggaaaagaactttataatgtggttagacaagttttataagattttaggattaggaaggcttttttagggggtggggttgcttttaaactttgtttgaaaaatggagcttgctgccatcatatcatcatcaaaaatggaacttgtctatccacaaatatttatttaaaagtcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggataagaaagccagtattggtaaaaacatatatcagagtccttttgactgtttagaaagtgttaatttactccacgattatccattcaacatttattagttggcttctgtgtgggagagtaaccattaataccttgaataagtttataatctggtcattctgtagagcttcctatatgatgtcttctgtttaagtatttctgtaataccttatagacatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgttcaagaccagcctgggcaacatggcaaaaccctgtctctacaaaaaataaaaaagttagccaggcatggtggtgtgtgcctgtagtcccagttactggggaggctgagatgggatgattggttgagcctgggaggtcgaggctgcagtgagcaatgatattgccactgcactccagactgcatgagaacgtaaaaccctgacttaaaacaaaaacaaaaagaaaacgtgctcattggctaagcctggtagaagccacatgaccaaggctgatcattgctgccactgggtggcagcatactgggattgaggaaaataacccctcaactgcccggatgataaacacagagttctaaaatggcaacaaagggagatccacccttctcagttattgtttgaaaggacagctctcaggcaaaatatgtccacgaagttccatggaataattaccttccttggtgttaaaaaatgccctcacatttcaaacatgtcctgctttaagttcccagcgtcttaaccaggaactcgcttatgtgtgttgttttctgcttctttccactagggagctattgctgtaaaacagaaggggtagtattacagggaggagatgcacattttaaaatatatttctgcttcgtcaaactgtacagaactcttttcctcaatgagaaccaggtttttgcatgtatcttttgccaagatttgagaagggaagtctccaccttccagagctttggtcatattttgtttctctctaagggtgaagatgctgtttgttcttgcagggtgaggctttggccaataagaaagcagtgctcagaggtaaagagcctcgctgaagccctagttctagcctaccaggatttggtcatttcttggtttttcatttgatcccacccttgcctaccttcagaatgaaggtagaatgtgggactgtttcagaccatgaatgcgattgggcagaaagactgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggcaaaaccttacctctcaaaaatttacaagcttagccaggcatggtggtgcccacttgtggtttcagctacctgggaggctaaagtgggaggatatcctgagcccaggaggtggagattgcagtgagccatgctcgtgccattgcatttcagcgtgggtgacagtgagaccctatctcaaaaaaaaaaaaaaaagttcctaagaaaataaagcctggcccatgcaatttgaatgtaactgtctataatttctcttggttactgaaattctgagtttgtgtctatggtttctccatccttgtctttgaggaggagcaggatggcgaagtcgcagccatttaaaaacttgttttcagtcattttgcagaaagcagacgtacacttctttgctgttggtctgtgatgcgggagtggtttgtcagttctttcattcaacaagtgctgatctttgggcagcatacactggtatgacctttatcatttgttcaggtgttgtggagaaagttgtttgcttttgaaagacttgatggagaaaagtctttctacatttctagaaagaccatgggtgtgagtattgagagctgagtgccagtttgtttttttgtttttgttttcgttttttgagaaggggtctcactctgtcacccaggctggagtacattggtgcgatgaaggcttactgcagcctctacttcctgggctcaagtgatcctcccacctcagcttcctaagtagctgggagcacaggcaccagcaatgacacctgcctaattttgtattttctgtagagatggggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtataaaatggaccttgttttgaggagagaatgaggtatgtggtactcgtgagcaggattttcaatgcctggctggttgttacttatccatttagtccgagcttcagggaaagaacatgacaccggcctccagcagagcctgctcttggtccactgtttatcctggtgaccttaggcaagtcatttaatttccttgagttttggtgtaagtattgatggagcagaccatcaataactgttcttatgtctattattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcactacaaccctatgtagttcacataactatttgcagttgtattttcctttaaatctaaattggagagaaggaaggtaattaaggcataattatcagacttaatcaagcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttttgtgtgtgtgtgtatgtgtgtgtgcgtgttatatgaagtcttgctagaatgcataaacaaacaaaaaaaatatcatactctcagatcctggatactgtggtcgcctggacttcaaaagccttttgtccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatctgcccgcctcggcctcccaaagtgctgggattacaggcgtgagccaccgcgcccggccccacttttcttgttgtgaatattttttccccttctgaagtgaatactgatttttcgttacagatatttgatgctttgggggcctgttaaaatagttgtaaatacactttctaaatagatgaaatgtaagaaattctgagaaggggtttctttgacttactggaaaaaaaaataataggaaagaaaatgtgatcagttggtatatttggctctctttcatcaacacttttatggacctgcattgcagtgtttctgtgatgtgtataaaacacagtttcagtgatcgtgcaagcctcagttttagaagataaaaagatatgaacttgaacccaagcttctctgtcaagagaattataatgtgttttgactgtaggcttccttcgagttaaatttacagtattttcccctaacaataacaacaaccagaagtgcccctttaagttgagatgcttgttaaactttacatgtatgcatgcatataaatgtacatttctgtatatataatatacgttcacatatagttacattagatttttaaagaatttcctttttgccttcaaatcattgcacagaacatccaagtagacatcatgtcaaaataatcaaaatgtatttaacgctctctcaagaaatccatttaagaataagaacacggtttgggggtgattttcagaccgtaaattgaagtgtaaatattcgaattattttcataaactcttcagttctgttgggcttttatgttatcatacagtgatttttttttttgtatttaagttttctagcagttctcttttttaagagcctcaagtgtccaataaaaagcaaatacttgaattttcagtttctatatagtgcatattttttctcctgcttgccttatttttataacagtgatttataaagacattactaaagaataggaaagaaggattttgaagaggaactgctatataacactgcttaaaaatctatttccaatgctaaggagaggaaaaaaaaatactggcaccgtatccgagtgggatctgggatccgagtgagatggccataccttcagtcattctcctccccaaatatttattgagcctggtggacaaggagggcgggataagattgccaggccctgcttctatttctggggttgggatggcgactaaagacccgcgtggactgcatgctgcagccagctcaggaaagatttcaggaagagcgtttaggaaggcagctttgaaaagaaaatggaaagatgaggttgcagagggtcagtccaaggtgaccagaatctgacctggggcaatgccataaatccaagaaagactgggtttcaggtgcaggaaatgcgattgtgcacggacccttgcctttttacccagtatctagcccatccttctttcttagaagcagaattttctaagaggtacacggtagttcaggataaaaattccctgtgctaactgcccttgcagctagctctctgtgaccgtgtgaccatgtgacccagttctagcgaatggggtggcagggaagtcccacatggacttcttgggcgtgtccttaggggaagcatagcttcttgccttcttcacactcctccttcccttcctgccgtctgggatgtggggtctggcagagaaacaatattgtgaatggaaatgggaggaacttgggtcctgaaaattacaccataccccagagcctggggtggattatttcaggacctttcttccttccttccttccttccttccttccttccttccttccttccttccttccttcctttctctctttctttttttattttttttttcagacagggtctcctccacacccagactggagtgcagtggcacattcatggctcactgcagcctcaacctcctgggctcaggcgatcctcacaccttagcctcctgagtagctgggactacaggtgtgcaccaccacacccagctagctaatttttttttttttttttttttctgtagagacggggtttcaccatgttgcccaggctggtcttgaactcctagcctcaagtgatccgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcgctatgcaaggcactgaggtgacaaagacaagcagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaaactcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcagattttgctgggctgggccagttcagctcagcaaggattgctgggcatgtgcttgaaggagaaaggtgaggatacaaaggcaatgagtacatgatccttgaccttgagaaacctatagtctaatagaggaggcacatataaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtacccacttgatatggtttagctgtgtctccacccaagtctcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtatgtctttattagcagcatgagaacaaactaatacaccacttgaattgctggtacgtctgaggggcttgactcccagtccttcgaacatggaggggtagctctttttctaagctcctcataaagtattgtatccaattcttcagaagggatgaaggtatctggtcctgtccgcaaacagagaagtgcttcttgtactgaccaggcagtgacctaacgcagtccttgagacaattccaggtgcccctcaggccgtttttccaccctggtgtttttctttgtatagacagcctatgcctggataagaacatgctgcgtcagagagttctttttcactttgcccctcaaaatgtgcacaccgacagccacagatagatcccagatgtctttttcctgctcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagactatatccacatcacagagagctggcccattgctcagggcctgggaagtggtagggagggaccttcccagaagagagatgactcaggctggtcccaagcccctcctgtagaacaaacagacaaggtgaggagcaaggaggcatttggaggtcatctggcccagcacccttgtctggaagacagatttaagttccataaagtcacttaggaggagaacatagtccaggttgaaccttgctgcctgccctctggttgaaacatcagtgttgaatcaatagaccacgtcctgtccataccttgggaattagactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgggcatggtgtcacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagcccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccataattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagcactttcggaggcctaggtgggcagatcacaaggtcaggagatggagaccatcctggctaacgtggtgaaaccccgtctctactaaaaatagaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgcagtgaactgtgatcacgccactgcactgcagcctgggcaacagtgcgaaaccctgtatcaaaaaaaaaaaaaaaaaaaaaaagaaacacaacttaccaaaccaagaaacttacagagaacatgattagaagctagcatctgtttttaccctaccctcttcccctatgacccaccaccacgcaggccttgctaatgtggggtctttgtggaggatcttcaggatcttcagtgccagaacccagcatttaaactcttatttgacagtggggccacagcagatttaaaaggacaatgacatgataaaaaatgtgttcctgagagatttaaatgcaggcctatagagagcagatgttaaaagagaagaagcagactgggcatggtggctcgcatctataatcgcagcactttgggaggccaaggcgggtgcatcacttgagcccaggagtttgagaccagcctgagcaacatggtgaaaccccatctctacaaagaatacaaacattagacacttttcaaaagaagacatttatgcagccaacagacacatgaaaaaatgctcatcatcactggccctcagagacatgcaaatcaaaaccacaatgagataccatctcacaccagttagaatggtgatcattaaaaagtcaggaaaaaacaggtcctggagaggatgtagagaaataggaacacttttacactgttggtgggactgtaaaccagttcaaccattgtggaagacattgtggcgattcctcaaggatctagaactagaaataccatttgacccagccatcccattactgggtatatacccaaaggattatatatcatgctgctataaagacacatgcacatgtatgtttattgcggcactattcacaatagcaaagacttggaaccaactcagatgttcatcaatgatagactggattaagaaaatgtggcacatatacaccatggaatactacacagccataaaaaaaggatgagttcatgtctcttgtagggacatggatgaagctggaaaccatcattctcagcaaactatcacaaggacaaaaaaaccaaacactgcatgttctcactaataggtgggaattgaacaatgagaacacttggacacaggaaggggaacatcacacaccggggcctgtcgtggggtggggggaggggagaaggatagcattaggagatatatctaatgtaaatgacgagttaatgggtgcagcacaccgacatggcacatgtatacttatgtaacaaagctgcacattgtgcacatgtaccctagaacttaaagtataaaaaaaaaaattagctgggcgtgatggcacctgcctgtaccccagctacttgggaggctgaagtgggaggatcacttcagctcaggtggtagaggctgcagtgagctcacatcacaccactgcacttcggcctgggtgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaattggttgtgattgaaaggaaagaaggaggtaatgatgagttttggtctgggaaccggagaatggtggtccatggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcagaattccaggacgtctcaaatttctggctggtacaccctgggtaaggtccacaggctggatgggttttggaacatgtcttgattgtactttttcctcttggtttggaaagcaacgtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatggaagccaagagaagcaaggagtttttcatggttaaatcttgtaaagatgctttttaaagcatattaatccattagtaatccatttggatttgggaatacggtcatatactgtttggtacaatatgtactaaacctggtcctggaaaattaagtggaaatataggtttaaactactggaacttcaaaatagcttctcagtaattccttctcagcaatcattccaattcctagatttaaaaaaatgttgatatatcaaatttccatcaagaggaacatacatatggatttttggagaggggagcagagcagaagagaaaactttcaacttttaatagtatttcaaatttacctgaaagtgacccaaataatacaagcaactgtttaccctgattctccaatacacctgcatctttaattatgctaatttgatacaggtgtcagattatgcattaacaaagacatcctttttctttgagtatgtgttttctatggttatgtaaattatggaggtgctaaacatacctttagagaactttgtatttgtattaactttttttttttttttttttttttaatagcgatggggtttcactgtgttgcccaggctggtctcaaactcctgagttcaagtgatctgccttgcttggcttcccaaagtgctgcgattacaggcatctgccaccgtgcccagctatagagcttcatttatttatttatttatttatttatttatttatttatgagacaaggtctcactctgtctcccaggctggagtgtagtggcatgacctcggcttactgcaacctccgcctcctgggttgaagcgattctcctgcctcagcctcctgagtagctgggactacaggcacatgccaccatgcctggctaacttttgtttctttttaaatagaggtctgtttttactatgttggccaggctggtctggaactcctgaggtcaagcaatctacctgcttctctctcccaaagtgttgggattacaggtgtgtgccaccatgtgtggctatagaactttttaatgtgccaaggtctgtgttcagtgttttcttattcctcatctgacttagttctcaaagtccttgcctaaggtattgctgtcctcaccgtcctatggggagataggtcactttcccaagtctgggcagccagcagcagggctaagatcaccactcagaccctgtgtttttatttttcatctcctcacatctggcgctgaatgtcaggaccttcctggcctctgggaaagacacaggatggctgttttgagaggagtgtgaaatacatgaaggcaggacttccacacacctggacgtgaactagaggtgaggtggggaaagacaggaagtagatcagtgttgcccagaccctaccttttccaactagggtgtggaccatccttcagagcttggcctccaagttggaacccgtgtataccactgacagtgtttcctgggatggtgatatttatcaagtgcagaggcccagacacagagagcttgaggacctttgtgtgagacagtgaaaccctcaaaggcaagggctctgtttcatgagttttctatctcctgctgctgtctcggtgggcctgtttgagttgacctgtcccgtcggtattagcaactggcaacagtgggtttttgttaaatacggcaaatattaagagtcgtctctgggcattttagtttattcattcatttgttcatttattccacagggatttattatgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacatgggtactggagagtgggaggcccagtcacggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggcagccacaggagggctttagacaggaccgtggccccgctggattttctgcccattgacttgggctcgaagtcacgtccatgttgctattacagatgcctcccagaacagtttatataatcgtcaacgtatattcatggagcatcttctgtctgctagacacagaattgggtgttgggctttaaagatggatgaaaggcagtacctggtctagagaggctgctacctggatggtgtgtttgccatcctcagtagtgtgtgtcccttacagatgatgcccagtgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggctactgaaatggcttagaatgccattttatcacatggtcaaattattcaatgatcaaatatcgaattattaaaaattatcaaaaggaagttccctgaaacatgaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggcccaagtttacccaattcgactgcccccacccagatagaatattcatggttagaccataaactacataactggaaattttaaatctatttttatatgcatacaaaaactgcaggcctgaagcttctaaaaataaacgttactttcatcccattatagaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtataaaataacctctgtggtatttgtttaccctgattttttgatttatgagtcgtcattgctcgctatagaagaagaaaaataaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccttttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactcacagccatgaatttcactgaagtttatgattggtccctgattgcctcacatcttgcaaagaatcctcttctagaaagcgttcttgcagttagattaacaagcagatatactgaactggtgcatgaatgaataggaaatatcccagttgcaaaggataaatctatcatgtagtggagagcgtgttcaggcaaaacatttggttctgcggtcgcttggaggattgggcccgtgctataattaatgccactagcagtaaaaggacattagggatgtcgcgcatgttgattatttcttcattttgtttatccaagtttccccgccttggaagctccgtggccattgccaaagaaagccctggagacagagcgttagccgttgctcctcgtaagcgcatcattaccttcctccgaacaaagtcctttttttttttttgtcagtagagggtgaaaacattattggattcaggagttcatagtagtcctgtatgaagctggggacggggggatagagttatgaaatggaccatttcaaatggcattatcttcccacagtgaggtacacctttcataaatcataggagagtgctcagaaaatagagcatttgttattcctgcagtacattgtatttgcatcccccctactcacaggaaagaagaaattctcaggtttcctttcccaggtttgaaaaggcagttaatcgccttacaatgaaattatatttttaaaaaaggtatcataatcaaataaaagaagtacttcatgtaagtcaaggattgtgcttttactactattttttctttttttgtaatcatggtggttctttttgcccacttatttaggccttaatttaattacggcgctgattaagttctttggttttattttttactgtaaacattgtgctgtattccgtaggaaaatgtagatgaatgtgggtcattgggaaataaagtgggtggaagtattggcgagcatttctttcccactctctacctcgcctggtctagccgctgataggtagttactctttagtatgcccaagttcaaattacgtatgactgtgattctaacacggaagcgccctccttttctagtagcttggatgtgattggtatggagaagcagagtgggtgcgtctttgtgtgttcttgacatagttaaagagtttggtatagtcaattccctttaaagtagtaggcttcttaaataattctagttgttcctcgtgctgccaagccatcttgaagaatttttcttcatttgtaaggggttaaaagtcatcaagctgattgaaaagtcaagaacctctagcgcagcctaccccttgcatatttgatactctcttttgcactctcgggagcagttttgaggacacactgtaaaaatgtatgacagcagtttgaagataagtctgttgccccaaataatcataagaagaagacagaagaaaaattgattcccgtagctctctgggcagtgggatgggggtaaagcaaggaattaataaaaacccaccagaatacattatttcagacaatcaaggagagcgttacattttaaaggtacttcatctcagaaagtttgagacatacttttcacacgtggcatgaagagaaaatggaatggaatgagcactaatgaggaccttgaacttaactaactgaacttgatggtcatcgcaagacataggggagaaatattttgagacatcattgtgcaggcaaacatgagcaagaaattgagaaatccgttcatgcacttctctctggtttcccggaagggatgaattccaaatcccgtggctcaggtcctaggtcaaagacagctctttagaaagagatgttctttgcttctttgctgactgcccatcccctcctctctctcaaggaaataagatattcatttgcaagtaaataatgcagcagtcttggatttgtatcagatcaactttgaatgaaagcctgcctttctgcgtttatttttgcttatctctcctgcttctgcttcctgttttgttaaataagggcaatgacggcaactattttaaattgctataaagttttagctagacagcgaatcaaggtggcaacacatggtgggttcttaaataatagttgtcatttgagtgctttctatatgatgtacatttcattttgcactttacaaataacctcttcctttttctgtttaatcttaaaaaagatcccgggaggcaggcgttattgtgcccatttcctggataaggagaatgaggtacgctaaacgagtaaaaagcaacccgagatccaaaccctttggcattcaagattacactcttattcactaactgttcatctcctccgactgcatcgccactcccccaggccagataacccatccagacctggagaactcctagagggagaaacagggaggacccaggcacataaacttgcagagcagctgagttatcagatcttccaagccatggggttatcgagctttatcagagcagccttgctcttgcagtttctgacacatcaccattgatcagtcctgggaaacaaacaaaatagagggcgatggctccactctgtgtggccccgtcaatggcctggacgcagctgaaaaaatccagaagagtgtaggacactggaaaagtagcagggtgtgcgattgcagggatgggaccagcagtaaaaggtagccctgccaagaccattaagcttcctgcaactccttctggatcccacaatttgaaggggaaatctttcccaccgcacatcactgtttggtggactaaatggctccccgatgtcccgaaagagcacagcttctggaagtgtggtatgtggtccctgagatgaagcagcagccacaggaacccatcattcctgctacccaaggcctccattgcctggttttctgttgtcagaagagttcattttcaggtccttcaccagatattttagaagctcatcaaggaaaggacgtttgaagaaaaacaaataaacaaaaacacaaaatcaaggacgtattgatttctgagaattcctcctgggttttgtttgtttgtttgtttgggggttttttgctgtggtattgtctgagcctatgataagattgttgttgattgatttttgtctttcaagactcagcacaacacatcccatccttctggataatctcttctaccctccctttccagataaaagttgactctcataattgtaactctcccctactttatcagcatctacatctttcagcctctaccacattgaattggaattatatgtctgttttatgtaccatgctgtgaactccttgaagataggagctgtcttatcttcaaggtgctcaagacacgtttgttgcatcagttgaatggagtcaaattataaacaggtgatgggggcaaatatcacaatatgatactctgaacatcttctctgacaaaaactggtcctcaagatacaacaacatttatatttgatttgtcttgctgtatcgaatcaagctgtggtcttgagtttcgtacacatctatgtaagcactctgaattgagtgactctttcccaaagatcatactgggatctttggaatgaatggcgggtcacccatccaattgcttttgcggagattcgagcatgtggggaatgcaagtcacaatatcctgcaaaagccaacttgagacctcctaggactgcactgctgcttatgacactgatccttagcccatctaagtaagtgagcatggccctgtaagtgaaattggagaggttccttgacattcccacatagctgcttccctggtaattcacctgggtccagaacacagaagggagattctaattgaaaaacttttcctaaaggccaggcacagtggctcacacctgtaatcccagcactttcagaggccgaggcagggagatcacttgagatcaggagttcaagaccagcctgagcaacatggtgaaaccccatctctacaaaaaatatagaacattagctgggcatggtggcgtacacctgtagtcgcaggtacttgggaggctgaggtaaggggattgctggagcctgggatatcaaggctacagtgagccgagaccgcacctctggagtccaccctgggtgacagagtgacaccctgtgtcaaaaaaagaaaaagaaaaagaaagaaaaagctttgcctgtatatgtagaacaaatgaaaaccaaataacagtggcaccagttcttctttcagtttccatggaatatcaagcacgatttgagttgagcaatttgatttgattgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttggtttgttggcttatgttcgctgcttgatctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcgtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctccagttaattttactttaattccccctacaagaatgccgagacacctctgcctattttctctttctgtgtttgttgtttcttttgtttttgttttcgagactgagtcttgctctgtcgcccaggatggagtacagcagtgcaatctcggctcactgcagcctccaactcccggctccagtgattctcctgtctcagtctcccaagtagctgggattacagggatgcgccaccatgcccagctaattttttgtatttttagtagagacggggtttcaccatgttggccaggctggtcttgaactcctgacctgagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcagagttcaccctggaagacagagtttctttctgtcttcatcctagggcacaggagagatgcagtgatggcatgtctccactctgcagacatgttgcaggcctggaaaactgtgtggtgcgtctgtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaagagggactttgttccccctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgaggaaacgctctcttcttcttgcaggggagggctggcaaattcagtgaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaaaaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactagctattatttatttgttgtcactgtttgggacccctgttgctgtctcaccaaagaacttcttgtctcccttttagaagtttccagagcgtcttcctgatgttgcatagagcactcacacctaacagatctcagaacttgtatcttttctgggtggctagactgaaaaatccattttcttatgagtgagccagaggtctgtctcttgcggcatttctgcttttgagaacctcccgtttcctgaaaggcaccagaccccaagacagctctgctgcctgattggtagatgcccatgacagctctgcttcatgcctgctgcctcctcatccctctggatgccttgtggtcctgcttgtctgaagagcataaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaataggaaggttatcctgggtgattagcatggatcagagttctcacaggagcccttcaaagcagaaggggaaggtggacaagagaatcggagagatgtggcagagggtaggcagagagattgcaagcagggaaggatttcacgtactgccactggctttgaagatggagggggcacatggctagaaatatgggcggccctcagaagctaagaactagctctttctgacagccagaaggaaatagggaccttccacctacaatagcatggaaaacggggacctcagttctgcaactgcatggagctgaattctgccaataacctgaataggtttggcagcagattctttcctggagcctccaaagaagagcccaggctggctgacaccttgtgagtggccttgtgagacctgaaacaggaaacccacctgagccactctttgcctgggacttccaacccacagcaactgtgccgtcgtgactagatacgtttttttaaggggatgataatttgctgtggcagcaatagaaaatctgatacactgtcatggggccttccacagggtggggctcaaccagccctcagctcatctagcatgtttcctcctacaacctggactttttcctgttgtcccctcccgtgacactcagctccctgcattcaatagaattgcttttgtgggatgatgagtgtgttcagagtcatactcagcctaattattgcttttgaccaaccccaacacataatgctgtatgtcatgctgtactacttttaatttcacagatgaacacatttctgttcttttaatccacctctccaaggctcgtgttaactccatctggacaaagccttgaggtatacgtgtggcttcttttgagcatcgtgccatagctgtccctgatctaccttgcggggcaaacacaacaagtaaaaggttttcctcttgaaggattgaacgcctcaatgcgtgcatcctacattgtctagtgggagaaatctccgttgtagattctgacatgtcactccacatctttgtaactttttatggctctcagccctactttcttaatagtagcagcagtatttatctactgtttattgtattccaggtaaaggatatgcgaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatgcttttccaatattccctcctaatctttcagttgaattatggtctttagctcaaatgcatgacatgatgtgtgtgcctttggagtggggcggtattagtcagtcgatggttatttccttgaggagaaaggaaaggagaagttgagtacttttcagtgtttgttactacaaaagcatggtggcatgccattgttctgagaggaagggggttttttgccttgtcagctcctgatgaaaaagatgttgggttggaaagctaagttacagcaggtgaacttgaatttgaggaaagacaaagcaaaccctggctattaaaggaacacacacacacacatacacacacacacacacacacacgtttctggtattaggaaatggagatttctaacataataaaaaagattgaacttaaaaatgacttccattaaatagggtaagaattttgaggtggaatcctttttccttgggtcagtactttctgcaagcttctaagtaatggtttctcttagacactcacggtgataaaattgggagttttcaaatgaaatctggaatgatctactggcatcatgcctaggactttggaaaacttgaaggttggcacctttggggaaaaccagacttttgaagcaggggctctgattgtctcttcttattatagtgcaaggtgtttggcagaggtgtggtagctgaaggcccaaggataacattgtccagattttcagtctttggagccataaacatccagttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgattggcaactgggaagcctaagggtggatctggcgtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcagcaagagtcccacggctgactctcattggccctcagtgggtcacatgtaaatcattgagccaatcaccgtctttctgtctggacctggaataaagaccaccttagagcatgggagcgggatccccttgatccacaccatatagactgtgaggtatgaagtacctcacagtaaagaagtcatgttattgctggaaaaggggacatgggtattaaaaagacaaaaacaacagggcttcatcacagcagctatactgctccatcaatacccatcccaggagacagtggcagtcttgatgtcaatcttgttttaggatcattgccagtggaattcaggactgcggttctacccggtaccggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgtagcaaagtgatctttttgagacccaaatgtgagtatgccattctaatcttcccaccctcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttgccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcctgtttttgtgtttgtttattaattcctatttttcccacctgacagtacgctccgtagggcatgtgtttgtttcggttccccaacgtatccctactgcccagcagaaggcttagctgttaacaagtgtttattgaatgagtaagtgaatgagtacgtgaataaatctgcgctttagaggcacttgctcaggcttgtggaataattctacagagagaaacaggaatcaaagggaaacctgaagctggctcagaagatggatgggccagcaaaggcttcagcaaaaccacacaatgctcatgaaaaatcacgcatttctctgatttgtggttattgcttccctggattttttttttttccagttgttgttgttcatggtggtggtggacaatctgaccatataccaaccaaattgactgttaaattcaatcatcagtgaccactcctgataatctgacctcctaagttagagcccctgggaagttcagccgtggttctgaccaggcaggataactatctaagtgttcccctttggacctagactgagccaaagattctccttggtctatataggataatagatttctaaaacaaaccaatagctcaggcacaattatagtggggggtggggggcatgtttaacctactttagagaacaaactctttttaagggctttgcacactaattgtatgcaaatggatgctgctaattgcaaacacaaaattcaaacctagtcaaatttgaaacctgttcatcaacagtccctttaggacctctgccccactctatgtatgcagtttaaattgctgatttatggctacataatgtcttcctaacccccagtttactgttggcttccttcagagtcattgccccaggggactcattgacggcagagagtgtgtcccctccactgttgcctcaatgcccagctcagcccagtgggtaccgtacttcaaaacctcttattgaggtccacctctgtgccaagcatttcggtaggcagtgacagaagagagtgcatgcatgaatggataaactctttcctggaatgcctgctctcatcacctggtttcaaagtcgagccagacgttctgtctcagctcagattctacctaccctgaggttcgcagctgggcatgatcgagccactctccactctcctgtagcatttttgggctttgagtttatttgacacttttcacttgctgccttatattgcgtttatttttattaattacttcagtagtcatttacaaaatgctgctgaatccaagtccctgtgcaagatgctgcaggagacaaaaagatgaacaacacgtggtctttgctttcataggttatttctcctcttccatagcaacacatgtcaaggcaaggaccatatcttattcagttcctagtcatcttttctttcttttgctttttcttttttaaattgttaagatctgccataaaaatgtctgtcagagtaggcatgattgcatattctttagatggatgggtggatggatggatggatggttggatggttgggtggatgtatggttggatgattggatggatgatggttgagtgagtgggtggatggataggtggaaggatgaatggatgcatggctgagtggatagaaggtggatggatggagggatggatggttggatggttggataattggatggatgcatggatgtttgggtggatgaacagatgaatggatgcatggatgaatgagtagttggatggatggataaatgatgcatggatagatgaatggtgaaacttttatattttactaaaaatctgcattgatagcctagtggcttgctaaaaataagggagctgcccaaatgccccatttcctttatatacttgtggagcagcagcgaaggccaagccagtgccaggggctggaaacagacacataaataagaacaaataagatacagacctgacctcaatgattttttgatatagaagcataggcacataaataaattcctgtaatgggagtctagggtgaggggtggtgggtgccataataaaaattatataaagtgctatggggaagcaaagctacatgaccaatttgttctatttatttatttgttattattatgttttttgagacagagtctcgttctgtcactcaggctggagtgcggtggcatgattgtagctcactccagtcttgagctcctggactcaagagatcctcctgcctcagtttcctgagtagctgagaccacaggcacgggacaccatgccagtctaatttttaaattttttgtagggacagggcctcactgtgttgcccaggctcatctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcagctggaggagagactgcaggggtcagagatcagggccatatgctagagctgcaatgtgggtgctcaaatgatgttcagtgcatcttcacagatggacctccacatgtccctcatgccctaaaatagatattctccacagctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctatttttactggagcatgtgagggtggatcacaactaggatggcgcgaagttcacctcgtgtaagcacaccaggctgcagggataataactgcactttttaaaaccagcaaatcattcatatttactttatgaaacctcttttaactttattttttatattttttttattttcttgtttctttttatttttaaaatttatttttgttttttttgttttgagacagggccttgctctattgcccaggctggatggagtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagtttgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacccagctcatttttttttaatatatatttttagtgaaggcggagtttcaccatgttggccaggctggtctctaactcctgacctcaagtgatccgcccatctcggcctccccaagtgctgggattacaggcatgagccaccactctaggcctgtatttgttttaattgattaatctacaatgacacatcatcatcacctaaagtctataggttcattaggttcacagttggtgatatatattctgtgggttttcacagacatggaatgacatgtatctatcatacatcatatattgtatcatatcatatcatgtcatatcatatcatatcataccgaataatttcattgccctaaaatacctctgttttcactttttaatctctttgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaaattctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgaatgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattctatctctaaaaacttaagtcaagggattttgaagcagttgtttgatttatgtatgtgaacctctcccttaggagaagaacttttctttggcaaacaccataggaacggagaccttaacaaaagaattaggactctcttgtcctgttttaatctcaaagctgtccctgcgctggtgcggctggcccacttgtgcctttgtgaatttgcagagaagaggctgggcgtggggggacacatgactaatccgccctttcttttgtttgtgcaacaactcaattcactgtcaccacatcagcacatttgctgcaaatctcagtgccctctcactttcgttttatttaatgcgtttctacattttcccaaggccacatgagctgttttctggcgcgtggtatgcctgcctcaaataactaacattgcctgggtcttggaatctgagccttcatattctccgatatattatttggtcctattgttccttaacttgctcatcattcacacggcgaaggaaattccatttggtccttttaagaccgccagactagctgacttaaacactcagctccagctacttctgaatatttcggttctttattgaaatggtccttttaatgtcatctttaatttaatcaaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatggtgccttgcagtttccaaagtaagctgaacagtgttttttaacagtgctgcccctctctcccactagaaatgcgagtccatccttttaccaagtgtggtacgacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttggggtagtgggcacaggggaaggaaggttatgtaattttaaaattcttcctttgattcaaaagaaaaaaacatgtttgttgcattcaactccaaagggtgagcatagcttagtggggagagatttggactaaaaaataagagttctgggttcaagatctgaggtaaattatttgctaggccttagtttcccatctgtgaaaaaagggagttctataacagcaagacatttaatattaaaataatgtaatgtttttaaaaatgcttgtctacccactttttcttgagattagtaagaccatcttccaattagaatgtttatccgaacttaccgctaggtatttccttgtagagtatgaaagtaaaatatcaatgggccatctctacgtcaaggttctcgttcttctcattactgagaaattatgttcctggaataatattgtacagacttagaaataagggcattgaacttaattcatttatttttcaaaaggcatgtattttttacctgttgctatatctgctgccagccaagtgctgtgcttggccctgagaaagcaaagagagatagagatgtccatgttttggaacttgacgtccattaggggacataaacatttgaaaagataacactaacaagctaattcaggtatgataataaaaaccttcacagggttagccatccatctatctgtccatccatctattcactcatgcattcatccacctgttcatccattcatctgtccattcatccatctatccatccatctacttctaggttgtgagaacccgtagtattgactctcagtgtgataggaaggccagtgtcttggtgaaagatcaaagagctcatcaaaatttgtcggatagactgcaggctcagacactgatgagacccccctgcaactaccacatcaaaaggcctaggagcctttccatgaccaaatgcccatattgatgaatccgagacaagtgagggaaagatgtcctctgtcggtgttctgaaccctgtggaaatcatacggggaactataaaagatcctgatgcctggttttcttctggagagtctgatttaattggataaggatacagcctgggcatcaagagtttctagatgacctaagtaattctcatttgcaaccaaggttgagaataaagggtgtgtataaggtgagagacttctggttaactaaaggaaataccaatgacatttgtgctttaggtctaccagttagtgggtattggtgcatggtgggacagactaaatggctacaggtcagggtcattgtcaaagagtgagggataaggggttgtgctgtggctcagaggcagagtagactgaggaagaacagctaattccagaaagccatgttgtggtgtaaaagatagtacctgacttgtaatgtctgacaccaaaaatgaccttaatttgggtcataggacaaagacctccccacctccagctatgaaagacagaaaatgataggactaggcttcatattttctagcgtaacgtttggcttgtggtatattcaaaactaagtccgtgtttgttgctgctgagtgactgggctgatactacctgtccttcagccatctagacttgctctctaccatcctcaatacttcatatgaaaggagactgtcacttcatgaaaatcatttatttgctttagcttaaatctactggagattacaactgcctcattttgtcaccttcttaccccagaaggaaatatctccacaagagagcaggtatttattgagttatgactgtcaggcatggaacagatccattggtcagaaataaggaaattgtctctaccttcaaggttctcacagtctggagggaacagagagccatcagggacaataggtccctgtgccatcagctactgggatgtatgactttccagtagaggtacacagcacttgttccaaaaggagcctatgtagctttgggagttctctatttagtcaccttattttttttgtcttcttgttaaactagcatcctgttttactgaatctctgcctcagttgctttatttactgtatacatacatagctcttttgaagacttgatgtcaaaagtaaagaagttcagaacctacggggcttgctttgggtcccaaattatcttagctttctggaaagagaagaatctataatgtattctccatggagtatctttactcacttgtgatgagatgtctgtaaaagtaatcagctccatacatctgggcatgatgaccctcaggcccttgagactcaggtgttctcagctcatggtgcaagttcccctgaaagaaagactcaagccaagcattcaatggttatgttccagatcatagtctcctaaaagccaggggtcctttatgcagggatggtgacatcagaagttaaaaggtctatgcagattaacgaggaaaaatgagggaaattactgtaaggtttttaaaacatgatagttatatatgaactgatgattatataattgaacgtgcctaaattgatgtagttctctgtaaaactagttggtgtaaggaaacttggtctttgaccatcaaggaggttgcagtttgtggcatggcacaaagataacactcagcagatatatagctatgggatacatggatggatggatggatgggtggatggatggatggatggatggataggtagatggatggatgcgtgggtgtgtggaatggtgggtggtaggtgggtacatagatggatgtatggatgggtgggttggtgggtgcatggatgggtgagtaaggggggataaatgaaaggcttgttcttctgaagggactctttacaaagagtctttgatcttccagcttcacgtgcaagagaatccccaaggtgagcttgttaaaataagcatattctgggtatcacttcctgattttctggttcagtaagtctgaggaggaacttggggaactttatcttttaaacaagtacctcaggttatcatagtagtcttgctgtcctgaatcttaatgcatctctatttctgctacatcttccatgaagttgattttgcagaaatcattctgtggttccacattgactgcatccaagacctattgccttcagatttacatcaagcacaatttggcaggtattagggatggacccagcagccaagtctttgttgccttaaacagatcccttgtctcttgtcaggacctccttccaggctgctcctgagcaagtctggatgtgacttctacctatgatccagtgggttgggccataaaggagctttggaaagggacagtcttagggtgaaaaagagggagaggcttgccatctgaacaggaatctctcccagaggagagaagagaagcctaggctttaatgaggacagccaccctgtggatgactttctgtgtgatgttatgtggaggtggcttcttttttctctatcccattagctgaattctgtgccagaaggaagagatttggagtcagcaaggcatccttttttttttttttttttttttttaaaaaaaaaaaaaaagaaggaatgtgattgtgaaggaagcaagaaaaggcccaaaggctctggacaagggctaggaggctgaggagttttacacattcataatttccttgtaggccaagcttactctcagggatgacagtcattttctaagaaagtgagattgcttcacattgcatttaaaggcttaaataatgtattctgtcagacaattctctgaaatggttttccaagtgaatgcatcagaaagtgcctagaaagaatgcctggcacaggaagaggagggcattcagaaaatgtgagctgcttgcatcagaatctaacttgagatgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatataaatagtcacccagtacgcattctttgctgtcttgcttcttttactcctcattaggttgtgggatttgcccacgatatttcattctttattgtcattcttctttctctgccactgccatcctaccaacagtttgtattatgaaaaattgcagacgtacacaaaagttgaaagaattgtactgtaagtactctgatatgcaccacctagattctacaattaacatttccctctatttgcatctctatccatttaccattcctcttgtctatccatcagtctatcttgattcatttcaaaataagttgtaggtcaggtgcagtggctcacacctgtaataccagcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacacagacacatattgttttttccattttaagatacagaaagtgggccttaaaggtgctactgacttgctgatatgctttggctgtgtccccacccaaatcttaacttgaatcgtatctcccagaattcccacgtgttgtgggagggacccagggagaggtaattgaatcatgggggctggtgtttcccatgttattcttatgaaagtgaataagtttcataagatccaatgaatttatcaggggtttctgcagtttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaacatatctgaaaatgtggaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgactcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgacagaaaagaaaaacccattttctggggagaaattcaagctggctgcagaaatttgtgtaagtggcaaggaacctaatgttaatctcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaatgtatagctcaggctgtggcttcagagggtggaagccccaagccttggcagcctccatgtggtgttgagtgtgtgggggcacagaagtcaagaattggggtttgggaacctccgcctagttttcagaaaatatatggaaacacctggatgccccagcaaaagtttgctgcatgggtggagccctcatggagaacctctgctagggcagtgctgaagggaaatgtagggctggagcctccaggcagagtccatactggggcactgcccagtggatctgtgagaagagggaaagtgaactaagctctttaaacctcatatgtttccatcagtaacatgggaacaatagtaacaattccacagagatagtattgatggttgaacaagatgtttaaatcactagtaaaatttggccagacacggtggctcatgcctataatcctagcacgttgggaggctgaggtgggtggagcacctgaggtgaggagttcgagaccagcctggtcaacatggtgaaaccccatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctagcataaactatgttactcaacccagttctgtcgtcgtcatttttttgtgttggctttgcccttcccgcattgtgacttgatcccatttaagcagcaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaattttggatacactgtgtgaccagctctgaggattccaagcttttttgcgtggcttcttacctatcagctaaagaacctagctttacttatccaacttagatattaaatcccatgatataatttatttttccgtgtgaaatatctcaggaacaaaaaagtcaggttgagttttctaaaggcactggtttaagaggctataggttaagaggagataacagacatgctcagaaacaaatcatttcctgatagctgtttcagatggaaccaaatggaaaacagtgcttctttccgtttactgtacaccccctatcctggcatctaaacatatttgtaatcatactgtctatagaagttttggttctgcttttgaccttaacactaaaatacccttccataatattataggcttttcatgtacatcgtttttaagatggctataaattccacttagtggctatgactgtagttttttttttaactcttcccctaatagtgaaaatttagattgtttctaaattttccttactataagtaaggctaaaaagtaacatgtgaatgttttgaatcaataaatatagtatgtattaataatattgagctatttcttaagattacattttcagaagtaagatcactgagtcaaagggtgcacactgtttaaaggagcttaaatatattgcaaaactcttttcatggtctgctgatatcactgaaaatggaggtctggattcaaatcacatgtgccaactgttctactttggcagaattacctactgctttgggcctcgggtactaaatttgtgaaatgggaaaaataatagttcccacctcatagagttgcagtggagattgaatgagtttgtagataaaaagcgtctgcgttgtgtctggtacatggtaaggggttcgtaaatactgagttatttcttattaacatttattattgtctccactggaagaagagcctgtagaatatgcagactattcaaatgcttcctttggtccattgttgtcctttcttttctcttctagaactttccccatagtcatgcatctgtccctgggttatctgatatgtgtttcagcctgttttcccaagtttacctgcctctctgagaagcccatcagccctgagagatacctggaaggaaagaggaaaatgcgtgattcaaatcatgttgcaagtggatgaatctagccccaaacaactgggaggcaactactcctgcctgccgaggcctttttttttttttttttttttttttttgagactcactctgtcacccaggctggagtgcagtggcatgatcatggctcactgcagcctcccgggctcaagctttccacccacctcagcctcctgagttgctgggaccacaagtatgcaccaacatgcctggttaatttttgtggttttttttttttttttttttttcctgctgagatggggatttcaccatgttctccaggctggtttcaaactcctgagtccaggtgatccacccatcttggcctcccagagtgctgggattacaggtgtgagccactatgcccaataccccctatgtagacttttaaagaaatacaggaaacagccaagactggtgtcattcagatttagcttgggagagtctagtgggtgttaggttcccacaggatgaaggatcaccatgaacggtcaggacctgacttaggaggactcagaagctggagactgcagaggatggcacagagttccaaatctttggggtgtgtaagagtaggagaggcaggatgggagaggatgggagtgatgccacataaatcaactctgttgcagcctccggggccacatcagtagctgcaggaggaggagggaacagggagacagggagcctttcttcctttcctcacccccagttctgtgtttatacttctcatttagcccataccccactatattaaaagaagatgtataagtgtatgtgtttaatctaccattccttgtggcacagtgcatggtctgcatggcacagtgtgtggtctgtatggcacagtgcatggtccgcatggcacagcgcgtggtccgcgtggcacagcgcgtggtccgcgtggcacagcgcgtggtccgcgtggcacagcgcgtggtctgcgtggcacagtgcgtggtctgcatggcacagcacatggacatgattcatacatgcaagtgaatgagtgaatgggcgatttccagactatccagaaactgtgccccatagtcctacccgtaggaatccaacagggaactgtcaccaccgacccgaggcaggaaccatgtgctctgagccctggccattttgtgtagatggagataaattgtcattgctaattgccagagaccaggtcctggtggtagccaaactgttccctagggagttctcaccaaccttgcaaaatgagatggcaatcttcatcgtggatgcaattatgtttcattgttaaccatcacaagcaacgggacattatgatgactgttataagttggtttcacatgtaaactttgacctcagagcaatggggcaggcttttcccaaggaccctgttgagaggttcatgatggtgacaaaaagcacaagccccagctgccaaggaggctgatatcgggagaggcagaatgtgtcttttctttcttcttcctcttcttcttcttctttttgaaaccatgctcattggttttaggaatcattagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggccccagtggcccttgtcttgttatttcctccattagagacctggcgtataattgtgggagggagaagccagtggagcagtcaggggactccctggctgtttctgtgtctggtcttatgggtctgggcactgaattcagtcacaaaccctagcatgctcctttgctacctcaggggacaaagtcaagaaaataacactaggattgccaccctgctctctctctctctctcttttttttttttttctttttgaggaagggtctctctctgtcacctggctggaatacaatggtgctatcttggcccactgcaccctccatctccctggttcaagggattctcgtgcctcagcctcccgagtagctgggattacaggggcacatgccaccatgcccagctaattttgtatttctagtacagacagggtttcaccgtgttggccaggctggtctcaaactcctgacctcaagtgatccaaccgcctcagcctcccaaagtgctgggatgacaggtgtgagccaccacacccagccactctctttcaactagaacagttcctctcttctttgttgcatatttttgtatttcatgcaaggtgctgtttatgaacaagggagtttcctgcagctttaataaagaagagaaaagaaaagaaagaaaggaaaattcgcatgttgaaaacattgtactaatcaaaaaagccagtcacaaaggaccctatgttatatgatttcatttacatgaaataccccaaagaggcaaatctgcagaaacagaaagtagagtggttgccaggggctggggatggggtgtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactttctctagttcactgtgaatggtttttgaataacatcaattagcataacctcatgcccagcatcgtccttattgttgagagcacagcagtgacaaaggtgcaactcttgctcttgagcgatcacagtttatttggggaacctggtactacctaataaaaccaggggagactcgacccaaggcattgtgtttgagctaggctttgaacaatgtatagaccctcaccaagtatggaagtggaagagtaagacattcaaggtagaaggaacagtatgaggaaagtcagagagctaacaaagattatagtgtaatgccagaatcatgagaaatttgctgagaattcatttgaggccataatttaaaaagataggaggagccatgtgtagaactttcacagaacagtgtgtacctcccctccttcttccttattagtcgtgattcttggggggcaactaaacccagcttttggcaaaagggagtatgttggttcatgtaccaggaagtcttggagtgatggcttcaggcacggctggatccaggggctcaaaaatataatcagatgatttgtttgcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtatatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatgctgaaatcccatctctactaaaaatacaaaaattaggtggcaggcacttgtaatcccagctactcagaaggctgaggcgggagaatctgttgagtccgggaggcggaggttgcagtgagccaaggtcacgccactgctctccagtctgggtgacagactctgtgtcaaaaaaaaaaaaaaaaaaaaaaaaaagagagagataggctgtttaacaggtgtcgtaggtcatgtatctacagccatggaaagagaatggagcactctaatggatccctgacgggtcaaatggagcaaagtgtgcttcccagaagagcataagaaaaaggaagggtactgggtggaccaaatctattgttacaatatcccttatattccttagggttcctttttttcaagttaaagcattgagtcatgtctctgataaatcgcccccccaccccgatccccaccctctgccgccccggccttctttttgtgctgttgggttccaaactttacctgaggattttcacatgcacatctgttaaatgccatttaaagagaacactaacaagagaaagctagttcatttttcttcctgggacctcagtttcctcatcagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgccggaaggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtgagcgccgtgtatttcaaagcaggatcttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgttccatttacattgaatggcacatgtcataaagtacataccgctgcacatcccaccctctgtttctgtttcaactgcagagcctatttttctttcccttccagctcagctgccttctcctccctgacctcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagacccgtaattgattcataagatcccttcctccgatcgcattgaagagttaattatttttcctgcagttgggactcagctgttgtttccactgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgctttgcagaagtccgggctgtcatcctggcgtttgggtacttatgttccctagtggagacagccgggtagactggggaaggtgataaaagggagaaaaatagaactgttctagaacgatctccacttttaacagcacaatacagagaacagagctactcaataattagccaaccaagtatgaattctcatatgttcttaaagtatctgctgatttcttcaaacatctctaacaacatgtctgatgaatacgaagcctccctttatttatttattttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaaaagtaaatgaaaagtatttctgggtatttttaatgacacaagtttctgtgctgatatgcgggcaggggttcgggagtgggggcaccagggctcatgagccgagagcccctgcttcccttggaaaacggaaatttctatctccaactagggaaaaatttgcatgtgtagaattttggttttttcttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagagaacggattcttttggatttgtgttagagaaaaactgtctctaatgaccgcacagcacaaagcaaagcagttaaatgaataaccgccttccagtacagataataaagcaggagaattttgtgtgtcacatcaataaacatcttaattgaacagcacgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattattgcagttttgttttttatttagcacaaacctaaatattacacgtagcaaatgtcacccgatgcaactgtctgtcctgaagaggaggacagattattctgtggctacctaatggtgtttacagagttgccactttgccaaaccccaagacccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccttgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactctggaccagaattgattgccaccaataaaagatactccagtccttaaaaagtcaacattgttatgttttacttagttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgtggtcctggatgaaaataacactggaggtaagaaaccttggcctagagggttccccaacctttttttttttttcattatggccccctcccccaggagccttttgagatacgactttcctaatggtctttgcccatgaaatctgaataccacagatgtgctgaatgcctgttcgtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcaagatggaattcagcctttcagacaattctgccaggcccttggagggtgggaggaaacaggcaagacctctggctcctagaaccgtaaggacccttgccattaggaccaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgtatatcctgcaccgttcctggcacagagtaggcactggataattatttcttggatgaaagaatgaacaaatgaatgaatgaatgaaagtttttttccttgcaaatctccctgcacactttaatcttaccagcatcttgtgaaacactcctacttctttctgatctttatttcttacgtagttttgaaatgagaaccgatgaagctgcttttgctcatggtacctcaggtcctcgctcactcccagcactcagggctgtgtggtcagagtctcagattcggagcatgtgatgtgcgtgggcctgtgactaacagccacatggcacgcaatggtggcagcctgggaggctgactgagcaagtaatttctgcttaagcaagaacgtgaggggtgatgtagttgcatgcactttgccatcatagcttgatctaggtctcagcctgggatcttgcagctgcgaaaagcatggcgttgcgtttccaagcctgaacatccacacccgcgaagataagaccatctcttggattaatgtgacgctgaaataaaataatccaaagagaaaatgcctgagacccaccaggagctcaccagatactacttctatcttccccactctaggtctttttactgcaactaccgtttaaaatactttttccatgaggcagatcttagtgctgacagtgtcagtgtctttaatgcctggttcagttgcaaacatggagggcagaggtttgatagcatccaaagtatgcacgccgcactccacctcccatgcccttttctttttctcagggccatcagaaaggaagtaactggcttagatttgacacctctttttttgttcgttttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcaactgtttgttttgaaccacttattttggcaagacttcttcagacaggagagccctgagagctcttcaaaggctgggcctgatggtgtttgtcagagaggttcgagctcttaaatttaaatggcctcccacagggaagcagaagtccttttggatcctccagaggactgagatcctccagatgctgttcatttgccttattcgttatgaccatagaagtttgtggggtggcactctttattctgtcctcgccccgcaagcaaagcacacaccacaagctataaggagatgagctcagtaggcctgtcctttactttattttccctattagaatcccaccatagacgccctctctgcatgtgtccttgtctgggggagtcgcttaatttcctttttctttgaggggctataaaatttttgttgttacaaaaatgaaaggggagaggagatagaagaaggaaaacagtgaaagctcagcctcgaaagaagtgcttaaaggaaaggaggttctgacagagggctcggatcatcagcaggggcagggggtgcagggggtgcctgcaagtctgtgaccgtcctgaaggacccccttcctaggatcccaaacatgcactcccatcccagcctcacaccaagctcccatctgggaagcagcagacacacataaaagcaaggaaacttcaaggacgctttttgttttcccctacttttaaaaaattgaggtgaaattcacataatataagattaaccatttcaaagtagacagttcaatagcagtacattcacaatggtgtgtaaataccgcatctatctatttccaaaatatttgtatctccccacaataaaagtctgtaccaattaagcagctactacccattcctcttccctaccattctaccttctgtctcagtaggtttgcctatttgggatattttatttaagtgggatcatacaatagcatcatgtgttcaaggttgacccacattgtggcatgtatcagtacttcattcccttttatcactgaatagtattccactgtatattgataccacagttggttgacccattcatccatccatgggcatttgggttatttccacctttttgctcttgtgaatccatgctgctgtgaataattgcatatgagtatttgggttcctgtttttaattatgttgggtatatacctaggagtggaagtgctgggtcacgcagtaattctttttaactttttggggaaatatcaaaccgttttccacagtggctgcaccatgttgcattcccaccagcgaagtgcaggggttccagtttctcacactgtcaccaactctgtcagtctattctggcactgctataaagaaatgcctgagactgggtaatggctgaagaaaagaggtttaattggctcatgattctgcaggctgcacaggaagcatagaagcttctgctactgggggcgcctcaggaaacttataatcatggcagaaggtaaaggggaagcaggcacatcttacatcgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatccaaaccttatcaccagcgcttgttatttcctcaggtacattttgatgtccctccccactttactctcccctacaccttgaagcaggtgcaatcattttaggctatgaggaccagcatcgaccttcatcagcatctgctctcctttacggccaggtctccttcgtcctccctgctcagaatttcagtctttttttttttttttccctatacagacacaggaagtatatattttcctctcgaatatcacttgggtcttatcttgttttatgctacatgcatgtggcttcccccgttacaaaaagaattcacattattagagaacatttggaaaacatacagaagtaaaacaagccatccccattcccacctcccagagataacgcctgtgttttagttcatctccttctaacctttatagttttttttctatcatattagttaggcattggtttggctccaagtgaaaactgcttctgttattaacatcagcagcagcaacaagaagagagaagtttatgtctgtctcggaatacgtacgtgacaggctcccccatcgaggtgctcagatatggtggccactgcatgattttgctcaggactgaattagaggcaggtgaaaggccctcactccctggaatcagctagcgatggctaaggctcctgtgagggtttctacagaggttccacccagagaggagagtcaaatgggagtttctaccgatgctcttgaaaggatcttgttactcagatgtctctaagacaatgatcagtacccatctctcagagcctgtgcagccgtccatgcttgaggcatgagatgctgaagataaaggtccccagtggtccaggtttttccttctcagcttggaaagcagcaggaaaactgcactgcatttatccaaagggtgtgattggtaagtgtgggtactgatatagaataaatcaacgtggctgggtgcagtggctcacgtctataatcccattactttgggaggccaaggtgggtggatcacaaggtcaggagattgagaccatcctggctaacatggtgaaaccccatctctactaaaaatacaaaaaattagctgggtgtgttggtgggcacctgtacttccaggtgcttgggaagctgaggcaggagaatcacttgaactcagaaggccaaggttgtagtaagctgagattgcaccactgcactgcagccttggcaacagagcgagactccatctcaaatcaatcaaccagtcaatgtgtgcccccttttcctccaactcccaccccaaatccttgctgaatcatacctatccttcacctttataagcatctagtttttaaatctttgctgtgaagttggctgtgtgagctccatttgacagatggaaaaactaaggtagtttgccaaagatggctctttgccttcaggatttccatgtctttattttgagtaaacacttgcactgctaattttattccaacaatgtccttggaatggttttagttctcttggctgtaaccaagtctacacgataccacttgaattgacaacatcacagtcaaacctcaattttcacaattaattgtgccgcagttaattaaattgactgcctggcaatccagtctcaattaaaatactaatagtttatttatttattttgtcttttacgaagcgttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatcctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcactttcctaaactctgcatgtggtctccatgatgtcctggctgtgttagcatcagaaatggctttgcccacatctcccaactctgccctcttattaggatttctctgcgctggctgatgcctgagccatctaatgatctttacgggaataaccaaaaatgctgggtggggggggaaaacgccagcagatctctttagggcagagtagggagggacacggacaatgtgggcagctgtccatgcagcacgtatcacatccaggatgatgtttatatgaagcatcatttttttttttttttaggtggagtcttgctctgtcatccaggctggcatgcagtggcacaatctgggctcactgcaacctccactttccgggttcaggtgattctcctgcctcagcctcccaagtagctgggagtaaaggcacatgccaccatgcccagctaatttttgtatttttgttagagatggggtggccaggctggtcttgaactgctgacttcgagtgatccaccggccttggcctcacaaagtgctgggattacaggtgtgagacattgtgcccagcttggagcatcttaatttaagccctctacatccctgcacggtagatacaaccagctccgtttccaaggacgaggagcaacagagtgaggtcatttccctgagttacactgaagatggtctaatttcaaagtccttcctgtgtccactttgccaggtgccccccgaaaagcaagaagactccttcaagcatcctgaagatttggatgctacaactgtatgtcctgctggagagaccctcccagaacattgaaggctccagtgttttgactggcagaatctcagtttcaacatctgtctctaagggctctggacctatgctgggtgaaacgtgttgtctgtaggatttggcccatctgagcctcactggggatgggctaaactccgtggggtttgtattccttctccttcattgctcagaggaaaagaagaaaaaaaataaaaagaaacgaccccaaacagcctctttcgtgcacacacgcctaagaaataggaacatgaatttgcattccttccaactggtgtgtttccaaaatacagacaggcaagtttgaatcactttgactttgaaagcgtgattttgagcaattatctggggaaaaaaatacctcctcttcactaaataagtctgtcaaaaagagtcatagtacagcgtgccattgccagaatacacgtgtgtgctggtaagctggccccaaccaattaaatagtgaaatgtcgactgcattcaggcccttcctggtctgcagacagacttgtgttagttcattttcatagtggtgtgtatgtatctttagactttaactgacagattcccacagtgagtagagtagggagttatcaattacatggttagctaggcgctgctattgtatgctctatggcttcttgacaggagcaggcagagaaggagggaaggactaatatttctggtgcaggaggactgttaatattttagaccgggctcctcaaacatgtatgcttatttagtgaggagaaaatgtgcatttgaatcctgcaaaccctcgagaagtttgcattaataaatagtgattaccagaatattctcttctaaaatatattttatttatcaaatgaatacccttctgagcccctctttatccttcctgtgatggctaaactaatttcatcaaattttgatttctgtgtggtgatgttgtgaacagtgcctgaaataataaaattaccctgagcagattgcatataaaactgtttgcaatgggagaagcagtctttggggctgtggtttcctttggctgcagtgtaatatattcctttgtttcttttgtgaagtatttattgtgggtctcctgtagtctgagtttcttgtggaagtgggcttgtgttttgcttttgtagactgacactgagaatagcatccaaacatctttttcccaccaaggcatcaaactccatcattaggaattccttcatagaatcaaagaatcagaaagagctgaaacatagaccacggacactcaaattgtttatcctgaaatgaatgggaaaacctaagctgaagaaaggaagtgtctggccaagaagctggcgggagagtagaatcaggaaccagggcctcctcgtatctggtctcacgcttcttccgtggtgttctttcttaagttgagcattgcattctccttggataggatggatattttcctgggaaggatgatacatgatgtatttatccataaaactgaacaggtgttatgtgtgccttttctaataggaaagaccatcatgctatgaaaagagaggaaggggagaagaaatggggtacgttaagatctcagaatgagttgtggggctaaatgttcagcctgtctcccttttctccttgccacaccactagattatattttctagactctcctggtgttagatttggccttgtgacttccagccaatggaatcggctgcaggatgaaactagtcttgatccctgaatgactgcgtggagcacatctccttctggtcaataaggcatttcaggagtgagagataaacttctattgtgttaaacccctgtgactttgagacatatctcctacagcaggtggagttagcttaactaatgcagaacgataggactggtgaagcagtccatctgttatgagagctattctttttttttttttttttttttttgtgagatggagtcttgctctgttacccaggctggagtgcagtggtgcagtctcagctgactgcaagctccgcatcccaggttcacgctattctcctgcctcagcctcccgagtagctgggactacaggcgcctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtctggtataaccatgtggcacatacccctgtacatgtttgccaagactgctatatggtagagcttggaattcttaggagctttatcaggtaattgcaagtcccccacctccaagaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaatgtttctgtctcaactggttgattggaacaacatacaaactgacccttaggaaccttctaccaaaaatatcctgtgaatcttcatacttttgtaatagcgtttagttagaagtggtcagactttcttcgtcctcttttcgtgatttcctctgtggtgtctgtggatcgataccggcagctcaggtaaggaacgtgtgcaggggatgtaacagaaaggagaaagacgaggaagaagggtgcatggagcgtgcaggggaagaactgattcttttttcagttaatcggctcatcaaggttctggtgttgaagtctgatttcatttgccatgttaagaggatatggacagatactgggcaaaaggaaaaaaaaaatattggatccttgcccagctccaagtgttgctgagtcccttgccccctccaccccgctctgtcaggagccaagctctggccgcccagtttttggactttgtaactgtttccgaacggatcagattccatctgaattgcagatggctttagccccagcagcagaggctgccatgacatcggcatgcgatttcttccaggacttaactctggagagagctccatttcctgttgatcatgagggttttacaggcacaaacgctgtcttctgtcactctgtcacagtgcattatgtcagaatagaggaagcagttcagcccgtaaatctgtgccaccggcacgcagggtgttgtgttgtctccaatgtgccttgtcaacaccacagggctaatagcagtgtcagggtccccgtgccatgaatcacttcacatctctggctagtacagatctctccctgtcactagtggaagtcgcctgcactacattcagaataggggccaggcgtggtggctcacgctgtaatcccagaacgttgggaggccaaggtgggaggatcacttgaagtcaggagtttcagaccagcctgacaaacatggtgaaacccagtctctactaaaaatacaaaaattagctgtgcatagtggtgcatgcctgtagtcccagctactcaggaggctgaggcaggagaattgcttgaatccaagagatggaggttgcagtgagccaaggtcgtgccactgcactccagcctgggcaaaagagtgagactccatctgaaaaagaaaaaaaaataggcacagacaatttacctggatcctcacattgcaatgctgaccactccggaaggagtgtagaagttgcagctcatgcctgcattccaaatggctgccttctgcagtcccgtcagccaggatccctctcatacaaacaccttgactggccgagaaatgcagatgctgtgtcaaaagttcatggctcagagccaacaatgcactgtgctgacctccaattttccttgaggaggggcatcccagggtcagaattttatgcaatgcaagcttgtccacgatggcatgggagcgtgtgggaatgtcaagatgaaccggggctccgggagacatttatggagtcaggagcacacatacattcctggttctgtcagcatttccctaggcgagatgagtcacacatttatatttttacatatgcagcgcgcttgcaattttccactggggaagatagaaaaacttattgaaaatagttaatcagttttacaaagatgccataggtagaggtgcttccagacctatagttttgaaagtcacctagaggataccagtctgactcagagctttatgaaggcatattcctaatatcctccctgtgctccacgaagaacaattggtttggacatgaactggtttccatttttagactccaggcccacagtattctaagtaggttggggctgtgctgattgtaccactctttggattttagtggattttctttttaggatttcatgtaagtaacctgtgcagagagtgaggataaataagaacaagaatgacaaaccgataggctacttgacatcattccttaattccaggtcactggcggacatcactcattcatcagtactctgtttttctcccaagaatggatctgactcttgaattctctttaatagagtgttctgggaggctgttaccaattgaccagggttgatgcacatgttgaaacatctttgccatttcttgatagcttcagaagagattttaaagtactattattttgatgttgttagctttcaaagattaattccacagagatttttgggcatctttttgataatacacattatgcttgacttgggagtttcaggatgcgcaagagactccttttgactgcaaggactcagtaaaacaaagtatttcaaggtcatgctacaaaaagtcccaccaagagcatggtcaggaggtacagtgcacttacccacacggatcagagagggatcagaggaggctggctggggaaatgatcctagggctttcttaaaggacacagcgccatggttatttaagtacagcttttaaggagaactaacttgccactttgatagcagtataggactccaatatttctcatttgtaattttcagaagcacacgggaggtctttgaaatttaatgtctccctgcatcacaaaccaaaagacgagtcagtttataagtaggctgtgcttattaactcagtcctggctttattgattgctttaggttccatgatctttggcatgtgagtggttttgctttgttttgacaatgatctttttgtaccttgtatcgggtaggttggaatgtgtttgaaaatttaagaatattttcctagcaaaggcaggatttttcaagtttgttcatgctggagctcctgccacgtattttgtccttttttcttttttctagcaactctcgagaggatgagacaaatggattgtgaaactggaaggagggtttctcattttttaatccattgttttagtgagagtttaaagctttcctataaaatatgtgggttgagaaaaattggaaaagacctcttcaaggactttcctctatgctccctcatgtttcaagtggcttttttgcatgatggtgcatatgtctttgtttctgtacagggccctccatgttcagaggcagagtaacgtgaattcatttcgcgctaatgagagttgcgatatgtcggcccaaactctctgtgtccttttcttcttgggctgatgaacttgtcaacttttaaaaaatgtgctctccaaaaatttccagcaggactttcccaccttgctgtttaaacagtgaatcagccctgtgggctttgctgcttacaacatgattccggtgaaaccacaggtctcgtcatgtcccttctgtatccatggtagtcccagtgggaaagaggtaacaaacccaaattgagtaatttcaagaaattttaataacaaaggggctattttataaagggggggtggtcaaggtgtagggaaacataaaagagagcgaatttctggtctggtgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctactcgggaggctgaggctggagaatcacttgaacccgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaatactccctctccccaggagaggtcccagcggaataaacatccccgccccttcaactctttgccattgttcaagccctgctagaaaccagatggcaaaaggaagttactgatgtgttcatattggtcaactttttcaggcacgaagaccagtacagaaggatggaaagtgcatttgggtagggaaatgggagattcctgcatagctgtcaagttagtttcttcccagagagaaagaccggtggctgtagtctgtgccccactcccagcctgtcctttctcagccgtggcttgtgtgcatccctggggccggcatgttgctgcgagccccaatcgatcagtggagaaacgagctctggtgggcagtcaggcaaagcagatacacgtgcttcttttcagctttgttggaaggtttcattttgcttcaggaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagatgctgaacccttattgtatctccccagggttagtgagtaattgggaatagtgttccatcttggatgcccccatccactaaccagctttcctcttcgggtggttctaagaattctaattcaattagaaggccttctttttagtttgattagttcaatatcaagagctaaatacattagcttatatatatgtctgatgaactcatctttgcttccttggatccccaagatagaatggccctaatgcagtcaaaccaccctgcagaatcttaacagcaccacaaatattgcatccaggcatcctgcccatgctggcttgcaggctggggatccctgtccatagcgcccatggctccaccaccagtcaaaggtagtggggccagcagtggactcctgtgtggttcagctctcaaaaatgtgaactgaaagacacagaaaaagacttgtgtttggggataaatactgagactgagcagtcttgtggattcaggaattgggcatccagttgggaccctttgcaagaagggtgttagggagcagagagcatgagtaagccggaagcagagcaggagagagaatggagcaggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccggggcgagcaaattgcttgaactcaggagttcgaggctagcctgggcaacacggcaaagccctcatctctacaaaaaatacaaaaattagctgggcttggtgacagacgcttgtagtctcagctactcgggaggctgaagtgggaggatctttagagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctagggaatggctgtctagcttcagtggatttccagggtccggagctactaaaggtcaacagctgtgttattgcaaactctgtggcctgcattctatcaatgccaaaatgcacatcacactgacaacagctctttgtttacaccggggagcccccaaagccccagggtaattccatcaccacccaagttgtaagatggtagagcgaacaggccagaatgtgataaagtaaaatgaaagaagaaaaaggaggaaggaaaaagagagagggagaagcacatagaggaaagaaggaagaaggaaggaggaaggagggagggagggagacagggaaggaaggaagtctggcaagagggcacagtcagacctgccaggatccctctgctgtcttaatcaagctttgcctcagtctttctggactgaatttgtctctgtgttcacttggcattttttaaaaggagacaaaacaggtgatgaacacagcatgagtgatttttcccttaagagagaggtgtcatgctgagaaagaagaaccgacctccaggggagcttgtcttcagaccaaaaccctggcaaggacagcctgtttggatcttggtcattttgttagatttataaagtgcctttgaacagagcaggacactctggggacaagtcaaagcatggcagccttcagcttcccaaagaagagttgtggagaaggaaaagtgaaggaaagtaccttactaagtcattgatggcacattcagcccttgtcaaagtcaaagaagaaatttggagaaattctcaccactgtgcttaggagtcaccctgaactatttcttggatgaaattaccaccctcccacttttggcaatgagacagcaagcttggaatttggagtccatgttaaatccaggtcccagccaggcacagtggctcacgcctgtaatcccagcattttgggaggctgagatgggaggatcacttgagcccaggagtttgaggccagcctggtcaacacaaggagacttcatctctataaataataaaaaaattaaaaattagctgggtgtggtggtgcacacctgtagtcccagctactcaggaggctgagatgggaagatggcttgagcctgggaatttgaggctatagtgagccatgattgcaccactgcactccagactgggagacacagcaagaccttgtctcaaaaaaaaaaaaaaagccagattctccacctaccagtggtggggccccttgggtaacttgttttcactccctcagaacctcagtttcctttcctatacaacgcaagccataaggttaacccctcctcgtggtgatgttaagatgaaacaggaaggtgaggggcttaacacatttccgtgttcccataagctttcaggagatcttggtagttttcatctcggtcttcattaccatcatcactgcttcagactcctgtccatgtggggccctgtggtcttgcgatcacctccataaatgttcctttgttcccgcctaacacaataccagccacaaaataattctcaacacatattcattagtggatgcaggggcgaaatgaaactcagggggttgggaaactcacctgaaggatcttctccctctccccactttcaggctctcctttcacacgcatgcattaattcgttcattcttggaatctacccacctgtgatgtgctagttactaaagatgcagcaatgaatgaaaggtaatcctgtccttgaggcattcacaggtaaagaagcctgcttgggacattgggccgtgagctccaacaatgtcactattcttctaggctttgtggacctttggtcaccccttctgtaagaccaactcccttatctgcctgtacagtgttctgcgaatcccggtctctactaaaaatacgaaaaaaattagccaggtgtggtggtgggtgcctgcaatcccagctactctggaggctgaggcaggggaattgcttgaacccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatggatgtgagcgtctgcgtaggtttttatttttctctctcagaatgaaaggtttgattcgtaccagctccccatcccttcccacgatcccatcttaatgtctgttgtggaagttggcccacagaagcctcaaggctaaccaacaagaaagatcacttcatatgcattagctggaaggtaacaagaggaaatcgcctgccagggtccctgactcccggaggaaagtgtcctctgagccctccttgagggacataaatagccccaaaagtcactgaatgctaagttggctttctccccaaaccttctaagtaggcaatcaggatttaacgacccgcaaatttccaattttttagtttatgaaaaaatatatctacatataatttttgcctccattagagtctcatctttaaaaaaaaaaattattcagtgacttcctccctctctttccaatgaggaaaactggactatttatgctgcattttaggctttttttcatatataatttttcatataaatgcacattttccccttctttcggggaggaaatttaacttttgtggaaatgtgatgtgtgtttaaattaccaatttcataggcaatatgtctgataattgcagagagatactgagttaacttgtagcaatgagtttctgtgacaaagggaaatcagtttgtttgcagtaagccgaggataacggcgccgaaactttactatttgggggtggggggaggttggggaagggaggccctgaaattgctttttataattaaaaagggaatctcagatgttttatatcttgaatatttacaataaaacctttaagtgcttgtcaagagggtaatgtgtcattaactggggactctgcctcgcctctcctctcggacatgacagtgcggctggataagagaagagtaattatagttcagcagggctgccaggtgtgataaatgactaatcagcacgcaggagcctcagtcctcaaaggaggactattacagtgttatcagctgcgggcctgggtgtacggagccccgaacagggatggggacaggaccttgcgctgtgcggcttggcatgctgctccagagtgagcccatggctgtctcttagttttgtcaccggcggctttatgtggctgccacggggggacaggaaacacacaggggctccagcaatctgcctggtgctaatatttatataacacactcgccagactccatggcctgagtccgggggtggcttttcggggtgcagcttggatggcatcagaacctgcaagaagccaagacgcctgttctccacggcggagcccgctggtcggtcactcctgttcctttcgtgtccgttgggtgcaggcattatttccagtgtatgtgaccgcttcccccgtgggaacagtgtggcattgttccctgggcaagccaacagctcagccctgtcctagagaaccctggagctacgacgagggtaccctggacccctgtcctaaatgttctttgactctgcttagccactgaggatgtttgcatttgattcatttgcttattatgatcaagaaacgttacctgtcaacattggataaaccatccgagggaaattaatcaaaacccccttcagacaaactgcatcacatcgattctctccttataggccttcttgttttgtgttctctgtgtgtgttttttttcccctagcgtgctgaagggtggcattggagtaccatttaaagaataatttttaagaaatgaacatcaggacatagacgtctgaatatgaggaagtgcctcatgtgaaaaaggacgtaatgtgctttaaagaaagaagaaggagataggacgacacttttgatacaaaggttatttttataatacttgcatttttatcggttcacgtattttaacagggagccctgactgaagtcacaaaaattatgactccggcaccgaggtacttatctgacaaatgcaatgcgaatggtcttgttcttatcaatgagatcagatttcagaaatgaatgcgaagaccgaggcgttgctttgtgcacagataaccttgcaggcgcaaactcccaaaccagaataaaagaattctctatgaaataatgggccaggaagcccaatcgcgtcacactgtaatagacagtggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttcttttttttttttttttttttgtttttcctcccagcctctctcctttcccattatgcacaatgcgctgagaaaggattcccagtccccctggtaaaaagtctgaaggatgccgaggagttcactgtgcccttagataataacagtttgtcttggctctgatcacccctttttgtgacttagctggctgggaagtagcaaaagtatcttccaagctcagcttctctctgcttgcattctttccaaatacgtgattccaaagcccatgcccaatccttgcactgaagcttttagcaggaaaggtgaacagaggcatctggatgcatcgcggccagtctgccccttgcccaattccctcccctctcctgcgtacaggtcatccctgagaagtgtgcctgtggactgcgttctttggggtaggacatggaatgggaagatgaaaagaaagccttcctttttctgtcctcagccgtaagaaagaatggtttcttcacagtgccgattggtaaaaccaagttctttgtaaattatggaacccaagctggaacttggagagcattcttctaactgaagataaatatggttgccactgtctttataaaaaaaaaagaaaaagaaaaagaaagagagaaagagaaaaaactgcaaaaccgcaaactggcttgttcttatgtggttgatggggacagcaagattacatatatagccagcatttgattctcaggactggtaaagtgtgaagaacagcagtgacattctagtcttcaataaatcactataaaaatgtttatgaaccctgcaatttactgtcttttatatgcaaattgaaaggggcatcattgcaagtgtaaaggagacccgaggtggcctgaaggaagtgtaaaatgttgcagtaggttttggagattgtgtgatcttaaatgggatcatttccaaacgattttgcgtttatacctctgtgacagttcgattaatttattaatgagattgctgtaagttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagaccccttttcagctgggtgctccctggaagatggatcttgccttgtggatgtttttctaccgtgacagaagatagaaaggatgaaatagaaagagtgtgagtgaattctgcacccaccccccccccccagcttccccacctgtaaaatgatttgctcaaagtttgcaaagaatggaggcatattcaaagtgctcagcactgggccggacccatgggtatgaattcataatgatcagcttcattctctccctttccctctctctccacacctttccattcctcctaactaatgtgggagagaagagaaaattacagtgagagatggtggtcagtttacaacagtatttagatgagaattaagattatgtccattcagggagactctagtgtgctctacatccccccaaaatgtggggacaatatggcaaatatggccaggtacagtgacagaaagtaaacagcccatgaaaacaggttgctctgcaattctcccaactgttcccttcccgcttcccacctgcctcgtatggaaaacacccaaagtaggcactgtttatagagccatcgcttgcagaacatctccccggcctccgacatatgtgccataaatgctgcagagctgcgtccacagtccctgctccggagaagagcattttgcttgttttcaaacacaagcatcctctcccgcgcctgggagggcgaggtgcggatcttttcgccttggcagtccctcgctcaaatgtgcgtctctggcaagtcctgtctgctgatagttgatagtgctgccacagagcggctgtcagattccaaaggcatcataccatctgcttttccaatcttctgctcttcaatgtagacatatgttcgagtggttcgtgtgtgtgcgtggtgaggggggtgctattttccgggggaagaggaggaggagaggatgcttaactccaagagtcctcaaagcaaactgaaataaaattttaagtgatgccaaaataagcagtcccagcaagacatgttataatataaggtcctttccttaaaaccatacctatatcagctttggaaataacgtacctcttaactgcatggaaaatctagaagattcgtggcttgggtctgtttctattcttaccacggtgacacgcaaaagaattttttaaaaaataggtttgttgttatttctgtatatctgtatgggcctgacctcccttttctctgggctttctactccagatttttattttatttttacactttcattgccctttgctctttctggctttcacctaaacaatagcatgtatatacaacagtacctataaaattgacgctcgtgtcactgatcatgccaagaaacctaatgtatggtgaatttgcactagtatttatttcctccctccctgtctctcccctctcctcccctcccttcctttccctcctacccctctttctttgtattattcccctagaaggaaatattcaagctggctttagagaggatagcaattgtaaggtcaaccaagtatgggatggggaccggaatagattttctctgcagatttcacgctgccttcccgggaatttctgaatgttttgcagcctaatgtttagcttccaacattctttcttttttttttagacagagtttcacccttattgcctaggctggagtacaatggcgcgatctcagctcacagcaatctctgcctcctgggttcaagcgattctcctgcctcagcctcccgagtagctgggattacaggcatgcgccaccatacctagctaattttgtgtttttagtaaagacagggtttctccctgttgttcagggtggtcttgaactcctgacctcaggtgatcccgcccgcctcggcctcccaaagtgctgggattacaggcatgagccatcgcgcccggcctagcctccaacattctttaagaaaactgcaccatgagtaaaatggggacgtttttctcttctgctgggacccaggacatgttggactgcacatcagttcattctctctgatctaaggtgttggctgctcttctcccttctccactgggctctgagcttcttgagtgaagggtctgtgggttttcacgctttgtactcgggcccagagcagagcctactgccttcacagaagatgctccacatgtgtttgtagaaggaacttggaagacagtcagttttaaagattttttcactgagggactaagagaaatagaaacagaggggattggccacacctgaagtcattctgtgttcaaatcttggctctaccacctatgatctgggagctgttagaggagttaatcgatgtagttaagactcaatttcttagtatatacaataggtgtaatagtaaaaattagatgactttgatgtgtgtaggtaagcggctagcacagtgctcagcatgcatgaaggactctttcattatcgttattaactgatgtttttaacttatacattgaaatgtggaaacaagccttgcttctattgaatgacttcttgaaagtgccagtctgatccttgaccttcaggtgcatctctaaattctttcatgtcagggtctctgaaatctgaacacatctcaaagttcccttatgcctggcaggggcggtgtccgactttgttattgcctatgcatgtataaatgtcccaaatgccagcaaccaaacttgcaggatgggtgttgacagattccaggaaagtcccagatgtaacagcggaatattccaccttctaggaaccaaatggctgtgaagtggagagacaggcagagctagaaatattccggacgtggaaatcaaaagtaggtttgcgcaacacaactgcagagccagctcaagaacccagcgccagtggctgatgcttcttctttttttttttttttaatggattcttctaaggatggctgcatcagccaggggcagcgggtcatacctgtaatcccagcactttgggaggccaatgcaggcggatcatctgaggtcgggagttcgagaccagcctgaccaacatggagaaaccccgtctctactaaaaatacaaaattagccaggcgtagtggcacatgcctgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgctcttgatggtacagaaaatgatctgcatggaggaaatctagacatcagcgattcagagtcaaaatgttattcaggggagagagacccttcatgtgaagaaattttaggaatactttaattattttttcacttacattttatagtatttattgtatgcaccagagtgattggtgataaaaatggaggcctacttaagtctaagagagttcttgtgaaagtgggagggggatgagggttggaaaattgcctgttaggtgccatgttcactattcagatgatggatacactaaaagtgcagacttcaccactacgccatatatgcgtgtaagaaattggcacttgtacccttgaaatacataaaactttataaaaaattaaaaagagttactgtaatgattataaaatgaaaattctacgtcatgagaaagcattgtgccatattttcaccgggagcatttttttttccttaggggaaatgaaaaataatggcatctatgatcttagatttagtaaaacgcagtatcttcttccccagctgaaatagcgaaagggtctcttcaggctcctgggataaaaaccaggatccttcatgtgtctgagcaggcttcccaccatttgactgctgctcctttgtccagacacatttaacaccatctccctgcaccccttcactgggctccgaagctgcgttcacacggcacgtcattggcagctcatctcagaaggttccagctttgcctggcaaattctcctccttcctttagatcccatctctggtagacagagtaatgagccccgaagatgtccaggccctactcctaattccatggaacctataaatatgggaggttacatggcagatggggaattaaggttgcagatggagttaaggttgctattcactcatcttcagattgaaagatcatcctggattatctgggtaggcccagtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctctcccagaacttccagaaaggcacgaagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcaggaatagtgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacacatatcccacatccaggtgccagtcagggagctgcgatttaatttgctgctgaatgcacttttgaataaagggcctagaagatgcagtctcgaggaaccgaggccggttagagacaggctggcagctttgcctcctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagagaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagacttcaaattgagccagacctcaggcatgaagggaggggagagagggggaaatgtggaggaagggggcgtttgtgcagtgggaagttggagaaagtacaaatgaaagcctctctgcagtgaacctcatgactgctttagagaggtgcttatgtaataactgcagtggtgtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgtaagtgtatcgacgtgctgtactcctaacacattatttgttatctgaaatttagatttccttgggtgtcctgcctttttttttttttttttttttttttgagatggagtttcactcttcttgcccaggctggagtgcaatggcgtgatctcagctcactgcagcctccaccttccaagttcaagtgattctcctgcctcagcctcctgagtagctgggataacaggtgcacaccaccatgcccggctagtttttgtatttttagtagagacagggttttgacatgttgccaggctgctctcgaactcctgacctcaggtgattcacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactccctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcacagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtataccgggaacagaacatatatggtttcatttcatcctcccattatcaccgtgaggcctcttccgcttatctattgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagggtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagtcaccactgtatagtcctgagctcactgggattaaggggaagggacacagactccacctctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacctggccaacacaccatgccttcccagtctctggtgttactgtctgcatactgtagaccatcatcttgtttgcatacttgtctgttatctctttatcatccgtctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccagtacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaaccagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccatatacctcaagtaataaaaaggcacagcaggcacttgggttttccctcagcttgctggggccgtgcacctatgtgagattttattatttgtaattttgggggggttaatttcacagcttaattctggcctttatgcatttagagctcccctcttgtgtttcagaaaggaggagttgttgttttcttttcacttgagtttaataaatgaaaaaggggaagggagagggaaggaagaggaaaaagcacaaatgtgcttgtttttggatcagcccctgtactgggcacatggatgcagtcagtcctcagtgtaccccaggaaagaggaaactgagtctccatgtggctttctgtctggcctttctcttttgcttgccttgtgctttgaatgcaggcctgctgtttgcctgtggacctcaggatttgtaaggccatctccacccacctacagctaagtttcccaagagccgatctccagccgaagtccaaggttccttgatgacccctgggaggagatgcaacacacagtttcctagaatcatttactccccaggctaagcacagtcacagaaatgaggtagctgtagccaaggatgatggcatagcacattcgtttcttaggcgtgccacgtactaggtggcttcagtcagcagaactgtattttcccacagttttggaggctcaaatttgcaagtcgaggtttcggcaaggccatcctctctctgaaaactctatgggggcgtcctctttgcctcttcccggcctgtaggtatttcctggcaacctttggtgtttggggcatgttgtcacctcattgccatctctgcctctgtcttctcaccaccatcttccttgtccatgtctctctatgtcttcaatgttcttcttataaggacaccagtccttggatttagagtccaccctaattcactgtaatcacatcttacctaagtccatctgcaaagaccctatttccaaataaggtcacattctgaggccctgggtggacatgcattttagggaccctttcaggccaccatatatggattccagagtgaccagtagaacatagctcaggccaagagagaaactcaaccttggtgaagttgcatgagaacagaaggcagccctggtccctgggagaaacccatccatactctggttacccactggccattcctggggacaggcggcaggtgtttagtcccctctctgcaaccatttgcggtcacctcttatgtgctaggcctggtgctcagcgctgagtgaacccatatcaacaaggcatggtcactgcgctagggaagtccctggtccagtggggtgagggtggcagtggctggcaacaaagacaatgagcgctgagattgaactacagaaagcagaagatggggtgacaagtttggcctgcggcaggaaagacttcccagtctttaaggataagtggcatttgatgagttgcacaaagaggagacctgtcctgggaatggaggagaagatgtgaagcgcgggaagtccagggacacacagccgtgcagagacccgggggcctcagcaggttagagtgtctgcatggcaccggcagaggatgaagacagggctggggaggggcatggggttagcctaacaagggcatcaggtgccaggttagagtttcggtttctaagctgtagataacaaaaatttcttgaatgcttttagcccctgatctgagttacgctttttttttttccttccattttccatccaacagacatttgtgaggcactgtatttgttttcaattgctgctgtaaccaatgattacaaatgtaccgtcttaaaaacctaaatgtattatctgacagtcccataaggcaggagtccaacacaggtctcactcggctaagatccaggtgtaggtggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccactttaaggacctttgtgatagttttgcacccactggatgacccagaatcatcttcctcttttaagatcagctgattagcaacgtcagttccacccacaatcttcatttccctttgttgcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagggacttacataaatagagtaatcaggggagggcccctgagaaactctaaaacatgaggaaagggctcatgatgtgaagaactggaaaggtgttccaggcaaaaggaatggcaaacacagtggccctgagacactcagagaaatcactcaggctgccttcgaaaggatgtattggagaagatgaggccaggggattgttagtaactgttgcaaggatccgggagaaagatgatgaaggccttgtagggcaagctggataagagcacccaaaatatccataaccgaatccccactacataggcatgctactttatatggcaaaagggaatttgcagaagctaagcactttaaaattattatctccttaaacctcactgcagagttataaggaaagcactgttatcagatgaagaagtagatttcatcaagtgactcacccggtatcatatagctgcttagcggcaaaaccaggatgtgaatggagagctctttctcggataccaaagctatttaatatttatcattgactaataatggtagagaaagtaatcatcataacctctgccctttattagtcactcatggtgtcacaagccctttacaaagcactttgcatgcaaatgattcctcataacaaccttgggaggtagttactttcattgtattagctatctcttgctgtgtaagaaattaccacaaatttagtatatttgttatctcatagctccataggttaaaagtcctggttcaggctgggacttctgctcagggtctcatgaggctgaaatcaaagcgtcagccagggatggggtcttatcagaggcccttggttactaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagcgagggcccagccccttttaagggcctagcgattagatcagtcccacttaggattgaatcccttttgattaatgcaaaaccaactgcgttcaggcctccatgacatctgcgaaattcctccccctttgcttggtagcctaactcactcaggggggcaaattatcccatcatattcacagttgccgcccacactcaagagaggggattctataggaaatggaagtcttgggggccatcttgaatcctgactaccatagtctgtgaaatccccatttcacagatgttgaaactgagacttagaagcattatgcaccatgccaaaggccatggaaggacagagcttgggcatgctcccgacaccaggtcatactgatgtcactctccctactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcaattatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctgtggctctttttcacaaatgcttatggagctctaactgggggcaaggaactgtgctacggttgggaagagaggagtgggcaaaaggagacactggggcttctgtgactttagaggcccatcatcaaattttcttttttttttttagatggactttcgctgtgtcacctaggctggagtgtagtggtgcgatctcggctcacagtaacctctgcctcctgggttcaagcgattctcctgcctcagcccataggcacatgccaccacacctgactaatgtttgtatttttggtaaagacaaggtttccccatgttggccagccttgtcttgaactcctgacctcaggtgatccacccacctcagcttcccaaagtgctgggattacaggtgtgagccaccgctcctggcacccatcaaattttcaaaggaagaaatggaatggtgcaaccatggtacatgggaaggaggagggggacacacaagactgtacctatcatgggggcttcgacctcatctgggaaggtggttggagagagtgagtcctgacctgagctttggaacttatcaagttgagagagaaatttgataatttgtctattaacgtgtgaccttgggcaagtcattgaccttctctgaacctcagtatcctaggacttcagaagcgaaaggaagaataatgggtcttgagtatgcctagaattgagcaagctgctatgcttgcaaaggccttggccagctgctcacccaccatgtccctctgttcccactccaccttactcatgcctagacttcttgctttttaaaaataatccacccatgaaacaagtgtttatttacaaggctggcttccccaggaggctttcacaaatgcttaccgagcatctgctgtgtgccagacaagagtgaggagctggggactcagagaggagcagacgagggagacactcacattagagagtggcgtgtgctgagggaaggtgcctcaggcgacagatgggaccagggcctttaactcagtggcagcttcagagacagatctggaaccccaggactcaaaggacctatgtttgctaatcaagtgaacacggaggacctgccactgggcagggcatccctgaccaatccacaggtgatggcgggacagctccaggccctggggatcccccagggaataagccagattaaagcccctgccctgtgaggtgtggcaaagaaacagacaattcatgaaataaatatatgataaataacatatgagaaggcagggagtggtatgaaacaaatcagggaaggaggagacggagaagttggagaagacagtggattgtttctctgggtggtcaaggaaggcttccaggcagaggaggtttggccatgggtaccaaggggtagagatgggaaccttccaggtacatggacccgatgctgccagcagaggggaaaccatggccctaagggcagagcacactggggcgggggtgggggttcagtgacagtctggtggcctgtgtggtgaggagtgcgggagatgggaacagagagcgagagggcagacggggtcatgttgtgtgggacctcggaggtcctgccatggctttggtttctacttggagagaaatagggaggtttgggcaggctctgagtagaggagtagcacgatctggcttacgatgatttctaacatctcaccatctttacttctgtatataaatatatgataagtatacctttatatatgtgacatgtatctttatatatgatatgtatggttacatatctactcactcacacatccacacacacacacacacacacacacacacacacacaccttttttggaaccattgaaaagttgcagacatcatcacggctcaccctgaaattccttagcaggcatcttctgagaataaggacattcttctatgcaaccatttcacatccacactaagaaaattaacactattacgtagtattatctaatatgccctctacattcaaattttcatgtctccaatcctgccccctttggaacttctgttggtgttcgatctggaatctgagaattcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtgatgtgccaccatagccagctattttttttgcattttttagagatgagtttttgccgtgttgccgaggctggtctcaaactcctgggctcaagctattcacctgctttggcctcccaaagtgctgggattacaggcatgagccaccatgcccggcccccttttttaaaaaacaaaaaaacaaaaaactcttttgtgttttagaaatggggtctcactatgttcttcaggctagtcttgaactcatggcctccagtgatcctcccgcctcagcctcctgagtcactggaatttcaggcatgagccactgtgcctggcctctgtcaacttccttatctagaactatctttttcctctattgttttgtccctcacttctgaatagttcagggatccctctggctactgtgttgagaataaagtgtcaaagccaacagtggaagcgtggacactgggtaggaggcttttgcagtgctctcggcccgcgctgtccaatagaactttctgcagtgatggatgtcttctatctctgccctgtccagtataaaagccacaagccacatctggctgtgtggcacttggcatgcaactagtatgacatcttaatttttctttttgagatggagcctcgctctgtcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcaatttgaagatccacatatggctgagggctactctaatgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcctggctgaagaaaggcatcacaaagaaaatgccaccagcaggctgggtgtggtggctcatgcctgtattcccagccctttgggaggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcctcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctggtaactcttttatcttccctggagttatttttttcccttctttctttctctttttctgtgtgctcttctaagagtaaaacgcatgtccccccatgaagtcactcaaagctcaggcgtgtgcaacagggacagcaaaagcacacacaatgatggccagagacactgctcagtgtactgtcttccaccgggacagcccactcaccaagggttaggtcctgtgctgactgggtcccgggtctcctcggaggtcggtttgcatcacgtggatacactaatctacccaagttgacttggagaaccaatctgaaatcagatgggagctcccggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggattttttgctctcctccttttgtcagttggcatgcgatatgcttctcaggcagtaatttagagactgtcaattcctgagagccgctggggaactgagcaatcgtctgcatttcgtcgctttagcccgagctgggtctttgagctggcagagaccaagatctttttctgggaagggatggtcctatttaaggaaggccctggattttgtcaagtttgaaaggttttcaacatcttcccgagatggtggtcatgggagtagtggttagggtggttatgacgcatgggacgggagaataccatgcccacccggtgatttataccaaaagatgctttcctggggtggttctgctggcagtcgggcagtgacatgttattaatgttttcctgttttctattgtccccgaatggaaaaacactgtggaacctttaaattttctcaagctgtctatgttttcctggatcgtccctcaattttccgtggtatgaaaaatgtaaatgttgctacattcagttcagggaaatccagccgttgctccagatccttctaagatttttcaattccagagatgttttcacctggaagattccccagatttggcaaaaacaacccaactcctagccactgctttttgagcagctactcagtgcctaagactttgaatagtttattaatcatgtgtcactgcagcaaaggggacatttcggccctgatttcagagatgaaagaaccaaggcatagaaattgagtcactttctggagtgtacacaactagtaagtggattcgagttagttttgctctattccaaggctacttactatgctatttttggtttcctacttttgttcaacttatatttatctgattatctgattctcttttacaagcacttagtgagcatcagctgtttcaatgagcatttatttactgatacctgtggtggcacccaggaaggactaggaatgctctgtgatatgtaggagaaggatgtatccactgggcaaaggtacctgcgagggatcaaagatggaaaggcagaaatccaaggactacgtgtgacatgaaaggggcctttctcctgctgtcatcctgaacctctgtctttcaaatttggatgtgtcgggggccacaggacactactgtgcatttgcctgtgatttgccattgggttggagtacttctcctgagtttctgcagtgttctaggtatggtcttaggccctggaataagacagtgtaggaaacacagaaggtgcctgatttcctgggcctagctaaggggaaaaagcgagacaatggggtcagaggaagctcagctgaacagatgaagttgagatgaacagaattccagtgccaccatgatttccagccgtgtgaccttccacatgctttttgatttttcttgaactcacttttcctttgtttgcaaaatagtaacaatattttccttccaagtgatggtgaggatttaagagttaacctgagtgtctgctgcatagtaggtgctcaataaactataacgtctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttatttttattttaattaaataatttatttttctgagacagactgtcgctctgtcgccaaggtggagtgcagcggtgtgatcttggctcactgcaacccccgcctcccgggttcatgtgattgtcctgcctcagactcccgagtagctggtactaaggcatgtgccaccactcacagctaattttagtatttttagtagagacaggatttcgccatgttggccaggatgatcttgatttcttgacctcgtgatctgcccgcctcagcctcccagagcgctgggattacagacgtaagtcaccacgcctggcctgatcctgacttagttacggttacctctctttgtatctctatatgttctcaaattccaacctgtctttgtaatcctctatttaagctatcgattacctccaaaaggccctgaatgtttcagaaagaaaggatctactggcagcttctgaaggcttctgtaataccttgtaccccaatgagtacaatgaaatcattaggggttctttcctctcctttggaatgaaactgctgcttaacttttctcccactgatgagatgcggtgatgctgtcacagttgggtggttgctcctcctgcagtcttcttcccattgcatgttcactctcttccccacttgcccacgagcagcaactcctgtttcttgtttttttccttttctttttcttttcttttgagacagagtctcgctccgtcgcctgggctggagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctggggtcgaactcctgacctcaggtgatccgaccacctcgacctcgagaagtgctggcattatggatgtgagccactgcccctgccctagatggtatcaccttcaaagcttaattaggaagaataatatgagcactgagtgtaactccaggtcgggtatattatgtccctctgtgttctctagctagttatctatccatccatctcttgccttgtccacagaagttacaggtaggctgccgggcgcagtggctcacgcctgtaatcacagcactttgggaggccaaggcgggcggatcacgaggtcagaagttggagaccatcctggctaacacagtgaaaccccatatctcctaaaaatacaaaaaattagccaggcatggtggtgggcacctgtagtcccagctactcgggaggctgaagcaggagaatagcgtgaacccgggaggcggagcttgcagtgaaccgtgatcgcttcactgcactccagcctgggcaacagagcgagaatccatctcaaaaaaaaaaaaaaaaaaaaaaaaaaaaaaaaagaaagaaagaaattacaggtaggctagagcacggatgagcaaactgtttttataaaggaccagagagtatatatttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacgttttgatatgaatatttccacccccattatttgcataacaaattacagattatccagaacaggtgggctgtacataaacaggctggtgggctggatttgtcctgtggactgtagtttgctgacatccaggctagatccttaatatacaatgaagtagtaaaacacatgtaaaagtaaaaagcaggcgaaatagaataaaatacacatttgcacaccacagtatccaaaaaggttatgtactggggctaaagatttggcttggagtttcctggtagtcaaggcaaaaaagggaaacaaaactagttacagagtttctcggacctatgagcaaaaggatgtccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctgacagttgttaattaaatacctactcatgctttggagccaaagccaaatagtgctctgtaaacattatgatttgtcagtaatcaatgtgatttgtataatttgtgagcaatcagatactttatccaaaagcggattattgacctctgtgcccatcttgggagaaattgccacttggtctgtgtctacacagacccaagaggagaagggatttgacaatggtctgattaattgaatcagtggtttgggggagtgggctgtctgtattgatccaattaaatagataattgtcagaatcgaggtcatgtctataagacaccaccatttcaaagccaaagagattgtttcaaacatatcatgctcaccccaatcaatgtgggccgcctcctccacatgaaatcaaccagaaagtgattgattctgcagagccataaaccagggtctttcctattttcggcaagtggttctgtgctaaatacagtgctttgaaatttttgttccccatagacccaaggatgatgattcattatgcaaataatggggatagaaatatacaaattgaatgttagggctgggcgtggtggctcacccatgtaatcccaacactttgggaggataaggtgggcggatcgcttgagctcaggagttggagacaagcctgggcaacatggcaaaaccccatctctacaaaaaattttaaaaatttagccgggcaggcatggtggctcatgcctgtagtttcagctattccggaagctgaggtaaggaggatcgcttgaacctaggaggcagaggttgctgtgaggcaagatcacaccactgccttctagcctgggcagcagagtgcgaccttgtctcaaaaaaaaaaaaaaaaaaaaaaaaaaaagaaaaagaaaaaaaaagttggaatgacatcagactcaaaatgtgtcacttcgcagtggggatgcaattctgagaaatgcatggttaggtggtttcatcattgtggaacatcatggagtgcacgtacacaaacctagatggtgccgtctactacacacacacttaggctgtatggtctagcctcttggtcttagcctacaaagctatgcaacgtgtgattgggctgcgtactgtaggcagttgtaacagtggtatgtgtatatctcaacatatctaaacatagaaatagtacagtaaaaatatgatattataatctttgggaccgccatcatatatgtagtctgtcattgactgaaagttgtcatgtagcccatgactgtcgtctcttttaggggaaaaaacaaaagcagaaagcaagcaagctggtatcctgcgtatctgtgagctcaggaagcagctgcatgtgcatactggataagcaagggagactccaaccccgggctctctaagggtgtaattgttgcaggcacactgaggggcagacctctgggtcttggttagtggtccagagagggaagagagcaaaggtagaaggcttgagtttaatttctgcatcagactcaaaacccagctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcattaacatgccttatctgacatgtggcaataacttctgcctttcttatgtcatctgcatggttgcagtggatagtcactggacaattgatgaacaactactacatgctagatctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctctttgtggctcagtttcttcatatataaaatggggatcatgatagtctctgtcccaggggagttaggaggattaaatgcaacagtaatccaaccacagtatgaaaagacaggctagcacatacaacacaatctataaatgtttgctattattgtcatcctttttattagtatatcatggtacaagtttgctgggtagaaagatggcgatggggaaggggacatttcaggccaatgtgataataaaatcaacagacaaaagaagggagagtgtggtgagtaggataaagctctgtacagatgcaaggggaagggtgttgatgtcaacacgcatgcagcttcccacacgtcgtgtggattcttttctgtgctctccattacggaatctccctgaaaataagtggtcactttgaggtttgatggtttaattctaccacaaaagtataaaaagcaggcagcctgctgtttatagatttttttttaagtgagggagtatgttaatgagcttagattgtcagggagctaaggggattcttgacatcaaattgtgggtagctaaataggtcaccccaagttattcagcatgggtggaagaccaagaggatacacaagcttcaaaaagttttcagggagagcaagagatgttcatttacctcattcaaaatggaatctttaatgctagtccagtgcttggccagtacaaggccattatatatttgttgaatgaatgaattcgtgaatatgtttataaagacaaggaaacgccattctgcaaatctacgtgcagtaaaatagtttttcagtcactttgccttcatttgtttgacattcttggaatatttgggctctacaaggtgctagggtaaggcacgcaggatgcaagattagcgagatattgtctctactctcaagaaactcgctttctttgggaatcatcacctgtttttgtgtcacggaccccttgggcatttggtgccctttgcagaataatggttttgaatacataaaacgcacgggatcacagaggaaaccaatcatattaaaatacagttgtcaaaatattaactcatgggatctagtaacaaatgttcttccttcttaacccattaaagaacacagctcatggtcggtccattaactactaattatcaaaacagtgggtgaaaacgatgtttggaaatagctgcgactctcgcgtgataggaaaatatctgtgatttcgattgcgacaaacacacagatgcttctcacacgatcgcagtgcattgcctaaatgacagtaatgctaaactccagtcagatgttagtgaaaaataaagatgtaacattttggccatctgtgtacaccccctctttctagggttccagccacagaccctcagattaaggagtctgcactagcttgtagcttgttcaatcacacatacacacaaaaagtgccagttataaaggagcaggaggttttctggagccaggatgagctgggaccaacaccagcaactgtatcacccagttcactgagagttaaaatcacccatgtgacgttctctctgcaggcacatagtaagtgctggataaatgatagggattgatattgaccagctttgacacatgaataggagagggttaggcaaagacaaagagagatggggatgccaagtaccctctgggcagaggaaaccatgagtgcagaggcacgtaggcctgaaacaggccagaaagcaccaagcaatttgcttttgctggtgaaggaggtataaaaggtagagttgcaaagactggggatggagctttaggctgggatcagcgcccaatgggctgggatgacaagtgcttggggcacattggcagctgcgaaaagctcgctctgatgcctgtgtggggacagattttgggggcaagaggactctccagcaatctgtggcaaaaaaaaaaaaaaaaaaaaaagtcccgcttgttatcaagcctactggcttatctgttatttcttggacatgccccagtcgctagtaaataaagctgtctactttacattttgtctctgtgcccttttacagccttttctcggaggagctgagtcccattatattccgaaagcatatgttcccgatgattgctcattctctttccaataatatctttgcaggacaaagaggaatggggaagggaacatacttttaggatgtcagtcccagttttaattacaagtgttcctggttgtggcattcatgtaattgggggctgatttatgccaaatgatatgcactgatgtaaggggctggagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcactttctggctttgtgacctttctgcaggttacttctctcccctgagcatcagtttactcagctgaaaaatgcatctgctaataatacctatggcatagggtttggggaggattaaataagataatgtaaatagagtttagcgtggtactgtgtatatagccagcactcactgctgttggcttattgaaaaaacaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaataaaagaattactgttctccctttgcatttatgcattgcatgtctctgttgaattcagagtgctttatagacctctgatcagcttccagcatcctcttggtatgagttctagggggagatgaggaatgtgcctaattcccttgagtgatttacttggtgttaccctggagttgtgaggacaaaaggatggggctgactgagactggggatgttcatcacaaagtgttcaggttacatccaggctgattactggccaggagactaggcattcatagtggggcgtcctttaaggtctgaagaggacagtgaccatccaccacaggcaaacatgtgtgtgttaaaaaggaatgacgttttggtctgtgctacaactgggatgaacctcaaacattacgctggacgtggtggcttacacctgtaatcccagcactttgggaggctgaggcaggtagatcacctgaggtctcagaagttcgagaccagcctggctggtggtgataccccatctctactaaaatatggtgataccccatctctactaaaaatacaaaaaaaaaaaaaaattagccagacatggtggtgcaggcctgtaatcccagctactcgggaggctgaggcaggagaatcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagacagaaagcaagctagtgattgcagggggctgggaaagaggggactagagaatgactgctaaagcattcaaggtttcttttggggttggttaaatggtctagaattagatcgtgttgatggttgtacaaccttgtaaatatactaaaaaccactgaactgtacactttaagtgggtgaattttattttatgtcttatttatttattcttttagggacagggccttacgctgctgcgtaggttgtggtgcagtggcacagtcacagctcactgcagcctcaaactcctaaggtgaagagaccctcccaccttagcctcctcagtagctgagactacaggtgcgtgctaccgtgcccagctgatttttaaatttttttttctttgttttgagacggagttttgctctgttgcccaggctggagtgcagtggtgctatctcagctcactgcaagctccgcctcccaggttcacgccattctcctgcctcagcctcccgagtagctgggactacaggcacccaccaccatgcctggctaattttttgtatttttttagtagagacggggtttcaccatgttagccaggatggtcttcatctcctgacctcgcgatctgcccacctcggcctcccaaagtgctgggattacaggcatgagccaccatgcctggccctgatttttaaatttttcatggagacagggtctcaccttgttttccaagctgatctcaaaatcctggcctcaagcaatcctctcctctgcctcagaaagtgctgggattacaggcgtgagccaccacacctggccgctggaaatacatttctaaagaggaatgggagtcaggctggtgaagaaacacgtgagtgtgggatgaggatggggacacagagtgatgtgaggcctacacaacaggagttcaatcctaggacctgagctgatgtaaatgaagcaccgccaggcccagttggggaggaccttgtgttcctgctggagagtgagagtccctccctccccattccactcccaagagcagtgaagagtcaggaaggtgggcttgttttgttttgttttgttttgttttgcttgttgagcaagggaatgcggttcccctgtgtcggacttgtttcagaaagacaatgtcactgaggctggggcagggagattagctgagaggctcttgcagttatctgggaaggagctgtccataaaggcctgagttaagacagtagccctttgggttcgatttagtggtggctccccaaaagatatgttcactggaacctagacatttgagaaaaagggtctttgcagataagttcagttgaggatctcaaaacgaggtcatcttgggtggaccctaaatccaatgacaggtgttttcagcagagacagaagtgaagaaggcacagaagagaaggcggtgtgaaggtagagactgagatcggagtgattcccccacaagccagggagcactgagggctgctggcacccccagataccaggagaggggcacaaataggttctcctcagagcccccagaaggaactaagccttctcacacctagactttagacttctggcctccagaatactaagaaaataaatttctattgttttaagctaccacacagatgcaggaaactaatataccctttaatgattttctccatggcctttctgataatcctttcatccttcatctcccctgtcgccgttttctttgctttgcttgcttgcttgttttttttttttttttgagacggagttttgctcttgtcgcctaggctggagtgcaacggcacaatcttggttcactgcagcctccgcctcctgggttcaagtgattctcctgcctcaccctcccgagtagctgggataataggtgcctatcaccacgccgagctaatgtttttggatttttagtagagatgggttttcgccatgttgtgcaggctggtctcaaattcctggtcccaggcgatctgcctgtcttggcctcccaaaatgctgggattacaggcatgagtccccatgcccagcccctgttgcccttttcaaaacactaagtgcatcatgttaaccttccactcgcttctttaagtttcctcactccttttaggtgaacaacccaaaccctcatatgccctagaggcccttttcagccctgttgacacttcccttctctgtgctttagtcaccctaccctcggtcaactcctaactcctgcctgccacagggcctttgcacatcctctgccggggaggctctcccttcaccttcattaggttatcagatctcagctcacacatcacatcttctgagataccttccagactcccctggccacggtcacttcctttgctgtggactctctgggaactgtgtccccttccttctcacatcagcttgcagttctgtacttgttcatgtgatcattgatcagggtccattttctgctccagacaatgatctctatctagaaagaatcatgcctgcttttctgcactctcctgcctctaggggagagaacacagagcctggcatgtggtagactctttttttttttttttttttttgagatggagtctccctctgtcgcctaggctgcagtgcagtggcgcgatctcagctcactgcaacctccgcctcccgggttcacaccattttcctgcctcagcgtcccaagtagctgggagtacaggcgactgccaccacgcccggctaatttttttttttttttttttggtatttttaatagagacggggtttcaccatgttagccaggatggtctcaatctcctgaccttgtgatctgcccacctcagcctcccaaagtgctgggattacaggtgtgagccaccacgcctgggcggcacgtggtagactcttaatgaatttttgctgaatactgagtaaataaagaaaagttaacacagtggagtccaggtacagtggctcatgcctgtaatcccagcactttgggaggtcaaggcaggaggatcacgtgagcccagcagttcaagaccagccttggcaacatggtgagaccccatctctacaaaaaataaaataattagctgggcatggtggtacatgcctgtagtcccagctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaacttttcattgcaaaatgaaaattcttcattgttattataattacttcaaggagcaaggccattttgtgtaagctatcctgggcctccctgcctcccattttacaccctgtttattgatactaagaagagcctccaactgaataagaactaatgacttctgcctgccatcattttggaatgtccaattccccgttctggagagcctttgattataacatcagcctgtcatttggacctctgacctgaattatatgaatctgaaaaatctcttcctttcctatcgtgaattcggtcattgttataagccaagctttgcaaaggtggaacaccttggagatacttatctcctccttactctacccaagtaatgactcatccttttatacagaatgtctcttttttgatttagatgtctttttttgatatagatgtctcttgatatagaagcatttctcgggatggtttttgtggttgcctagtgtcttctaaagacccctgaacatagcatagaaacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttacccaggatggtctcgatctcctgacctcatgatccacctgccttggcctcccaaagtgctgggattacaggcgtgagccaccacgcccgactgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactgaagagttgataaaaaagcacaaattgtaggctgcaaatctatcatttttctttcctccttcttcctctccctccctcccatcctttcttgctttcttccctcctctctccttccttccctccctttccagcttaactaaaattttctgatacttttttcctgaattagggtatgttttggggggaaaaaacgcttcagtgcgtgtttctttcgacattacacataagcccccatggaaagcaaattgaataaatttactctctaaacttctttccacaagagtaggtttataatttattttctttacattatctggataattacatttggtttgcttacatagatggaggcgaatggttttccaatcttcaaaccaacctatatcacaaaagcattctgaaaactgggaagagatcacttcacagtttcctgaaccactagaaaaaaaaaatgttcataaatttatagccgctgacattgaagttggagaaaagagcatatctagtacctatgctatgtggagaacactctccatgtctttgaaaaataagcacaatacaaattatatttgaggatgacctgccaaagggttgattatcctggaaacatgttttctcaatggtccatttgggcaaacaggccagctgaggtatctcaggatagcaacaggataagcagaatcgattgatgaaggagggagcctacctctggaggccccaggctgggactttgggtacagatgcacaggagacctttgccccaccccgtcacggctgggcctactcagttccacgtctttgagttttcacgcggaaactggatgtttcttacatcctcagctgcaggcatggggaagagacgcacatcagccattaagaaaaaggtatgcagtctacatgcctcttaatttcctccacatacacagtaaacccatcatgtccatcagcaccattgtcaaaacatctgtgcaccagtaaagggttctgatgtgtgataaatttatttagctattactcatctgaagttatactattttaggatcttggggcagtgaggactttggaaatggaacaggatgctcctttaagttagggtaaaatgaagtctataaaaactgtttttctatatcctcctcctaccccacaaagaaagttagggtaatatattcttatataaaattgacatttttaactttaatgagaaattgcttgtcctttaaactttaggcattgatgcgcttaattatgcttttcaacaagattttgcatttttaatatttccttttagagcttccaggaatctcaattattaattgtaccctggatttattggtctttggactctcccgctagtataaagactgtagattcatcaaacattgtttactgtcttcaaacttcaacagtgttttaactatcaaatagaaaatcgaaaggaagcataaacgcatatggtcactttactggtataataggggccaagagccgttgtgttttataatttcttgatgatcctggtggtaggtaagccaaccgctatgaactctgatgagctctggtttaccccatagtccaaataaagaatggtttctgacattgtatgaccaaaaaaaatagcatctgcccaaaagatgctatttataaaactgttacaaatggagcttattgttcaccagaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggtttctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagaggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatataatctatatatagatatctatataatatatataatctatatatgatatatatatcttattatatattatatatatagatagatatctatatacagatatctgtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaatatatattatgtatagataatttatatataaatatgtgtatatatatatttgttagggtaaaacaaagtctataaaaactgttttcctttgtcattgcccccaccaaatatttatatatatgtatatacacatatgtatatatgtatgtatagagagtctattatatatattacatatacataatatatacataatatataatagactctataatatagactctaatatgtagtctatatattatattataatgtatgtaatatataatatattctatgtaatatataatatattctatgtaatatatattaatatgtagggaatatgttacatattatgttgagagtgtatatattatatatgggtttctatatattataataaacccatatataatatacataatagactatacacatatacagctaatatatatacacaatagtctagtatatattatacatgtaatatactttccatacatacatatataatttggggggcaaaaacatatatataatgaatataattatataattcatataatatatgtaatagagcgtgtatattatttacatatgtatatatatatatatacacacacacacacacatttcaactttcttgaactcctgaaccagccttagattgcctagtaccagggttcttctttttttaaaaaatttatattttattttaagttcaggggtccatgtgcaggtttgttatataggtaaactggcgtgatgggggtttgttgtacagatgatttcatcacccaggtattaagcctagtgcccattagttatttttcctgctcttctccctcctgccaccctccaccctttggtaggccccagtgtcttttgttcccctctttgtgtctatgtgctctcatcatttagttcccacttataagtgagaacatatggtatttgcattttctgttattgaattaatttgctaaggataatggcctccagctccatccatgttcctgcaaaggacatgatctcattattttttaaggctgcatagtattccacggtgtagatgtaatatatatataatatatatataaaatatatattatgtatagataatttatatataaatatgtgtatatatatatttgttagggtaaaacaaagtctataaaaactgttttcctttgttattgcccccaccaaatatttatatatatatacacacatatgtatatatgtatgtatagagagtctattatatatattacatatacataatatatacataatatataatagactctataatatagactctaataattattttttaaggctgcatagtattccatggtgtagatgtaccacattttctttatccagaataaactattttttatactggttttaggctcacagcaaaatcgagtggaaggtacagggattttccagatttcccctggccctcactaccacatgcgtagccacccctttatcaacatcatgttaactattttaaagtggacagttgagtggctttaagggcattcatattgttgtgctaacatcatgaccatccatctccagaatgattttcatcgtgcaaaactgaaacgctgtacccacagaacactggctcctcatcacctccccaagcccagcccctggcaaccaccattctcccctactttgtctatgaattcgactactcttggtacctcatataagtggaatcacacagtgtgtgatgtgttcttttgtggctgacttatttatgatactggattctcagcatcatgggagttaggactgtctgtcgcaccatcaaacaggcatagctggctggctagaccatgtcacagggatgttggaactgggtggcactgactggcccagccaaggggtcacgcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataaatgaaaagcaccattattagtaatgtcaataactttcctgacatccatttgggcattgtatatgttttgataggattacataaataatgaaattgtatgcaaagcatcagaatgcaaaaggtgttttctccaaggtgtacacactgcctgggccttgtactctggccctcaattttcttaaacagctgcatcttttgggggctctgttaagacatgctactgtctttagtattttgccccctcaccgaatgatcaggagactggcttccccaatgccctgggcttaattcccagatatttattctgttgtggagtgattatctgttcctggattgtctcaaaggcattaatctttttggtatccaacatcttgaatgcttctgtgtcattttcctttctttttttttttcaaagcacttaattatttaaaaacaaaaatacttctctgatcagagcatacctgccgtgctcaaagcacttgcttacttggaatgccataaattacatgaaggaattattcattgtatcacgaaacataccttccagtctcccgagtagtgtattaggctaagtatggtcttttaaattattactttaaaaataaaagataatggaattatagcattaaatacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaaaaaataaatatctgtgatctcatcatttgaccgtcagtattttcatttttgcatgtgccactttaatttccctaggcaacactagctagtggcccacaataagacgtagaaaacaagaccacgtaccttccagaatcattggccctggctctactcctggaaacccagtccatctctaatccctttgatttccaatgggaggcaaatccaggggagttctagactgtctagaatattgtaccaagaacaaaaggccaaccccattagacagtggccaagggaggtgaactaaagttggtgctgtgaacagggctaatggtttgtgatttacccataagtggaaggtgtactccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgatctcaggtgtaccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctatcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccactctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagctcctaaggaagtgccagagtcagggctttcctctgcctgaattatcggagctcttggcttaatgtgggagaagagatgaatgatctgtccttctatgaaaggcttaccaactccattcaattcacagtggctctctgaagctctgtttttggaaggactgtgaggctgtacctgcacttgattgaacgagtgctgggattgattagtgatgtctgcagtgagcgaaggattgggaagagtaaacaggcatgctgcatatctgtcatcatggctctgagtgtatcctgtttcagaagagatgaactgtgctgtagagatgttagcatcaggtattttagacacatgaagagaggatcagattcagtggaagtgccaaagggattctttcagatgggcaataagtggttctgaagatacgtatttctcagtgtgttatcttggctccatttagccacacaaaaggaatatgggtatagtgatgggtctctcatggctcacgtattaactgtatttgttgttactgcttctcaggcactctgttaagaatgcagggctcttcctcagactcagggcggggcctgggctttacagcaatggttttcagtttgtaatctctctcaaggaagggagaggagcacaaagctgccttgactgccagcaccatcagaaaagtgacagcagtcttggccctgtaattgccaacagtaattcatttgttcgttctctctctctcgctcctgctcctgactctgggggatgcttcttttcctaccctgcctggaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaccctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcagttgggagagtgcaggatccagttcaaaaggatctgtccccccgtgaaccccaggacagggtgagaggccacctgcacactttttttttgtcagctcacaccctgttggccctttgcaaatatttgtctttcctcatgcacgtggttattcccagaaagatccagtgaattgtctcctgaagataaaatacataaaagggcgtttcaaagtataaacagtgattttaatgaaaaataagaagaaaatgcttatgatacaacattaggtggaaaacgaaggaagaaaaattctgtgagtctaattatggaaaaaattactaagatatgttttaacatgccctagacatgcacagaaaaaaaagactggaaggaaatttattgagatgttattgtttatgagtgttctaattatgatttttaacaatatattatcagagttttctgacaaagaattaactttttattttttttgagacagagtttctctcttgtcacacaggctggagtgcaatggtgcaatctcagctcactgcaatgtctgcctcccagattcaagcaattttcctgcctcaggctcccaagtagctgggattacaggcacccaccaccacacccaactaatttttgtgtttttagtagagacagggtttcaccatattggccagactgctcttgaattcctaacttcaggtgacccacctgcctcagcctcccaaagtgctgggattacaagcatgagccactgtgcccagcctagaaataacttttaaatcagaaaaatacattttttaaaaagatgtaaagcatacatagaggataacttacaaatctgcatttcatgaccacatatatctattgagttgcccctaggatcatttttttcaaagctaatgtctgccacaaatgggagttttaataggttataattcatatgacttagtgttaaacctctacgttgggattcttaaatttaacatggataaactgaacttgatttcctgcattaaaaaaaattaaagaaatgaaagttctgactgttttattgtagctggggaattctttttgcaggtgatgctcatgttacggttttgaacccaggactttgcgttgcagttttgttcaggggttgcagaataccgatctgactttgcaggaatgactgtcttggtgcataagccattaacctctctgcgcccttggattgcctcctctcctgccagcagaagccaagtcacctcatctgtaagggagtttcattgaggactaagtgggaccaggccgaaaacgacccccttcccccataggaagtcacagaacagccaagccctggaacaggaggagcagcttcctcctgggcacagctgtgcagaaccagaggcgacgcatttgcccatcgtaaaggctgattagaaacagttgggtcccaagcagaatccttttgcccatgactgtgtccatggtcgaggtgtccattgtcactgttgccagatgccagcactggcgagggttttgccttcctaccgtaggcttcttgacccggcacctcggaaagtaactcctgtccattgttccttgtgccatctttcttaagaaaacatgaggaggagcagggtgatgctagatggaagcaggagagcctggggtcttagtttcagtggctctgacttcagttttctcacctcgaaatctcccttctctgaacctttttgcgtgctcttctgtctgtctgatattcatcatctgactcatctctaccagtcaggagttgcttcttccaggaagccacattccatggactgatacgctgggctccatgccatcctggggttctcttgagtacatctggaggggtgtagtgtgttgtaaatgcatacgatcatgctggtacatttcatcaaaggtggcagttacactaccagttgtgtgcccttgggcaattagcatcaccctgctgtgcctcagtgtttccatctataaactgggtataataatcattcctaccccataggttgctgtgaagattggctcacatcagtaatgtacttggaatggatcctggcataaaaagagcccttggaaaatgatagcgttcatccttggtatgacctccaagttctttgaacctcaaagagccaagtcccacatctcaggtacatttcagttcattctttctgagttgatttttttttttttttttgagacaaggtctcattctgttgcccagactggagtgcggtggtgcgatctcagctcactgccacctctgcctcccaggcccaagcgatcctcctgcctcagcctcatgagcagctgggaccacaggatgcaccaccatggccagataattgttttgcatctttggtagagacaaggcttcactatgttgcccaggctggtctcgaactcctgagctcaggtgatctacctaccttggccccacaaagtgctgggcttacaggtatcagccactgggcctggcctgagttgataatttttgtcatttctttctcacttttctcaggaaaatcatgactgtaaaacagatcagttttgctttagttcccaccctcatcatcaacccctccccagctaccctgcaaaagagtcacagatcattgggataactagaaccacagagatccccctagacttgtcagccagggaacctgacactcttagaccttcttctgagtgctttgtccttgtccggagagctcggggaggagcaaggttgtactgggatttttttccgatcacagaaagtaacttagctagctgttgcccagccaatttgcccaagggagaggttgctcctgggttgcaggacgcatccatggatggagcatgggttttgggctgtggggggacaatgaggtggttcctgaaatccctagttactagcagacaagtgcatcagacaagtgcatttcaccgttctgagcttcagtctcttatccaagcagaaacatggccagaatgcaatgtcctaatacatgtaattcattacgtgtgttgtcatgtaatgtaacacacctattggcagtctctgacacaatacagatattgaccccatggtcttgccccaacttaaataaaaataaaaacgaatgcaaaagaggaatcttctttgcactcgtgtgatgtctgttaattcttggctttcttccttcataaggttaatcatctccctgtcacccctcccgcttgtcccccagcctctgtgtgtcaccttctctctgagctcaccctctctaggaagccttccttgctggaatgcccattccctgatataaggattccacccaccacgccccttgcggttccttgccggtgtcctgtcctgggcagacataagccctgtgggttccagtttctcattaggaacctggatgatggagcagggatcatgctcattaagtccgcagaactcatcagctgcttagcagggggccaaggagggctgagcctatgacgggtgaataagtctggttggcctctgggagtacgggatcagaattccaagtgactggggtcagtagcaggccaccaagagccatcccacctcagaaagacagaagccatcactgcaaatggcaagggcatgaggcagtttgaaactggcaaaactggacctttcatggaatccagggcttgagctttaatgctttacacttttgttttttcattccatacgcttttgctttagcttcctggcaaaattcagacaaacctagaagggataataacttacattcaacctctgcttgctctgtcctttctcacacgtgtttagagaaactggaggagcccgggaactgctttctcctctctaagagtcttggtggtttcttgtgtggaaatgaatgggaagttcaccctggttctgcaaaatgggtgcgaaatgtaaaatgtatataccttctatcctactctttatgttccacaaattttggagggaaactgattaactctctagctaccatgttccaggtgcctgcacctgcttgctcttggttaacctgcacccacgttcccccgcctgtctctgaagtattcacaggtggaggctcagatgcacacagtgattgagtgccctagctggggttggaaactctgtccatgaactccaaagcccacgctctcttacaccctcccaaaagctgaggcttcctcactgtcttttgcattatgtcatgggtggaaacatgcaccttccctgaccttttggcttggaacatggaagttcattgactttgttgcctagcagggcctggagctgggtttcttgcctgatcaatgtatatcattttgccaagagacagagtctgtgctggagagattgattccctggttatttatcttcctctgcccagtgtaaattggtcagcctgatcctattcgcatgataaaaatcataatgtctcaaattacttactcaataaaatgtgggtttgtctattattagtgattattagggttataatgcagcatggaaatttggagcaaattaactatacatgcaagctgttgggctcaagtgcagttaatcatacgcatacagtgccagtgggcagaaggttttgcaagaatagcttcaggaagactttgtgggaagacagatgaatactcagggttttttttttttttttttttcttctaacttgtcctccttgatcaggatttctcaaatgcacatttgtctaatatactgttgaaccatgcaagtaccaaaacaaaacaagaaacccagaattatagctcaaatttaattaaaatagcttttattgcttctattcatgtgtccctggattttaagtgatgcgtcagaatttcatgatgagcaaatgcctatggatgccctcatttctcatccttcttgactgtctgctaagattcactcttggtcttgtctttgagcttttctgttcagtgatgtaatgggacaggctctcctgtcatcaagagttcccatcatacctgggcactgccatttcctctgtggtagatgcttcctggacacgtgggcaggtgagaggtgctgactttgcctacttgcagctgaagagaagagagatgtagctttgaatggccacatgagtgtttttttaaatgaaaaaaaaatctatgtataacttgtttcctgtgagggtgccaggaaactttacaatgaacttcgtgaattaaacctctaccagatgaatagaggtggtggcatggtagcagaaattaggattaaaaaaatggtttttgatttatgaaaaatttttctgcaggaaattttgatttgttctttgtggattctgaggataaaattaagaccaacattgaggatgagagacagaactgaactcaacttaaaatagcttcagggaggaaaagcaagtgcattagataagtaagtgggaagtccaggggtagacgtgagttcaggcatagctggatccaggatccgacagcttgcatgtgtagttaatttgttccaaatttccatcctgcattataaccctaatgtttgctaataacacacaaacccacattttattaagtaagtaatttgagacatgatgatttttgtcatgtaaataggatcaggctgaccagtatagactgggcagaggaagattcataaccagggaattaatctctggatccaggctgaaatgatattatcagacacctttctttctctggtcctcagttttgatctcttctctgctagctttattctaagacaggcttagatgggatgtagagagcaaactctggaagtggagtacctctggcctccaaggccagtagttgtagcaaaagtccagggctgccgctcattcactctgctcggacctttctggtcacttgtcttctgtggtttggtccttgtggccagggacaatgaaactctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggcggtctgatacagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcacgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctgagcaggattattgtagaggggactgatgttgaagaatggaaaagaaggcagtgtcagagaatgctgaagagtgtggatcttaaagtccaacctcaaggcccagcgctgccacttaacagctctgtgaccctgtaaagtcactcagcctcattgagtcccccatcctcccctgtgtagaatgaggctaatgctagtgctcatttcatagagttgctacaataatcaatgagataatgtgcataaagatttacatacataataactgctcaataaagggtagatgttaaaattagcatcagcgagctctagaagatgctaagttctctggaaagatcagctctgctcctgtcaatctctccaaatgttagattttgcctcaaattttaggcattcgttcattcatttattctttcgtaaattctatcgcattaacctttacaagtgttaaattaaatcttttccccaaattatgcattagaaccaagttcttatgtggtggatgtacctcatttcagcaagagctttctaagggtacagaattaaatatgcagcctctgggattcagtgatagctcatgggacatttgacctacatggaaatgcaggctggagttgcattttaattggcaaggatcagcccagttgtccagcttgtagcttggagtgtggcctggctcccactccagagagatgtacatcatgatctgcgtgggtgagaggatactctcaggaaatgggcaaagttgccagctgacctctccagaaagagagactatgttgttagtttcccttacttggatgagaaatttctccattcctagtctcattttcccaatagaacacggaggcagaatttaaagcctcaaaacaatctgatgcacatcagctatcaatgaaaaggaccagcttggaggcagaggcacctgagttttgcatcttggctcaatcacttactaactgcattgtgggttaacacagtgtgtgtgtgtgcacttactaactgtgcaactgtgggcaagtgatgtaatctctctggagctcgtttttccttttttcttttcctttttttttttttttttttttttttttttttttgagatggagtctcactctgttgcccaggctggagtgcagtggcgcaatctcagctcactgcaacctctgcctcccgggttcaagtgattctcctgcctcagcctcccaagtagctgggactacaggtgcacaccaccatggctggctaatttttgtatttttagtagagacgggctttcaccatgttggccaggctggcctcgagctcctgacctcagatgatctgtctgccttgccctcccaaagtgctagaattacaggcataagccactgcacccggccacagttttcttttctatattgtagggataataatcctcccttgcaggactgtgctcagcacatgttcattgctcaagagaagtagccactgttattattattgtcagtatgtatccaagtgtttagttcattttctctgcatttgtctaactcccttttttcccttgaactgtaaagctctcagcccagggatatagtagcaccagcacatagtagatgatcaagaaaaattagtcattctctctggttcttcctttcctgtatcctgttgtctttatcagttcaggctgctgtgacaaaagtatcacagactggatggccttaaccacaattgttttacatggttctggagactgggaagtctaagattaaggcagtggaaggttcactgtctggtgaaggctgggctcctgattcatagatgtctgcccttcttgtgcatcttcacatggtgggaagagggtgagagagctcaccggggagtgtttctcccagttcctccccagtacacagaaaaacaaagctttctgtctcaccaggaggactccacggtgagcatagcttggctcagcccagcaggagattttgaaccgactctggtagattcttcctgcagccattcagctcccacctctttctctcaaaaagaaatccagggctgggtgtgtgtgggcaacttcaccctgctctctttgtcccccaggcctgcactacaacaaatgtctctttgtgtccaactcttcttccatttctagtccttcttttctcttcttctcgtacttcccatattcctaatacgattggttactcaaattcttaaacaactcacaactcattatctcccttccatgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaaagacacaaattgtccttaccctcatggattcaccatctatttaaaggccacaaatacttgtgtgagaagcaagtcttaatagtctgaagtattttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgtatcagtgtcctgtggctgctgtaacagattactacaaattttgtggcataaaataacacaaatcgattcccttacagttctggatgtcagaactgggtgactttctcctgagactgtcctgattttttttttttttttttttttttttttttgcttgtcagtttgttttgggtgatgcagatggaaggtaacgtcacagggcagctgtattccaggtacttggtgactcttggttgcgatctgatgactggctcacagtaggaccatgacgtgagcagatttgtagtcctgcatgaatgaaggaaagaaagaaatctgacaactcattgattcagattcacagactctgcattttgaaccagaatacacccgagcaattacctagcacaaaatctcctgtctgcagaggagttgcaggaaggagaattcactatatcctctcctgaaaatatcccttgtggtcaaggtggctatagactggcatccctctgctccctaagatgccagggactcacgtcttctaggatatcaggggaagatacagggcaatgggcctcagatcacagacacggaaaatcattttctatttcatggagcatggagaagcttccttcaaaaagctagccttcgactttctattttttgaactgaagggcaggccaggagggagctgacctgtgtagagcttggaggttgtgttttcagctgagaaaagtgatcctgaacctctccatccttgcaaagctcagatggaagcccaggggccccagccctccagccccacacacatgccggtgcacctggactgccactctacctgtttacaaattacccccattttctgcttggttcagcagcaactgattaccgtcccccgtgatgtaattagggcttcagagttcacgtgtgtctattatgagctctcctgtgctttgtcttggtgcttcgtttctgtagcagtaatcatatatatatataaaaatttggtatcaattgtttggctaaattatgcacagtgggccatcctaacctgccattaacataacgtatgctaaagaatgtgttgtgtttttttcttttctctgataattatactctaaagcatcaattgcttatttgagtaaattaaactttgagttgttcttatttcttcaaactttcaaattgtcttgcctgcagcagatgcagacccagcactccggctgctgccagtggaggcaggagcctcgttaccacctttctgagaaattcaagtgccacacagtggtcaccagcattgtagctgccctgatgttccgggctcagctgcaatatagcacatctctaccaccatccccagagtgacctccagaactgtaagggacccccgcctttggtacagagatgggagttaaacacaggtgtccactggagtcatgattcctctattccctggacaaatatgcaatgagaatccctgagggacaggcactgtgctagatacccgagatacaaaagcgacaaggtttctatcctctgacagtttatactttagtgcagtggtcagcagactgtttctgcaaacagctagatagcaaatattttagactttgtgacccatacagtcaccatcacaactattcagttctgccagtgtaactcaaaagcagccatggctgttacataatgagtggctgtggctgtgtgccaattaaactttatttacaaaaacaagaggagggccagattttgcctttgtcaaggaagtaagcataatagtgcaagcagcacgtgcccgctctttcacactggggcaaacacaggggatttattcggcacaattgagtaatgtggatgaggctgctcagggctggcagttgtaggacgcaaaaccttgaggggcatcgatattctggtacagctgtcacccatttgcagcacagctgggacactccacagagaatgatcaggaaggccaagcccagatggcattgttgaggggctttctcttaagactgcatctgagtggcagggcgcagtagctgacccttgtaatcccagcactttgggaggccgaggtgggtggatcacgaggtcaggagttcaagaccagcctggccatgatggcgaaaccccgtctctactaaaaatacaaaaattagcctggcgtggtggccggcgcctgtaatcccagccacttgggaggctgaggcagagaattgcttgaacctgggaggtggaggttgcagtgagctgagatcatcccaccgcacaccagcctggccgacagagtgagactctgtctcaaaaaaaaaaaaaaaaaaagttacttctgagttaaaatatgaagagtgagcagtacccagccatgcagaaggacatggagtggtaaaagcatgtggttccattaagggaaagactccagggcaagaaaaaaacatgtcatgcttgtacctgagggaaggccagtgtgattgcagagtatggggcaccctggaggtctggaatgggaggagtttaaacaggtcattagagcttcaagatgaagcataggccagtgacttggttgctgctgctgcgtaaccgtgtggcaactgagtggctcacggcaatcagtatttacttctcacgtgtgtgtggggttcagcagaactaggctgggcttggctgccctgccctactggtcctgctggttttggtggggcttccccctgtgtctgtgggtcagcttgttttgctcctgcatctttgcatcagctgggctttctgccctaggctggacatgggtggggcactttagctggggtggttctcctccacatgtctctcatcttcctgggaccagcagggctagaccagacatgactttcttatggcaagggcagaaatgcaagacagcaactcaaaacacataaggactttcaagtctagacccagaactggcatacccattcctctgtcacacactgatgccccaaataaatcacatggctgagctcacggttagagagggaggatactgcagtcccaaagcccggggcatggatccagagaggagggtgaagaatgggcccctgacccaagactgcacttgtatttgagttgcataagaagctgctgaggaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaacgagaaattacagcccagattagcagccttgagtgctccttgtgaacacaagacactgacccaaatcacacgtcacggctcttcgcccattaacgcttatagcaggattattcccaaggaagctgtagccattatatttgctgccatcacaacagtaaaataaacaggtgtgactgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacctaagtgtgcaatgctttaaatcagtaagtttgtttttcattaacataaaatccaaaacaggtgctgtgatcagcaagccgctgtcctccaagtggtaattcaggaacccaggctccttccattctgtggcttcaccttgaccaacgaagaccttttgaggttgccacattctccaggccactaacacttatgtcattggctacaactcagtcacatgaccatggctgcctgcaagggaggctgggaaatatagtttgctgtgtgctgggtgggtgggagggagcgtccacattagtgaacagccaggcagtcgctgcctcaaatttctttagggttatcctttcattccagcaattgaatttgatttgcactgtttcacttctctacaagggtgtaaaaagtagaggttcctcttgaaagaatttcctccccatctaattaggaataaatagtaacttctcttagaagcaaagttaattcaaagacctgtgctaacattcttaaatatctgctagctgtaatgaagaaatcaatgtactttatgttcttagctcccacagtttagcctaaatatttgccctggcatgcttatactggtccaagcaagcattaggtcatagcctgttcctcttccttatttgaaggtgtttttacctttctcagcattccacaagttacttcgtccttcctttgttctcctctgcctttgcctcttttttctttttttattttaattttttttttttaattatactttaagttttagggtacatgtgcacgttgtgcaggttagttacatatgtatacatgtgccatgctggtgcgctgcacccactaactcgtcatctagcattaggtatatctcccaatgctatccctcccccttccccccaccccaccacagtccccagagtgtgatattccccttcctgtgtccatgtgatctcattgttcagttgtcacctatgagtgagaatatgcgttgtttggtgttttgttcttgcgatagtttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacatatgtttattgcggcattattcacaatagcaaagacttggaaccaacccaaatgtccaacagtggtagactggattaagaaaatgtggcctttgcctcttttaaaaagttctaagttgctagccagtcggaacaaatacagaatgtgaggtccctttccagccaatggaaaccggacacagcagtagagtacacgtgtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagcatttctaacaatcatattgcttaagaagtggatggcaagaagataattactaatatgtctgcaattgatctgaaattgacacagttgatctaactgattcatggggaccctgggagtatgtttgtgtatttgggggttgggatgggggggtgggtggagggtcagagaggtggcaaaagcaggtgggaacagggttacagagcaaagtaattagatgccctttagatgctcttagttaaagaccatgcaaaaaggatgaaatcttttgatcatgttcttcacaatattagaggtaaaacatgaactcaacgcttttaggaagaaacaactggattgcgttttctattttattgacagaaactagatggggaggccagggtgtgttttattattgcacacatacgtaattacaaagtctttgcttttttcccctacataaatttattttgagatttaatttccaccaattagaacccgaatgaagccgttttaatgtgattcctgcatcccagcaacgtggccctgcttcttagtgcgcacgtaaagaaacaatcctggagtgaattttaagtacctaaagttgtgttagactgcaaatgaatatccaattcaatttgtaggaaactttagattaattaggtttataatttgcacagtaaggtaatgtaaatgtgttgctacggcttgactttttgcttaatcctctgagtggatatttaatctttttaatattagaattaaagcaacttggaagatatgaatattaatctaattatattccgatcactttaatttctttaatgttttaaataacaaaacaactttacaaattggtttaggttggggaacgcttttagaggattttgcatctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggtaggaagagtttgccagcccgaaaactccagtaagcaaacagctttatagtaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggctgtggttaggctgacataattatgagctgcatgtaccaatatatagctctttacccacaaaagcatgctgcaacggggaatctttcagagataataaaaggattcatcaagtgtctatacgatagctacttaaatcgctattgttttagttaggcccgcaaaacatatcccccagctatcccggtttcttatctttcttacttgatatttcaggaatttcaagcttttgtacagcttgttcagttgcatcctagaggaggaaaatgcttttggcgtgatttccatttcaagatgacaacagggagaagtctttccaaaatgcgcgtgttgcaatttcagatttaatcaggggaatacattaatttctggaactaattacagattttaaaagagtgatgggtctggtacagtggctcacacctgtaatctccacacttggggcggtcaaggtgggaagatcccttgagtccaggagttcaggaccatcctgggcaacatagtgagaccttgtctctatgaaaaaatgaaaaataattagccaggcgtggtgtcgtgtgtctgtaagtcctagctactcaggaaggtgaggcgagaggattgtttgagcccaggaggtggaggctgctgtgaactgtgatcacaccaccgcactccagcctggatgaaagagtatgacctttgtctcaaaacaaacaaagaaaaatcataaaagggaggcagaaaattaactgaagaaattgtgttataaaaggcagtgttttaagttctagaattaaaagcaattgcagcaaataccaagtgagattttctgtattttgagagtttgtgtgtgcaatggttttccactgactaatcaggctgataaaacaacctgaaaatggctttcccatggagtttatatatttcgtcagagacctaaaatggtataaatgttcaataatagccagtgaatataaaactaaataatccatatgagacaaaacaggtagaagaaaaaaacattcctcctcagatatgcaccttttaattgaataaagcaaacagtaacagtgattaccaggacacttgctgttttctgttattttggtttatattgcttaattagccagcctttctaattaacattacattttgctgagttcacattgtgataaagatgaatatcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcagaaagaagttacttcccattccccacctcaaggccctgtccaaactgaagattcatgggcagaataaacaattgctattttttaaaggtgtatgtttggggttgtttcctacagagcaatgaataaccagagcaaacacccaagggcaataaattatgaatagtgaatttaatttttctatgtgacctatggaatcagcctattttatggcagtacaaagtatatgtagcaaccaaacagtttcttctttcctaaaactcaaagtgagtcagacttcttaggcttgtagatgttgaggactaagctttgctctttatcttctctttatggatttccctttggaagcagggataagaagagggaaggtctcccagatgtaaatttctcataaatatttgagctccatttcagtaattctttcattctctgatctgttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagtaataggctgtcactagaccaaaaaaaaaaaaaaaaaaattcagcatttcttttcattggaggttaccccagaacacttaaactttggagaggaaaatagaacccctgaagaaaagtgaattctcatgacaatttgtacattctttgaagaatgactgtaatacatggaggagttaccttggacccatgtgcagagtagtgtcgtgaatgaggcctgtgccttgtcctgtggtttaaggataggtaaatgtatctggggcagagggttgcctgggacaaaggcattataagcttattcatttaacttgagtacagggtttctcaagctttggcactgccaacatgtggggttggataattttttgttgggatctgccctgtgcattgtaggatgtttagcagcatccctggcctctacccactagatgccagtagcatcccttccccctcttgtcacaaacacaaatgtctccaaacattgccaatccccctccattaagggtcatgtctcttggctgggataagtcttctctaccgtatccctttaactcaagaagtttttcttgctaagtttatgtgatcttgaaaatacggtgagattgaacttgattttctttaaaggacaaatatctgcttcttccaaattgtcataggaatagttcaaagctaaagagcctttcaggcaggctgggcacttcaaacctacaaaacatagtgctaaaattaaggagtgtatagtcgtgtgtttatagggacaggatatttattatctatcacttttgaaaatgtcattggcattatcgttcacttttacaaatacgaaggaaaaatatgaaggagttctagaaaacaccagaagtgattttgccgccatgggcctgaattgaagagcttaacccactaatctgttatgactgcttggggagtgctagcgcaggttctctaacacactgagagtcgtttggagggtagtgtgaagtggcgttatagttctccttttaatggttgagacaagaattgcctggacctcttttaggatacatcaccagtcttccaatggcaaacgtatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcttgtgataggttcaattctcaggctccttctcattagagtctttctgtaaagaccattattatttctgttatatttcctgtggctgagctgagccgcacttggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaataggcaaggtagaagacataggtggtcaagaatttagaaagacccggactcgaatcccagctctgatccatctcagctctgccatattgccaagttccgctgagactccatttactcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctggatagagagagtcaggcagatataggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaaaagagggatggaaaggaggaaggaaggaaaggagggaggaggcaagtatattagtcatgatatagggaattgaaaagacattcacgttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcaatgtttacgatatacttctactaaaatattattttattctatactaacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggagattgttatcagtcataagctttataggaaatatctccttttgaaaatgacattttaaattaatgtgaaattgtgttttaatttaattcacagggagtcataaacaggtgggagaattatggaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaatatgggtgtgatcttgacattgagatgtagagcttgacacctgcatataaagtagaaactcaacagtgtttgagaatttgccattgcatctcagtcttttttatttatatgttttttctttttttgagatggagtcttgccctgttgccctggctggagtgcaatggcgcgatctcggctcactgcagcctccgccttccgggttcaagtgatgctcctgcctcagcctgcctcccaagtagctgggattataggcgcatgccaccatgcccggctaattttttgtatttttagtagagatggggtttcactatgttggccaggcatctcaatcgttttactaagaaatttggaggccttgagaaatgggtaaacttgaaacatttaaaaaagttgttctgctaattatcctaccacgtgtgtcagagacaacattaccctcttattacttaaaagtaatttggactggttcgcacacacaaaaatagctttattaacaacttgagtaatttatcaagttcagattctttttttcctccagaaatgctgcttttggtacactgagaggtcattcatttaaagtttgtccttggcaattccttattgaatagattccattttattttatttacattttgtacaaagctgataaataactgaaaccaaattagctcaaactggttatatttctgggtacaaaccaggtgtatagttaatccattgttgtttctgtgtcgaccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatctccctctccagtgaggcttttggccactggccgttaattggtaaggttcttgaaaactgaagtgatggtatcagcatggatgcccgtgctttctgatgccactgaagatggatagaagcttcaagttatgctttgtgcagactgaatttttccaatttgtgcttagtagcatcttattatattagaccagcactgactggtgatgaatagcaagattgctcccttctaagggcttggcaaaccaagaagaatgcagtgacatatgtcttatgtcttcaaaagcaactggacacttgaagagtattttctagtctcattttgtaaacccaattacgagcggagctacaatttttatctttgtttaatgtaaccaatgaggccattgtcactgtatggagaatagctttagtccatattctctgttttttaagactctcagtctccttgcaggtgcctttggagagttaggtgtttgctgtgatttgagggatagtggccaataattttattgaaatgaatattggttaattaaagcttattgtatgccatgggccattctaagaacttccatccacccaaaagcactatgaaatagatgttgttatttcactgatggaaaaacaagcacagagaggctaaggaatatgctgaagcttgcacagctagtaaatggcagaacattcagactggaattcagacttatacactcacattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctaaaatgttaggaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatacccattcaacaattagaagctgctgatttctggacgagagttagtttatttagaaagtaacactcagagacactgggacagagaacagatccattttaaggctgtgtgagcactgatccatgacagtattggttcaggggcaaagaatgggaggaaagaaaaagacaagttatagctgcactgaaaacaaactgggcatgtcctaattttgctcagggctacttctcttagagtcgttaaggttttgagcatattaacagcaatactgatcatagctaatatgcctctatgtcaggctctgtactgggttctttgagtatactcaccacctcctgacaaggttttggcagccttacttggtagacactatgattcccattacatacatggaatgtacagtaactgaggatcactgtgatattgggaaagtgggacttcagacgctagcctccccttgtagtgcctgcattcttttcacagcccctccccaccttagaatcattttcttcaagggagagtatggtttgtgatgcccttatcagcaaaacttcagctagaagatgcaagggtgaaatacacctccccaccccacgtgatctcatagcacagaatgactggccaccccagactgaaggttagggagactgggggccccagactcaaggttggggagactggggagagggaaagcgaggaagaagcgtaagtgtatcttacagtttaaaaccataatgggacatatcattttcttagttctccatttattaataaaatgcccaataccttctggcatgtgctttgaactgcttttaattatcttcagttggatggagaaaaggtaatggggacctcataatagtcgtggagggacaactgggatttatttccatagggaaggcagagactgtttgccagggaaccaaggcctttcaaagttgaggacacttcccggtgccgtgcggtgtaaatcacagtgcaaactatgcgattatcccctgcagaggaatcgagtgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccccttgaacagtgcttgagagtatttccattataaatgtcgaatcggcattgaaggaacatctgttttaagtcaacttagactcaatccaggaaaaaaaataaatttctggctgtccacctgctcaaaaggtcaattacccacccaaatcagccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttagatatggttacccagcccaagccgcctctgctctttatagccgtgtttttgaagtgttcttattttttgttccgaaatcggaatatttcctggcgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaaaccaaatggagaattccaggagcggatttggaaacaaggttgggtctactttggcctttaagccatcactagaaacactgactcttgcgcgctagagtgatgtttttccttctcttttggattgacgtgccagcacctcaagaaacctctgtgaaaaatccacaggtcttcaagaaccagaagaaaacagaataaaaatagctcaaaataaaaatgaaaatgaaaatagagcaaacatccatttctgtgggacctaaagagttgggaaacctaaacaaccagatgatgatagctgttgctgctcttcctgaaatcaattttaaagtaggaattgtcaaagataatgagactagtatggagcaaaaactggcaattttcagttaaccagaatgttgcatgaattagaaccccagattttcctggagatgactctagccaggccatttgaggacaagttgccaaatatttgtattttagaagcctcagaagtgtgcacaattttctagttctcaacaaggcactacagcaacatgtctagtgtttatgtaaatgatctttataaatcctctagctgatagagagttttcttccatcacaggcaaaatgtgggtttagatgcaatttgtaatattgttgtacaagagtggggtcctttcactgacatatacgaagtgttgtaatacaaggcaaagaaaatacaaacccatccttagtcatttagaaagacaacctggttgagaatttaagatgatggtttagggcatagcttgtggaattcgatgggttgcactgtaagtttcagtttccttatctgtaaaagtaggaataatatctagacctaaaggttattttgaagattaaatgagataatgcgtgaaaagtgctgactcagcacctgcagaacccatgcgtcgtcatcatcacgtttgttgagggatttgaggcgtgtctaggaacgcagatgtggagacacctggagcatcttcaggagctgtttctgcggattctcatgtggcttatcaagcacaggaaatagttttcctggaaagacatggagcaaagcagttatttagccgtccatccggcactgccaacctcttcgtgttcctgcaaggattaaatgagagatggtgacagtagagagtcagccctgagggaggagtgtacaattcatgggctactattccatgtgtgtgggtcaggagacgcttaaggcattcacagcactgggtgtgaggaaggatgcaaataagcttaacttatttatgaattatctgccctggaatggcattctaatgttgtgttggaagagagacaagaatgtgctgggaggatactcagtttataacggacgttctgatggccagtgcaaatggcgccaggaatctgtgtttatagagatggagcatggatgcccctgagcacctgtgtgtgtgcgaagggtgaatgggttgctgggagttcgtcggttgtttagggaagcacttacgtgtatgcctgtgtgtgtctctaggactcactctccacttcccaccttacttattattagtgttcttgtttctcttcgctatggggaaatgcagataaaccgtaaaaacttgatagagtgaacaaaggcttcggaagcttccttagttcttataattgctcaatgggttcttcttgcctgctgcacaggtaaaacccagttcactgagatgacattatggcaggaaagaaagagtttaattaacacaagtccagccaagcaaaaggacaggagtttattattacccaaatcagcctccccgaaaatttggaggctagtgttcttccaggatagtttagcaggaagggagctagggaatggaaaatgctgattggttggggatgaaatcattgaagtgtggaaaatggtcctcgtgcactgggtcagcctcagttccagttgaatcacaagtcccaggcctaggtggggtcagtgggtcatcaaaatgcaaaagtctgaaaaccattccaaaaaaaccagtcttaggttctacaatagtgatgttatctacaggaataattggggaagttccaaatcttgtgacctcctatgcctacatcttagctgaattcagacccctctcctaatcctaaccttgtggccttttaggagctttacaaaggtggtttcatttcgggaaaggctgttatcattcttgctttaagattaaagtataaactaaattcttcccagtgttactttgccctatgcccagggatgagtgaggactgccagcccgtggggctagaagcaagatggagtcagctatgctgtcatattcctcttatggtcacaatttcacaaaggtggcttcattctcatgaccattgctcccaggcattgttcttgaataccttagaaagtttcattagctcatgtctctcctctttgtaccaccttccaacatttccctactgccttggacattaaagtccaaatccagtctgttcatcatgatctgtggagcctttgataatcgcagcctccagcttctccttcacacctgtctcctgtctcctgctttttctttttgtgcactgcccaagaaccttttcatctactaatctttgagtttgccgtcctctcttcctaaatcactcccctccctccactgttccacgtgggacgttccttccagagaggcctcccttaagcccaccttccatacctcctctggttatcctcagtcatgaggccctgcttcctcccgcacactgagcacaggcagtacctgctttactcatgtacttgtttattatctgtgtcacccagtgggacatagtagactccatcagggctgggaaggaatctgccttcgtcaccattttgacatcattatcaagtgcgcaattaggctcacagttgagctcaacataggatctgtggaaggaaagaaggacagaaggaaggaagggggaagggaagaagggaggaagggagggaaggaaggagggaataatttccaggaagcctcattggatttctttcccccttatttctgaaagctcacctctttacagctggcaaggccagcagaactgaacaatagagccggattaagcaagcattcaggtgcccacttaattcaatcggcgaatttgcatttctcaggctctgtgccatgagagcctgccgcctcaagggaccacctgccttctaccagaaggactttgctccttggagaatttccctctggcaatggtccaggtcaaacgaggtaccatacaaatgtggcttgtcaccattttccagtttaactttctcaagccttggctgcctcgatttcattccagactacagtagcagctgaaaaggtagctaccattgcagtcgaagacactggcagatgggactggcttgttggcagagatggcagagatggcagagatatgaactatctctgaaagggcattctgcatgccacagttaagtgctctgttgaaggacggctctggaagggagcatccgcgaaatgaataagaaggtggttattagtgaggtctccctgaaaggagcatagctggatgcaatccttggaggccctgtctagggcctgtctggggctccagctttcatagggccggccatcccctttgctctgggtgagatctgtctttgcttctggtgattctgatattcactatcgagaacgattgctttaaaacacatcagatcaaagttttctaaaatcagagtaaaagctaaaacctttgcaaggtcctgcatgacttgagtccctgttcctcccttgacatcaaaatggctgttgtctgctctcgctctctctctttctctctctctgcttcagctgtcctgacctccttgacctttcttaaaaactttatgaaaactccacgtttgggcttccctccacctgagatgctcttctcggctcctgtgagggctacccctttaccctttatagtgtctgcccggacatctcctcactagagaccttccctgaccactgccacatggaatagtactaatacttcatgctcatcctctgcctgccctgggtttttaatttgtgcgtgtgggtggggtggggggcgggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattactgaggactttgtggttcgaatggaatgagtgtgctgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcacaggggatgggaggggggctccggaagatccctaacccattgtggacacaccatttatgttagtggaatctggtaagagtgattgaggagagagcattgggtgaatgaccctgtaatccttataaaaatagtagcaacggtaactaatgatgtttatgaactgcctaagaatgccatgactgtgtcaagcacttcccataactagctcatgtaaagcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctaggagttcgagacctgggcaacatggtgagacccccatctctacaaacaacaacaacaaaaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttgtcttacgcacaggcgtaagatatgcatctatcttggtgtgcacctgagaagtagttatgtctaagtttccgacttgacttggtagagtcatttgatcagtaaagcgcagagcagatgaactacctggaaagaaagtgccggaactccccacgtgtgacatctcacttcggggaaaggtgggccctgcgctgcgcttggcgaaggtaaatgcacctgggtatcctcttgacctggaatggtggaaaataaagaaaacttcagcatgtagcaagtagttgtgagtacgattaatgctgtttagagttgccagttctcttacgcactcagcgaaggccgtgtggcttcgcattaatcaccaccaagccaacatgagcttccagcaaaagagcccagtgattgggaacaaattcaaaacagctttatttcattgacagacaggacctttttgttaaactgtggtttaaagacctttacatctctgtcttgttcacacgttactgtagtcatttacgtaaacttaggaactaagaaccgacttatttatcacaacctattggcaggaaaagggtcacataaaaaagaatctttattggtaggtttttttttttttttaaagctaataaacagtgctagtggaaagtatgctgttatcaaccattattgaagtaagtgggtttctggactgaaaaaaaataaagaaaacatctaaatgtcagtgtgcaaatagaaagtagcagtcaattaaatgaggcagtgtgtggtcaccatagatggccaatgtctgtgttattagggaaagaagagaagccgggaaggaggaggaggtttctggggttaacctgtgttttgctaactggtgttagttagtctcagataagagctctatgtaaaccaactttggcccaaattgactcattgaaaaacaccttgtttcaaattttttccccctctatgaccaaaaagttacccaaacctttgtgtcacatatttaaggatgttcaaggcaaccaattagtattcaagcatttagaattattttgaaacatcttctgtgaaaaacaatttatttcctattccaaaataaatgcagaatattcctaatatagtttgatagttcctcctcaagacttatcattcaaagattgggcaaattgacttgaaagagaaaagttaagctatttccctaataccaaggcaatgcaggtcagctgcagtgcctaatgtttataaaacttgtaaatgttgaaacccacacttggtctgagagaacatcatgctccagtttgttcttaggaatgtgtttctgatgtgtgtgtgtgtgtgtgtgtgtgtgtgtgtgtgtgtgtgttttccagaaaccaactgggaagggccctaagctgagattactgttgagaagtaaattgtgcttttaaagtgtcctccagcaaaatggtctcctggctgtctttggaaatgacgtatcagtccagatgccctttttcttgatggattgctaggatttttactcaccaccgatggaaaattctcatagtctggaagggtggagcgtctgccttctatcatgattgtacacagatgagcaaagctccttggcaatgagtgaggcagacgggcagtcaggttcggactggtgcagcaggtaggctgctgctagggaggaaggaagaggcacagaagttcagggcgtgagagggtatgcgagagatgtcaacaatccaggagctggcttgcttcttcctttagtcagtggtgcaagcttcaagtggataattcaaatgaatcaatggaaaggcctcttttaacatttgatttgtttcttcaaagaacacagatgaagtttttctcatctctttagattagtgattctatattggtgagggagtggaagagaaatgtgggtgtgttgactatattctccacagaaactttttgaagtagcatcctcactcagcacagaacattttgacaatacacttccagggcaggtggtttcttactatgtccctccctacccccacatactttgggactcagaatgtagggagtgtactctcgagggatgcggcccatacgtgaatgcatggaggcagcatataaggttgcaaagcactgaccttctctttttatgattcccatttattccatagactgtgaagtctgcctgtacatttccaggctagcagtttttaatcaaatgtatgatcactttcttctgatgaacacagttaaggggctttgttgttcaggtgagtctcacattgtactcctctcctaagagcatttattattacttgctacatacatttttgacaacctgacaatgacttttttgtcttaatttggagaaaacatactctgagcttttgaagttggtgtacttgttaaaggaagccagaaaagcttttcaaccatttgagagggtgtgaaatacagaaggggttgtgcgtttcttcccccctcatctcttagagccctgttacccaagagagttcaccaattacccaaaccaagtttcattttgttttctctctagtttgaaaactgtttttattgcttcaactctccttgtctaggagagctgtttcaggtttttagagtcctaagaaaggcttcactggctctctgccagcctcctgtcccattacacgctcaggcttgtagtcagttactctctgctggttttgctaaaccactcttgggtctttcttggcctcctgccccgcattccccttcacgttgtaaacgtagctttttaagttggtcccttgattgcttcaagtaattgatctgttggcctaaaaatgagtggctctgattcagaggtaggagttaaaccagattctgcctagggacaagtgtgttgggagctctgcttctctggagacaatggtcagcagtgttgcaaccaactccatgtctggtgcaccagatggtctcattgggtggtagggtggccaaaccttgtgtgagctggctcacttgttcattcattcattcgtttactcgttcttttttgtattagcttaaaaatgcttatacgccggccatggtggctcatgcctgtaatcctagcactttggaaggcagaggcgggaggattgcttgagtctaggagtttgagaccagcttggccaaaacagtgagactccatctctacaaaaaaagaaaaataaattagttaggcatggtagagtgtgcctgtagtcctagctactcaggaagctgagatgggaggattgcttgagcctagggggttgaggctgcagtgagctatgatcataccactgcaatctagcctgagtaacagaatgagactgtccccccaaccccccaaaaacagaaaacagtattcctatcatatgcattctcaactctgcagaggtcctgggtcacatttcctgcaaagttgcactgcctcccataggcatgagacctccacatggacagaatttcatgagtgttcaccttggtgttgctactttgcaacatagacttgaagattcagagaggagatgtggtaagagtttatttctggacagagaaaagctacaccattcatctagatctcattaatctgtattcattttgacatgcttttctgcagttgacgtttttatttattaagcgctttacaagatattcagtatcattatcgaagctataattattaatgatcaaagttagcagtacttgttttagctgtcatcttcatcatcaccatcaccatcaccatcgtcatcatcagggccacaacagcctcttcttttctcttaaatcttccagcaattcttcaactttgcctgtatatttatcatacaacataatcctagtatttagtaaatgcttagtctttgatttcttattttcaaatgcatgtctttagaaccagaatgtgtgtagctgttttctggcctgaatttgggctgagatgatgagaagtttagttgccactttcagcttagtggaagtgttttccccatttggactccgggtcattgacaaacgtcatcactgtttttagttgaaatgtgcttccatgtggctgttcatcagcacacccatatctagacgtgtgctagcctcagtgagagttgcagaatctgtgtattcatttcctttatctagaaatcctcattatggtacataaaagagctttctatcgcttttttacattatagtagttattcgttattattattattattattattattattattattattattattactgagacaccgttttactctctctttgcccaggctggagtgaaatggcacgatcgcagctcactgcgacctccacctcttgggttcaagtggttcttctgcctcagcttcctgagtagctgggattacaggtgcacgccgccatgcccggctactttttgtatttttagtggagacagggtttcaccatgttggccaggctggtctcaaactcctgacctcaggtgatccacccaactcggcctcccaaagtgctggggtttcaagcatgagccaccgcgcctggctttgttattatagagttatatggatttatcattttaggtggagatttgagtttatgtctcctacagacagccgtagactttgtttcattttaagatcagtgttgcagacgctgctgagtgtctccaaatgtctgttctccctttattacctactaataaaatacctaattttcaacagcctgggaagagactatatttccctgcttgcctttgcagctagagtgatcctttgatgaagttctagtaaatgggacgttagcagaactgtcgtatctcagggcttccgtagggtttataactgatccactgagagataagttgagagcttgagagtcaacctttagaaaagttcgtaactatttgtcaaaattaagcttatgtctgttccaggtagtaattttaaaatgggcttatattttgtatgtcctttttaatttcctttttctagcaattctcaatgtttttttaaaatctcttctggaggagggtacccttcacaaagttatttgccaaaggtctgagaaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagtccgagcaggcaactccgaccccaagttggagctgtgtgttgaagatagaagagcaaatatgtagaaggaacctggatttctatttttttaaaaaatataataaatcatccagccccaaatgtcaggaacctgggtttctaatgatggttggctgtcacccccatttcccacactttaaatgagagaagtaaacatctgacttcctaaaaccaccgttctcactcaaagccgaatctcatcctgactgaaatgtcactagtccttttttttttttttttttttttttttttttttggtcatattttctccatttggagaggctggctgacccatcaatgggcagtgtgggggaatggagagacctgggattttggggacaacagtgaccatgaggggatctctacactcctacttggaaatggagtagcattctacacttaagtatctccctttataagctaggaatactaagaacctaagagtctccatgaggattagatgaggtaatgtttgtaaagaatctgagatatagtaagttgatcagcatatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacattcgactattccctactcctcagtgaccccaaagaccccagagaaactcagtatgaaaaatcactatggaagtgcaatagttattactttgtttggaattcactacaacactgtttctcaaaatataattcctgagtcacttggaagattacaaccaactgaattagaatctctggaaggcatcctaagagtctgcatttgtatgaagcttcccaggtggttctgctcagccctaagtttgaaaactactggcagaatagtagcagagttacttattctacattcgttttttaacccattgtaaaaatcatacatgtatgttcaagacaccggcagatcacaggaagggaaaaaaaatcacttatgcttccaccaccttaacctagaaacctttaggacttttcagtacttcctttctgtctttttcccctatacctaagtttttatttacaatatagttgtagccatatgattgttgctttcattgttgcttacatgtgttaaataattttgtctctgtataataacaacctctggcgatttttcctttctctctctctcttttttttttcttttgtttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaaacatattaagttatttttcagaattatgttttttcctgttgcttttgactgtaaagggcagacttaaatttagttaacatctgctctaacgttggatcatgtgtggagtccccagttttcaacattaaaaataaagtatttgttgaagtggggtttttttcttcttacagtatatgtagaaccattttcttgaaaatgtttcttagaaatttgttacttagaagatttgagccaatgatacattgccgagatttgtaagagtaagaccagcctacgctgagtattattttctcaaaggaatattatgaggcacatcccatcttcatatcagggaacaaactgtcacattttagtgaaatctgtgggttatgtgtgaccacacacagtgtcgtgtttgctccctttacagaaatctaagtaaaagaatcactttttcctagtatctggatgacttgatttcttactatcttgggccttcttggaaaccctgaaatgtagccttttcatcttaattcacaaagtgttcattctcacccttttccttcatgagaattttctgaagctattgtgaatctatggaagactcaaggtagtatctttttcacagcattcaaaaaaatgctgctggctccttggcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagccccccacttaggtgttatgtgactgtggtcgggttattggtaacatcttcttgctcagcttcctgacctgcagaatgggaataagaatacctagcacatagggttataatgaagatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtatgaaatgactgtttttatagggaaaaacagtagccgatcatcaattccctaaggttccacgtaataatttgtccaggtctcatagcaaaaaggtggccggatgaggatttgaacccactgctctccaacccctaagcccgtgctttgtagaattaatcggagctctaaagtacttgaccctgggcctgacaccaatcaggagcttaaaacccattagtttcttttttgttttatttttgcccactattaaaatgtgccaaagtaataagatcaaacagggcccctgcgttttgacaaacatccgaattctgaatttcagcgtggaacagggcatggaaagcaaacacaatggggaaaattgccgtggccggtcccgacaatgtgtggattaaaaaaccacacgcatgcacagagacctgatgtgaatggtatttctgagtggaagctaagtaggagctgaaaatggccttttaaaatacagaacataaggatgcaattcacagagatggtctaaactgtaaacatgcagctgtggggtttgtgaggctcattgcttacataccgacagcatacaaattgtcaagtacttaaagttccattgttgctgaaagggcctccacccaatgtccttaaatggtcccccctttttttttttttttcaaaccacaggatttacatctctcgtagcatctaatgaaataccagcaagaattgtgtgttggtgtaagaaataataatctttccaaatccttttgttttgttatcatttgctaatagagatctttgaaagaaaattcaaagattgaagtttgtattctcctaaactcctgcaaagaagtcctgtgcaaggatcgttcactagtgttctgcatcgttcttcttactcaactctcccgagaggcattgtggacgcctgtggggttggtttttggcacccatccctgaccccttcttctccaggaaactctgttcctacctgctcctcttgtggctaccttgggaggtgccatttttatcaaggttagtgtgtggttaagcaccttgccacaagctcaggggaaaaaaaggtcccctccccagattttttttagaactggaagtttccatttcctggcactgctgaaagctctaggacataaaacttgggagccgatggccttcaggctgcccataatgtgaagagaggtcatttcagacattcagataaagtctgtggctccagtatttttctaggtcttgctccctccctgaccttttcacagtttggtgacacaactcttccttgaattccataggttgacaaattcccctgagtttgggttagggttttgttacttgcaaggcaggcatcacagggctgctcctggccatgcatagctttggaatcacttctctgattctcatggctcgggaaggagaaagtgtcctgtgtgtggagatggcagggtggctggagttgagaggagagtcccttgaatgccacgcaacatttctctctgtaggtgtcctctgcacactgtccaaactccatttttaaccttgactgcatagtaccatgtacattcattaagcatccctcgccataggagaatctgagttcctgggagcatttaacacagttcctggccttgagtaaaaacttcataagcacttgttgaattgaactgaatttgttgtctgtgtttaaaggacttgatggataaagggagatttaacagtttatagccagattggactcaaccatgatgatttctggtccatcttttagaatggcttcacttctcttggcctttatttctccaagtggtgataatgagacctatccctaacggttaaagtgacatggtccatttaaagtgcttaaaccaattgccaggcacataataggtgctcaataaatacttcctttatttccctgttaggcctctcccaaccagagatcaaagatgattggccctgaagttatttttccccccaaatttgatagaaatcagtagagatgctaaaatataatacatttgacctgcattgatcaaggtaggctaactgctataacaactttacaattagtgccttaacataatataaaatgacttcttgttcatgtaacatccaaggtagctgtacctagttgcaatgctctcttccaagtagatatttagggacacgggctccttctatcttctgtcaccaccacctttatttttagcatccgcggtcttagcaacagtagaaggaaagaatggagataagacagtgggtatttaatcaccttagcccataagtgactcacgtcacttctgactaccatatccaatttttgcctctctttttttcttgggttccccccgacaaaaaaaaatatgacagaagtatcacccatccagccagccagccatcaatccggtatccattcatccatccatccatctaggcatcccaggtgactcattcctgtgaccttgggagacagtctttcttcctagaggttgtttgccccaaccccctgttacattcttgaaccatatgtttcccattgtttgcacttcccctagtcacctggtgctttaatttttgcctgtaaccttctgaaactttccttaaatgttcggctttgacctgtcattcactaagtctttcaccatccttcactcatcttacctccttcttctgtggcatttcataaatttaatgattgtaattgtgattacaacataattgtttgtgtctaccccaggctttgcaacagggaactatatcattattttgcagacacaacaaattctgcaagcatgtatctttggaataaaggagagagggttggacacaaatgtgattacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttacgataccacgcactgctttaggcactgggaatatagcaggatatacaaaacagaaaaatcatggccctcatggattattggttgtgagtaataggaacctttcaatctaacttaggaaaaaacgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctctgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatagaattcaattcttctcttgccacaaatcagctgtttatactcctctttgcacgttgcagaagatcaggaatttgcacattatagccacaaccatacccagaaccagattgtctaacactgaatctcgaatccaaattcctggatttggatggactcaatctggacccagtatctacatttggtccagtcatctgtatccggcatcggggtcttgttgaaaaaccatggcttagccgggtacagtggctcatacctgtaatcccagccacttgggaggctgaagtgggaggatcgcttgaagccaggagtttgagaccagcccgggcaacacagggaggcaacatctctaaaagaattttttaaggaataaaaaggaaaagcatggcttttattctaagagcaaaggcattttgtatatttggcaggtatcccaacagatgcatcacccagtctcttaaattaagataataatttatttggcaagtgaattcttctagtgtagttagatagtgatgaaaagatttttatacctccaaacacacacacgcacatgcacacccaccaggctcttctttacttctcactcatagatttgaaaacaactattatattatagaagttttttggtatagctgccaggggtcattgtttccatcccctgtgtggagataagaaaatcgagatccagtggagtgtggggtgctgagagaacaagtctatgttttcttgagacaaagtcttgatctgttgcccaggctcgagtgcagtggcagcatcttggctcactgcaacttctgcctcccgtgttcaagtgattctcctgtctcagcctcctagggagctgggattacaggtgtgcaccactatgcccagctaatttttatattttcagtagagatggggttttgccgtgttggccaggctggtcttgaattcttgacctcaggtgatccatccactttggcctcccaaagcgctgggattacaggcatgagcctaactatcctcattaagccatctgctttctgcagtcattttcatggcgatgtgttataacaggacagaccttgtactttggaatcaaacattctcaactctgctatctgctctttgtggggccctgaacaaaaatctttactctctttgagccttcgcttcctcattggtcaagacttttctcactgcattatatttgagtgagacccgtatcaatggattgaaattctcagaaacccaagaccaggaatagcccagtgacaggaatttagaccatgccaagtgtgaaccatggcttgcgggggctcctgtctcacgctggatgctcctgcctggctgcctctggtctccagcagaagacctgtcgtgcttgagtgacaaagcagattgcttcctcccacctctgtgggttaggacccctttttctatcctagtttcactctgatgggcgagttcactcacagtgaaaccgtagcaaaacctcaaggtttggcttaactgcaaaggggtggttgatatcagattcatacgccagaaccagaagaccactcgtgagaaattctgtaagcacaggagtgtggtttatgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagcggagttccagagcatccatctcctttgtaagacacagataataccaactgcatggatttgttatgagagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcccgagtgttttgatttcatcctatacctatagttacaggccatttaagatccacagtctgctcttttagcttctgccagcacatttggacatctgtgcagttcccagggcaggtgaagagttgttcatgtgatgcaaacttttgagaagggacgtgtagggaagatgggagggaggtgatatttattgagtattttctttttgctttcagctttataccttgtgtgtgcttacagaggtcatgaattgtccgctgttgtatgtgtaatccgtggcagatgtgcataataagttcaggaggggctcggttttgggaggccggggatactagaagataaccctaaaatgtggaaatctacatcagagagtggtgtgagtggttcccaaaatgcctacctggcactcctaccaaagacacagcagagaacttggggcctcttgtttcagccattttcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgacacttccagatggaaatattaagagccagtgtgtggttcaccctgaccccttcctatgccccagcaattaaggaagcaatgttcagatgaaacccatgtcttcctcctgggtccctgagtgaccacagtcaacagagcttccctgttggccattactaatgtcaagaacaaagctgtgtaaagtcactaagattttggaggtatcggctgttgcagtagaacctagcctatctcacctgacacaaacgttttctttctcacaaaacctcacaccagtgttgttttattcatctgcttatgcacgcgtatggctgcaacatccttccaaaatgcattacaggctctaatgcacgataagacagttaggttcgaaggaaaacaaagacaattgcacggcacagagggaatatactgctacggtaaaccgatcactaacacccggccctgaatttgcttcaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggttaaccactcgcatcagttttaagtctccacaggcagaaccagaccatcgtgaacttcttgatttacatggtggtggagagtggctgagaaaccagggagaaacaggaaggagctgattgaggagaccaaaggagggtggggccgcagctctcaggcactcttggtgttcagaaggccagcttgaagaaagatgtgcatatttgcaaatgcatttcttgttcctagtgaagaggtgaggaaggacactgactgtgctagagctgtacaaagagaagtagaactctaaatagagaaaatatgtaaagatcaataaatcacaccaaaaataagtcataagaacaacaaataataccaggaataaataatgtaaaatataaataattcctaaaatggtgataacagcttatgacaagtaatttcttttttttgagatggagtctcgctctgttgcccagggtagagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcacagtgactccttgttagggtttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctcccaaagtgctgggattacaggcatgagtcgccacactcaattatacacttaaatatacatatatatatacaatatacatatgtaaatatatctgcatatacatgtttagggacaaaaacacgggagtaccatttctgtctttgtctctctctctctttctctcacttgactctgttgggagctatattagttgttttctctttccaaaccaccttctggaggtctcttagattttcccaatgatgaaggagctactgtctaggttattacagtagtaatagtggccaagaaaatgatatgaggttgaagtggacagatgatgcttttcactcttctgggaggttcccactgggtggtctgctttgctgagctttgaaaaagagcttttcttcttcccagttcactgggccgatgtgggcacagcctcaggttttggtttttttctcctttgctccttcaccacctagaaaactaatttcctataaagaaaatttctctggaaatgcaactttctcaataggttgagtctactcaaagactgacaggtaaaagtggtccacatagaaaaacctgtttctctattttgttttcaaaattatatcatctttataataactgttagtacctagaaaaatgcatacattttattccttaccaaaaccagttaccctatagtcaaaaggcattcagaagtattagcagaaatgtagtcagtagccaggcatagtggctcacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtggcactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgagaaagcgtgtcttctggtatgtttcttgatacattttgagggtattgagctctaatttacttaagatgaccttttgaaaatagattaacttatcaaaacttgtggtggaagcaagactttgtcagtacagtactatccaaattctaaagtaatgaatgcttctctccctctggagttagagacctgactctggggtgtggataaagaatttgtgtcctggccaggtgcagtggctcatgcctgtaattccaacactttgggaggccaaggtgggaaaatcactagagtccaggagtttgagacctgcttgggcaacatagggagactctgtctctacaaaaaataaaaagaaattagccaggcatggtgctgcatgcctgtagtcctagctatgtaggaggctaaggcaggaggactgcttcacgctgggaggtgaaggatgcagtgaactgtgattgtgccactgcgctccagcctgggtgacagagtgagaccctgtcccaaaacaaaataaaacaaagagtttatgtgttcagtaagagctgcagtcacatctctagtacagactctgcagagcactaggaagccccgtgtctgaatgggatatggtgagagaggcagcctagggaatggagatacctgggggtccccatctgctcctgatggacagctcagatgaccccaagaccctctaccaggcactgatggagtaaggatggagatgggaattgcattttagaggtaagaagccaagtggcatgatgaggagagtattcatgaaatttatggaacagtctgggggaaatgccatgatttcaagcccttcacctaaatcttcaaaagtggcatggatcagtgcctctcttccccagccaggagcgtgtgaagcatggggacctccggaatgttctcagaaaatgcttggttcttcctgtgttgagcagggaagaagctgaagctagcatgggcaggggagaagaaagccagttacatatcaaagaatgcttatctccgtagacaccactgtgtttgagagtcacattgggtggtttgtaggcagcttttcattttcacagccagtcaggcaaggcttggaataacttgtctaagaatcctcatcttaaccctgtgctagaacaacaagcttggaaggagccagccaacaggagaaagccagagcaagactctgtgctggacaagaagtcctgagcactggggagttgacttcatattggaggcagagaagaattacctgccgatggctgttggcccatggcaacaccctagatcgttgcatttgtggtcctgctgaaagaggagacttaagttatagagttattggtacttgcaacactttctctggaatttggccatttctctgctcttttagtttagtacgttctcttggttgcgaggaaatcactgaagccacctcacgtaatgtgagcatgtatgctcaaggggaccaggaaatgctgaaagttcaggcctcggaaaggacaggatgtggaaggatgttctggactcaaggaggcctagggacccttggcaggaggcattcatgggtctgtagtccaaggctccactaccatctccttggcttctctcttccattctagcttcttctgcttattcatcacttttgcttcctatgaaattggtgcatcctggtcttggcctctttgagccctctgtatagtgtgagctcatctggtactcttgactctctcaggctcctgaaggagaaccatcagatagaagcatctcatctccccaggccatgccactgggcctcagccaggcttgaactagctaggctcagtccacggggtggccttcaagcagcctagacttggatccctaagcacagcctgtggatgggacgttttaaggtaaagggaggacgcagagcattgcagcccgttggttgttttctccagcacagccatgcaaaatccatgtagcggcaggaattttgcagctggagttgctcccctgagactctgatcagataaagacagggtttgctgaacaccgtaggtctggccctgagccgtgggcagcctgatgagcacaggtgaatggtgcaagggataacctcacagtcatcagcaagtcttatctgggccgctgcaaatatgacggagtcagaaaaatgacaacataaagaaatgcgatgttttctatgggggtttctttttgaaactaaaagaggttttctagactcactccatggagaccactttactttccatttttctcagatgataacatctgcaggggggctccttctgtgggtacatcatttgtcaaatatgtggtccatattgagaaccgcataatacttattaattaccacagttgctacttaccgtgggctgctaagactgctttagatatactgcagatattcaaagagaattcatcgtccacccaacggcaaagtccatagaagcccaggatgcattctgaccctcatcctttaaagcttactgaacatattgatcacctcttttccaaaggatacttcctattggagtgtacttttaaaatctattttttttgtcttaatgtttagtgtaatgagggagtataggatgaactcaatgtaccttgaacatagctgttgtcaggaatgaagccaatttcattttgcctgaattagggccctttggtgtcttttctgtatgcagttaatacagttcgtgtgctgtaccaagggtgcgaatgtgacttttcatcaggaaggccgcatatggtgggcacagggcctagctctgccgttttatagctgcataactggtttcttgaccttttatgagtctctactcatgttttatatggagacattagtcatctcacaagatttttgtaatgattagaatatttgtaaagttcctggcaaaggtttgattataaattagcgtcatcatgaacgttcaaggtggggaccttttttttttttttttgaggcagagtctagctctgtcgcccaggctggaatgcagtggcatgatctcggctcactgcaacctcctcctcctgggttcaagcgattcttctgcctcagcctcccgagtagctgggactacaggcacacgccaccacgcctggctaatttttgtatttttaatacagacagggtttctccatattggtcagggtggtctcgaactcctgacctcatgatctgcccgcctcaaagtcccaacgtgctgggattacaggcatgagccaccacgccctgctaaggtggcaatctttatacataaaaaacaggaatgacttcttcgaattggtgcactagagaaatgttttccagtcgcctaagcgtttaagcatggtaaacagattaccatattagttgcccagaccttgcaaaacttcatagtgtttgtttgtttcccttgggaggctgttctgagaaggaaccttttcattcctcggagttctgatgtgttcattggcccctgttgtcatgctggatatgggggcggttcaaggggggcttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggctgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtggatataatgtgttgcattggtgtctaaagccatgctcagtatatagttatatatttcattcattcatccgttcattcagttatctcacgtttctggagggccctctatgtgcaatacctagtgatacagcagtgaacaaaggaaatccctgccctcagggagctttcattctacttggggaaagagacgtgaaagaaatcaagacatgcaagcaaggataagtgctgtaaagataattcattcctgtttagagggctgaggacaggaagacgatgctgtatggctctagacagggttctgtgatgagtggcctgtggacagattcctgtccgaagaggtgcagggtgcaagggaggaggggacggcaagtatcaaggtcccgagtgaggcacatgctcggcggggcccaggcatgccaccaaggccaggaggagagactgaggaggcttggccatgccctgccttgttggtttttagaaagactctgttttggttattttgtttttctttttttgagacatctggagtgcagcggcatgatctcagctcactgcaacctttgcctcctgggttcaaacaattgtcctgcctcagcctcccaagaagttgggactacaggcattcatgccaccgcacccagctcaaatttttgtattttttgtagataccatgttggccagcctggtctcaacctcctgacctcaggtgatccacccacatcggcctcccaaagtactgggattataggcacaagccaccgctccaggcctagaaagactggattttaccctgattgagcgagggaggctctcgaggttttatttggttctgcccagtgaccagccaccataaccacatccttcccccagactttttcctcttcctataaaacaaaacaaacaatgtgaacaacaaaagcaaaaacaaaaaactaagtagtagttggggcatttttattttaatgctgcttttttttttctcaccttttgctatatgctgatcccagtgcatgaaatttttttgtaatctcattcctgtgttgaagctctttcactgctttcgtgagcacagatgaatttgaaggctgccaggcagtagcaacatataccagcttccccactgggtgttcattctacccaatttttgttcatgtggacttcaggaatctgggatttatgatcttcggatttggctcttggcttgaggcttagcctgtgcagtcatcttggagagagggtttactaagcaaagaacaccccagaacaatctgggggaactgtgccctttgcaagagagcagttttaaagtaccctcgggcaatttagaagctcctactgactcaaggatattcttacctcttcgttaaagcagctcgcctaaggactttgctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcgtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaacccctttttccagtaaaagtcgttggcgaggagtgaattgtgatggaaacagagacagatgtatgtacctttcatggacataatttccccaagactgaacacaaaaatgagggtttttggagatctctctggaattaatgtaaacgttgttgaaaacatattattctatggctccttcataaaccctaggccatcccgaggctgtctcactcaggcccctcagccctcataaccccccagctccataggagtggagtttggatttcaactagataaggcccattttcatggatggacatgtgagttttcatctataatatagaatgctattttctagttaggttggagcaaaagtaatcgcggttttcaccattatattcaatagcaaaaaccgcaattacttttgcaccactactttttacctagcagttcaacagctgtaaagaaagatgctgagctgttggttacgtaactgtggtacagccatttcatagacaagtctacatcaatgaaaagaatgacacttctaaaggaaaaaaaatgggcaaaaattatgtgtttacatctatcagaaaaacaaaacaaatgtcacggtgtggttgggaggaggtggggagagaggcagattttggaggcgaaagatacacagaaacactaaatacctgtctattaatactgacagtagttgcgtttaggggatgagactctaaatttgtttatttaaattttctcattttaaaaaatgagtcctttcaattatgagatcaaaaagaaatgttcagtggcttattgtgacccaacatttttctgtttgatttagatagagcttttatttgcctaaaaattgtgcttgcaatatatatgatgatttttttttcttttattaaatgaaaaagagtcatttaacagtcacagtggctcagccaccacccgcagcaggcagtgggcccacttcaccttcccagcaggcctccagtgcccggtgcagggtggcccattggcacccacaacaaacatcacgacattacttttaccgcacacttcctgtcgaggcacaggcagtgcttcagcctttttggtaacttgaatgaacatcaaaaggataatcagatattagttaaacttgttcctcttctccaatcattgatacttttctctcttgcttcccctccccctgcccttcgacacagagtgacaggcctgaagtaaaaagggaaaaggggaaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcatttacaaacaactgtgcatgtagggttgcttgcaaaagttcgtcgtgtgccgatatttcattaccacttttgccagcgctctcgtctgcatttcctgaggtttttcttttttttttttttttctttttttctttgatacggggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttcaccatgttggccaaactggtccagaactcctgacctcaggcagtctgcccacctcggcctcccaaagtgctgggatgacgggtgtgagccaccgcaccaggccatttcctcagttttaaaaagcaaataagaaacaacaacaaactgcatcagagtaaccgtttcaaaaacccatctcaggtctgttttttcttttttttttaagttagcattttctagaagttttggtataaaatatgtacaaggatacatatataaacttagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtgtcatcagcccaaaccagatcagcgtcgtgggcgatttttttcactttactgctgaggggatttgccaatcgcctggtcagcttctgaattcttcgggcacacaggaggggcgacatggttctggcttatttctaagtccctttgaggtgatttctggtccacaaattgaggcaaaataatcctcacaatttcttggatattctctgccccagccccgttctattgcaaaggaggcttctctaaaaggcttcccaatgccttagaatctacttaagggtatttttgctggagaaagagctgctgtctttgtccacctgtcgttttcctttctaccccaacagggctttctccctctggctgttttatttagcgggagaagacagaagagatggaaaaatggaccctgcatttatagctgttccttcaaggagctcaaactgctttcaggcatttccttattacctcattaatcctcataatggtcccttggcagaattattcttattttcagaatggagaaattgaggcacggacaaaataaatggcaggtggaaggtcagagagccaggcagcagaagaggtgggggcagcaggatggcttctggtttctgccctggtccatcagtcagaatgtcctcttcagatgaggagatgcagggtgaggcgcgggggagctgacattgcataaataataaaacaaatggagccacatttagttatcactcatctagcggaagtcgatcttcttgggacatgagtaggctctaacctggcaggtttttcaacatggaaccattatttgtcacatgtgttctgtgtgccagggactgagttcttctcaacggagtttacatgtgagaggagcaagggacaaacctcacaaataggaatacagacctcagaaagccgacttcacccttgcatactcctccaggttgccctcgcctcccgcctggatcactgctcaattctctctctctcttttttttttttttttttttttaagacagagtcttgctctgttgtttaggcatgatctagctcactgcaacctctgcctcccaggttcaagtgatgtttcccacctcagcctccctagtagctgggactacaggcatgcgctgccacacccggataatttttttttttttttttttattggtatttttggtaaagatggggtttcaccatgttgtcaaggctggtctaaaactcctgacctcaactgatccgcctgcctcggtctcccaaagtgctgggattacaggcatgagccacagagcctgaccacagtcctttcttttaagggcctcctggcacccagccatgttgggaccctttcagttctttctccacggagaaccagaatctcctttgaaaatatgttagatcacctctttctcctgctccgaactttctgaaggcgtcccctgttactcggagtgcaagccatgctctcgagctggccatggcatcctgcgtcctctcccttcccccattggctctgttcttcctgccagtgctcttccccctgctcactgggttccagctgtgcgggcctccctgctgttcaatggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctgctttatttttctccatattatcattgccatcaatccaagcacaatttccagttacttacccattttgctttctccccgctctttgagaatgctggctccaacagggcaggtatttcacctgttttgtttatgcctgcatccccatcactaggaacctcataggtgcttagcaaatttttgatcttaatacagaaattgactctcacagaataagaagaaggagcttgaagccgaggtttgtgcccagaagatctcactagattctttatactctggggagaagaaaggatcagggtcgggtggggacatctgtgggcatattggggagggggccaggaagaagccaggaagggggcatgctgtcattcgtgggttttgcaactttctgtggcatagaaggcatagaaggatctcttcatttaaaaggtcaggttggattttttttttttaacttcaacaccagttaacttacttgcttccatcataccctgtaggtactcgttatggacaggaatacatgtagggtgaaggctgctctgggtcagtggattcacagagaagtcagaattctcttttataaagagcctgcttttctcaataattgcataatgacgtctttgattcccaggccctcatgcctagctgtttccttaggcatttattcaagatccgagatgccattcgcaatccagcaggatgcatatttgtatctggctccaaaactttttttttttttttttggcccacatcactgcagcccatggcagaagagtctagcaattagcaggaactgaaagtgataatttattgcaaccaacgctgtgatctaatagtcacacattacaaaagcaaaatccatattttgttcgcagtggcaccgcagcgctatcatatgctccacatgctttctaatgtcttttgtttgtattaggaaaaaacataaccctctcctactgagaaccagagagagcccctcaggttctgagaatgacgacattcaacatcgtactccaaagggggttaggtttgtgtgctaggggtgaacgctgtgcaatttaattctgtttccaaaagatctttggaggataaaggatactttctgtcttttatttagggaaggcgatcatgttggcacagggcataagagagtagcggggctgagagtgggaactgaggagattcaagccttttgcccgtcgatcgcagttcagatctgttgattttgaccattgcatcttgcctcacatctgaacttcaggtgaagtttcaaaccaccaggcaacatgcattacaggcaaaatgataagtcaggtcctgccgggtgactaaggcagtgtggcaatgcttcaagcctttaaaaccatatcccagtggccccaaagcattaatatgtctggaacattgcctgtccaatatctagagaggcgcctgcagaatttgattcctaggtacatcaagtttttgagctggaagaaacttgagacgctctttagtccagcaaatttcaaacctgtctgctcatcagaatcacctgggagcttgaaaacacacagatgcctgggcctcaccatccagagagacattcatttgattgcagattgaatccagaagctctaagcagaggcacagtcacatttggggactccttttatttagtagaggaggaaactgagtctcagtgtctgagacagacagtggggattgaacacagacacctgactcccagtgggtggtattttctcctagagtgcatttctgcttcttaaccagcagaagaaagcccattaactaacccctcaggggtcaccatgggcaaaggagtgcatattaagaactgtctggaaagaaaagaaggtcattggaatcttcttcaccccttccctggtactgatggttgcatttcaatggatttctccaaaagcaattatcacagtgttcctgtgtgttgagcaaacttcccttgtaatcaccttagcgttttcttttgttaaagagtaagaagaatggtttcatagtgaatttttcctaaaatgtgcagggtgtagaagaaggaattgcacacaatacatgtctactaggcaggtcaacataaatgagtagaggcaggtaataacccagatacactttgttggaaagtggaatgcatagaaatggtcttcatttctgcaaagaaaaatgtacattctcctttttttccttgcaatatgttgccttctctgtatatcttttaaaatttctacttctgatagagtaaagggtatagttttgtccgttttgtgttgctataacaaaatacctgagactgggtaattcataaagaaaagaagtttgtttgattcacagttctcatgcctggaaagttcaagattaagcatctggggagggcctcaggctgctttcactcctggcagaaggcaaagagaagccagtgtgtgcagagatcacatgggcagagaggaagcaagagagaagggaagtgccaggctcttttaaacaaccagctcccgtgggaaatcacagagggagaactcactcactaccatgaggatggcatgaagcccttcatgagggatccgtccccatgacccagacacctcccggtaggctccatctcctgacatcttcacacaagagatcaaatgtcaacatgagatttggtggggacaggcaaaccagatccaaaccatagtgactatgatatatctttcacatttctctttacaaaaagaaaaacaatgtaaggtcccgtgacaattagccttactgccggggagaccataaggagtggtggagactgtggtaaactgcagcgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtctgaaatccatacagtgggcagtcgagagaggcagacaggaactcttggcatatgctaaagctgctatccacaggcagaatttcttcttctccaggaaaagaaacagttcttctcttaaaatcttccaaatgattgactccgtcacactcagaccatctaagattatctcccttcctaaaaggcagctgaataagggcttcaatcacatctacaaaatactgtcccagcaacaccttgattcatgtttgactggataactggaaactatagcctagccagggtggcaaacaaaatggaccatcccagggtagatgttaaaaaaaagatacccaccaaagataaataagatcaagattagaatgtcttcttttgataggatgtctgatttttctgaatttttgttcctaaaacataagattatttttaaaagcctgagaaacgagacattagtgatccgattcagaaaagaagccctgggtttaagccaatacgagatgggtttgtatctttaagtggcctttattaccacagtaataaacagcaaacgggcccaaatcttacaggcttgtgttggctttgaccaatgaagtagaacaagacctctgaataccccgttagttccaggctgtgctttgatggctctgcacagacagctcttttcctatacaagtcaccagcctcacccgtgtctcttaacaaatgttgttgacaggccgcgttgcaatttttctgcatgttctgacagtttaattcagtacctcctagctaagcactcagcctaagggggtgcttcagcaccttggcgtcaccaggctgcaattaaaataattcagggactggggctgggcttgcagaaataggccttcttccctttggaacatacaatgcattttccagtctccccgtggagcacacgagatccttttagagcagagggcagtggaatgtattaacaagatgtccactggcaagaactagctccatttgtatgttgcacccaacggggttttctccataggggttaggcgtaacgtctttggtaaacttggcacctgtagaaaggtcttgtggtgggcaggggggtgtgaatgggggaatgagaactagggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcaggtaaggtggaatttggtaaattccccaaatttacaaatagatgaaagttgggtaaattccccaaaattacttgatgacaaagatcatttgggagagattctttcaaaaatgcctactccctattcccatatcccagcctaagggaatgagtttaagtgggtctacagtgggtcctgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagaggtaggaggtacataagagaaacgtgttttatggctgtggttttcaagaagtacagcgttttggagagagtggaaggctttcatgcatgaaacactcagggaggtaggagatccatgagatccaagctaaacaattctggaagagttacctgaagttgacacttaattcaagctgcatcatcttcctcctcccagcagatgaagaccaaaggtggagggtggtgggggtggggggcagggagtaggggggagggggggagggggtgtggggagggtggggcgggggtgggcaggttcagggactgaggccggaagcaaaacaatgtactggagtgcttatagtttttgaggaatcagtgagaaatgtcatctgaatgtctcttctcaatctttctgaaagataacttgcctataaacataaaattaaaagcctgctgtctgcttagttcaggtattgggtcagcgtcttgtgactatggacaagaggtgtttgactctaggactcagctacctcatctgttaaatgggcaaactgggagggtgtttatctgcatgcaacatctccttccatttgaaaacttttatgaatgtatggaatattattgagctggtgtgtgctaatacactgctaggagccattggagatttgaaatgtgagagaatgcctgctgtctgtcgcatttaccaaacatcatgcttttcaagattgttaaaagttgctgaaacccttctttgaaggaaatcatactttgaagctcaatatatagcaaacgggtagaagagttgctaagagtttgaaaatgatctcattaaacaagaaacatatatacagtgcctacctaggaaagagccaggcatataatagccactgcataaagatgtcaagtcttttggacacaatcctaatatctcggaggttctgaagctaaagggtacatgtttaaattttatttgtttcattaaacacctaaagactctttctagctcactcctgccaaaggcagaacttgagagtggcattcttttctggtctttgaagacgacaggtgaagggcagaatgtcctgtgtacttgggcacgcacatgcaaccctggctggtggctcctcctctctgtcctcttcctccctctcttccttctcttccttttcttcctcatcctccttttcctcctcctcttctcctttctcctcatcctcttcttccctcttctttgtgtccttgtttccatttgcttcttgctttgggcaagttctcaccataaccctctggcaaaggcaaatattcacctaagtggttaagtctctgggcatatttgttgatctctgctgagtctctcagcccgttttcatccctcctctgcctctccctagccattagccaaggccttgacctattgactgcagtgttgccgaagcagctggactccgtgtttgaaaggttttctgaagaggcatctattaatttatgtatttaatttctgtatgaagtgactgttctcctcccagcacaggtattaaagtacctttaggggaatccagcagctgaaatcctcagtaaggaaaaatgcttagagtgtcacaaagcaaacgcattagtgggaaatgtttaggggctcaagcacaaccacaaggattcactccttccttggattttgtgcctcttcccctgttcctgaggcccccactgggaacccttagctggagaacacccgtttcattatggaacatggagaaaagggtgattgtcagctccaatttattccatactatctgattcaatctgtagtttgactttgctaaaggaattaatttttaagatcttaacaaatccagtaacatttaaaatgacctatccagtccatgcatattagctattcataaagggttttaaacattattattaatcctagatatgttacttaaactattaagtccgttcaaggcattcagtttctgagtcctcaaggatggtaaggagagctgcaaatgggctcccttctcaagcaaaggcatcttatgccatcatgcacgtttctacacatctgcctgtagatacactctgtaggacaaaccaggtggctctgtccttcaggcaaagagctccttaattgaaaatgatgtgtgaaatttcaagagagaagtctaggaatggggagatttatgtactatagtcagtaaccaatcctgagcaaaggtaggcacagctatgtggtggtgcccttttttgggggggggggggcgggtggtgggggtacttactaaggaccttgcctaagataatcaacaatttttctttttcagccctgggaggctctaaagctggaatcaaaaagattcacaaccccacaaataggtgaactactctaaagcaatggttttcaaaccttgaaatatcctaacattgaaaaaaaatgtggtaacatagggttgcctgtgtcttattttggtctgtaaggacattaataatgttttggtaaaacctcagttatcatctgctattactgttatttcataagacacatcattttccttcaaaattacaatgaaaactcataagcatacatcaaagttgaaagaattttacagcgaaccaccattaacattttgctataatggctttatcatatatccattcatccgtctatcatatttgtaaaacaaataatattttaatgccaaacatatacaaaggatagatcagtaatttccgagaaatattagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgtgtacttgcaatccccacttgaccaaaggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttcacaaaagtggaaaatgtgatatgacagactggaaccagcacagggacgcagcccctcacctgctgggggtctttgggtgggtcctgtagccccagagcctctcgatgacctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccatattcgtacccatgtacgtattcatacccatatctatacaccttcccttatccctgtccctgtctacacccacacccatacctaaaccaatatccacatttatatctatacctatacccatatcaatatctatatttaaatctgtgtatttagatatttctagaaatgcatatatagctatttttgcttttataaaaaaagtcacagaaacaattatattgtacacagtcctatataatctgctttcttttgtttatagaatactgtgaatgtctttttgttttttttttttttgtttgcgagacagggtctcactctgtcactcaggctggagtgcagtagtgcaatcttggctcactgcaacctccatctcctggatgccagcaatcctcccacctcatcctcccaaatacctgagactacaggcagtcaccaccacacccagctaaatttcttttgtgttgctatttttattagaaacggggtttcacctttttacacaagctggccttgaactcctggactcaagcgatctgcccttcttggcctcccgaagtgttggaattataggcatgagccactgcactgggccaggaatatctttctatgacagtaaatattattttacatcattttcagtgataccatagtatcccattatatgcttttcagtaataagttcgaagccaagttcctggatcagcagcatcagaatcacctgggaatttgttagaaatggaaattcttaggccactccccagacctactgcgtctgggggcagggcccagccgtctatatttcagcaagccttccaagagacttcagtgcctgctaaagtttgatgcctactgccttaaataaacttcttcatcccttgtcaaacttcctaggggagcacattttgaatttttgacctgagacctcaaaacttttacctgtgctcactcagttcaggtgaaagaatctttggcattcagaagcttgtgttcacactcacctacttctcatggcatgattcctcttacctctaaattctactgacttaatcaagattgagggattctgggatgaatctggggacactttttggtccctgaaataaaatacgcaaactttggagtatgagtgcgtatttggggaaagtatacctatcagattttcaagaacttcatgaccctaaaatgactctttcttaaaataatttttttttttttttttttttttttttttttttggagaacggtctggttctgtcacccaggttggaatgcagtgtcaggatcatagctccactgtgtgacctcaaactcttgggctcaagcaactctcctgcctcaagcaactctccagcctcagcctccgagtaactgagactacaggttgtgtgccaccatacccagataatttttttttaactttttttcttttttttttttttttttttgagatggagtcttgttcttatgccgaggctggagtgaagtggcaccatctctgctcactacaacatctgccccccgggttcaagcgattctcctgcctcagcctctcgagtagctgggattctgggtgccccccgcaaccatgtcccacgaatttttgtattgttagtagagttggggtttcaccatggtggccaggctggtctcgatctcctgacctcaggtgatgcacccaccttggtctcccaaagtgctgggattacaggcatgggccaccgctcccagcctttaactttttgtagaggcagaatcttactatgttgcccaggttggtcttcaactcctgagctcaagtgatccgcccttctccgcctcccaaagtgctgggatgacaggcacgaatcaccgcgcccagcccaaaatgactttttatttgttatttttgatctcatccttgctgttctgttttgcccaggttggtcttcaactcctgagctcaagtgatccgcccttctcggcctcccaaagtgctgggatgacaggcacgagtcaccgcgcccagcccaaaatgactttttatttgttatttttgttctcatccttgctgttctgtttttcccagttatatcaataacaaagaaaagaaaagaaatctactcagggtctgttgggcatactgcccaagcacagtgtgaaatgactgccttttcactttttatcttttggatagcccaaagaccagcctgacttagcagcctgatttttctttgctggaggcagatcacactctgcagatctccactgaaaccccaccctcacccttcgtaataggcgacatgcacattttcatgtcacatttaaaaatgaaatttttcttgaaaatgttcacatccttcccccagaaattctagatttataaatttctcccaaggaaatcattaggtgctacctgaaagtttatgtatcaggtaatgatcacaaaattataatcacaaattaaaatagccataatgtctaataattcgacattagtgacagagatgatactacagttataggatgaagtgtcataactggggattttggaaaatgattagggacatggtgaagtcgtcatagaataaaattaagtgaaaagagtcaggttgagtgtagaatatatttattcctattcagcatatgtattacaaaatatctgggataaatgagaactgcatgctgacatttacattttctccttgattgtcttatctattatcaggattttctacaatgaacatttgttggtttataattggggggaaacctaaattcataaaataggcactctgttggtggcaaggaagcccactagtccactgtctaagtgttaaatggattttagcttcataattctggctttgactagaccctcttacaagcaagactatatcctctgcaaaagcatcagcggggtcctgcagtgccttcttgacacacacatcagtgtatacccagagctcttgtttctaaatagctgagctgcgtattaagtatggctaaccacacatccatgcatttttctggtgtctacctgaccacccctccaggggagagataaactcaaaggggagaaaaaggtatgggagcgaaagattgcaaggtgcaggtatgtttgcagatgaagggattgtccaggctgagctgtgcagtcctggatgaaccaccatctgggcacttcatatgccattcatacttaagggtgattggctattttcatcatcaagaaaaacattgctttaaaattttccatagttattcgggcatggtggctcaagcctgtaatcctagcactttgagaggctgaggcaggaggattgcttgagcccaggagtttgagaccagcccgggcaacacagtgagaccccacctctacaaaaaataaaaaattagttaggtgtagtggcgtgtgcctgtaatcctagctacttgggaggctgtggcctgaggactgcttgagtcctggaggtcgagactgcagtgagccatgatcatgccgctgcactccagcatacgtgacagagcaagaccttgtctcaaaaaatttaaaaaaaaaagttttttttttttaatcgccataatcttgtgtgaaatacttggtcatctgagcaacattatccttcttctccccatcagcctggcatgagcttggcagatgcaagctcagatcatcacctgtgtgagtgtgttgtctttgtgtccgtgagcatgtgtgtgtgccctgggttcctctcccaggtactccagagctcttgacaataaatgagaacaatatagaggcagggggcacttttcatctcaggccagttccaggactctgtgtaaactgtactaagccgaaacgtattcctttgtcccttttgccgctgtcctcctaatccacatctgggcagtgtgcactgtggctgggagttgacacagatccttgtctcccagacccccagtttctatcgagctactgtaactttaaaaagatttaacaaagactacctccactagctaagctgaaataagaatgtctccggagtttaatggatcaagtagcggtgataggttttatggctcttttttactttagggcatagggaagagagagccgggcaggttggttttaaattcaaggatttatgttgttaatcctccgggctaattataatttatgggatcttggcaaattaatatgcagttgctattcaaaagtggagagcaatgtaaggcaggcataaacaagccttgttcatttttaatttatttccaccaatggagaatattaaataaaatgaacactggggtatttcgctccaagtttggtgttcattatttatctctaaattatgatattcatagaacaactccttgctttttcaccaagaatctagaatctagaattatctgagcgttcgcatcagataactaggaagaaatcagagtcattttctctctaaggcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgctagcctggtagatattgagcagggtgtgatcctgttattgggctttcagactttagcttagcaacctcattgcacccaggacccccatttaatcagcgactcctatggctgtttgggggctctctttcaaataattcttctcacccatgaacatctgtcagaaaactttcactgattggcaaccaccaggcaggtaggtttgactcatgtgataattggttgcaccactagaaatgagaatgcccctcctacttccccgccacctcttctcctcttacctttttctccccgacatgcccctgccaacctccccccatcattccagctgggagaggccatcaaatgtagcttggagagctatagaaaccttgagctctgagcccaaggagcaagttggagtcctgcctccagctgtgtagctcagataacagctggagcagagaacatgctgttctctctgctagaatatctgacccaattctgactagtaaagagagttaatagtttgtacctcaagtcattcttgtccctgtgtgaaggaagagaagcagtcatttccctccacctccaacacacactccgtccccactctgtctctcttggctgtttttctcttcattgttgttaaactcacgttcatttctcttgtagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtcaagaaatggcagattttcccccttccattcccacccttgcacatagtaggttctcagcaagtatttgtagatgtaatcgaccagcagagatcatttgtacccttaacacccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcactcgagtatcctaattattttaaattcataatgaatagtcatcatggtttcactttttttatgtactcttttgaaagagtacgatgggggaataaaagccagaaagttaaaaaataaaaatagaaaagagctgcaattgtcaagagaccaaaaagtcttgtaaaaagggcagtaggtaattctggaggcaaatcagcatgggtaatgtctaggcaaacaggatagaaaaagatcaggaggtcacagtgacaaaagtatttaggctcatcatattagaatttcatccaaagaacaattgattatgatttatagaccacaccatcccatgagcccagatgtgtgtccactgggcctggcaggggacaaatttatgtaacagactccatcctgaattccagtcctcaagctttgagggtaataaactcaagctttgcaactgggtcaagatcaggcctgtctccttcttgatgatgagttgtctcataggaccctgttaagcaccatccccaaactccattctttttggtgaatatcccaacaaactccccagccatacctcaatgtccagacttgcctgatccccagggctggacacagaacaggctcattctgagaatcttctctctctccctccttcccattttgctcctcctaccaacatgagaagctagggggtctcatctttaaataattaattcttctttctttgtaagtattatacatgccaaacagactcttggtttgtgtctactgacccaacaaaagggctgtccacttgacggacaggcaacagatcatcttgataagtacatgaggcactcagatgtcaagtcaccaaaccttcattctgaatatttttgaggctcatgacagaccaaaagagccagagagttggggaacataatttcctttgctcataccctggaccaagaactgttgccaggaatatccatccatctgggggcttccagcttccccagatgcctgcgtgccttttgacccttctccttcccccaccctgcgagttcttcaacaaatactcttctaaaccaacatccccggcaaacgggagcaagacaccagcttttcactgatgcagatatttctgatcttttcatctcggttttatttctcactctcccactgcataaaagattaagaaagcactcgcatgaatgtttgcacatcatttaaatattcattttcattaatttattcatagtcgtaaagtttattgcctagaatatagagtcgtagaattttagagctggaagacaggagagaaatcatctagtttcgccgcctcgttttacagatgaggaaactgaggtgaagacagctcaggagaccgtccaaggtcagattctgaagtgagccaagtgagacccaaactcaagtcttggacagtctagcctctgtgcagcgcagctcagcacagctgaaaaccacttttgctctctgctggcatagatggctgtgctttggttcattttcttgctcatcttcatgatctagcaagttcttgttgagtgccagcccagtgctaggtgctgaagaacaatggtgaacggcacagtcatggtaccagaactcggtctggtggaacagagagattaagcaatcagaaaaacatatgtgtgtgtaattacacgttgtgataagggttttgtggggaatatacaagctcaatgtggagactagtggtgggagggcagaggcattttcccaggaagtggagaaagggaaggggaagcaaaagccatcccagggtgcgttagggagcaggtactgctgtggatgacgggtgaagaattcacctgggaaacttggggagaccatgtggaacatgccgtctctgagttatgccccatcagggggcaaagaaactggagtacttacccaccagatcctcatctgtcgttggttgaggactgctctcaggacattcacatccaggcacttctggtccacaccttggtacaatatttgcaatattagggacatgctaatacaattattcattgtatatgttaattcaaattaaatggaatgtcctatattttatagggcaaacttaggcttacgcctgggtggaatgagcaatccctgtcgccaaagaaggtccccagcatagcagttggctggagaaggaagggctgaccataagttgcactaaactgctctcagcagggtgacctggaagatcttggagtgtagatgtcaattaaggcaagtcctgagggctcggatggagccaacttttcacccgaggaggggaagagggagggttaaggagggcaaaggagagatttccaggcaaagtgcacattaaacaccagatgcgaagagctagacccccttaatgacaatttgctttctgtaatcttgaaccagggtctctcagtgtgtggaaggaatgtttgaatcggagtagcagggctgagtggcagtcctaaggcccagccacaacgtgttcttgacaagccatgtctatgtctggcgatgtgctcgcatggcacatgatcctgtttgacttcctgacagccccaggtgctggcctaaggccttccaaatgaggaaggaaggctggaagaagttaagtcatttgctagtaagggttagagccaggatttgaacccagatgactacagagttcatgcttttaattgctgcttgttaagtgcatctattatgggttgaattgcatccccccagaagatatgttgaagtcccatcctgttacctgtgaatgtaacctcatttggaagtagggtctttgcagatgtcatcaaattaatgtgagatctggctggattaagatggagcctcaatccagtgactggtgtctttattagagaaaagagagggagatttggagagacacacgtgtgtgcacacacatatctacgtatctacatgtatgcacatacctacatgcatgcacatacctacatgcacacacgtgtgcacacacacaagcagaaggccatgtgaagatggaggcagatactggagcgatgctgccataagccagggaacagcaagcattgccatccaccaccaggagctggaagtggcaaggatatgttctgccctagagccttcggagggagcgcagcgccagagacaccttgaattcagactctttgagttcctgaataaagagagaataaacttgtattgtttcaagccacctagtttgtggcactttgttatggcagccccaggaaaggaacacagcatcccctgtcaacaaaccaaggggagctaaagatataccctttagccaagtaaaccagctgccccgagcaggagcacagcttccagatcactcatcaaggggccgtgggtgacagggctggcctgctgctgcctttaatgggcgtagatgttgttgttcatgtttcccagcccattggtgatgacacagaggcaggagccggggctgcagactaaattatatacatctcaagggcagttagacaactagctcgcccacaggaacattgcaataagcacagtatctgctttcccagcaaagccaagtgcaagttcctgcctgctctgatgacctcttgtgcctccagtgtgggaagggaccaggtccctcaatgctgccgcctcccaccctgtgctgccacgtggatttaactccttcgtgttccccatgttcttagtcagtatggttgttgtgccatggattcaaatggggttgcttgatttgatttgccctttacttggctggaattctctctaacaatcaatggaaacacagctcatagggatgcatgtagcctgtctcatatgtgaaaaagaaactttcaatgtatacttcatctcattccaacaagaattggaaacagcaacatcaggacttatatggtgcagggtggtcagtaagtaggaaagaaactcggggcatggaagtgaacaggaagcccagagtgaagccaggacccaaaacccacaggtgctgctcttgttataagccagccacacatttgtctttgagccttttagcagctgccacaaactgggagaaaccatcagttatgcagtttacaatatctctaaactcaaaacaagccagtaattcagaaaaagcccagttcttctcacaaagaaagatctaagtgtgatatgagagtatatgcatggagaatattttctgagctggtgatgagctgcagggggcctctcccagcccccgcactggttgcacttttaaataagagaaaaaaacagtgataggactgacctgcgtgtagaagtttcaagttacaagaaaaacacttcacaggatccaaatccttaaagtcctgaaggaaacagagagcatatacaccagctttcgccacccaattcggatgtgttagaatgaagagtctcttattttttaatgaatttttctctatttaaaagtacagggatacctcagagatattgcagatcccgttccagaccaccacaataaagcaaatatctcaataaggcaagtcacatgaattttggagtttcccagtgcatacaaaagttgcttacacgatataatagactcttaagtgtacaatagcattgtaagaaaacaatgtacataccttaattttaaaatatttcattactaaaaaatgctaatgatcatctgagccttcagcaagttgtcatctttttgctggtggagggtcttgccttgatgttgatggctgctgatggatcaagttggcggttgctgaaggttggggtggctgtggcaatttcttaaaataagacaaggataaagcttgctgcatggattgactcttccttttacaaaaggattctctgtagcatgcactgccgtttgacatcattttactcacagcagaatttatctcaaaagtggaatcagttctctcaaactcgccactgctttatcagttaagtttatggaatattctaaatcctctgttgtcatttcaacaacattcatgacgttgttcatgacaatgttcagtgttcgccttcaggaagagcaagttccattgcaagaaatcactttctttgctcatctctaagaagcaagtgctcatccattcaagttttctcatgagattgcagcaatttagtcacatcatcaggctctacttctaactcgagttctcttgctatttctaccacatatgagtcttgaaggggctcaagacttacttcctccactaacttttgaacccctcagagtcacccaagaaggtggaataaacttcttccaaactcttgttattattaatttttgatcctttgccatgaatcacgaatgttcttaatggcatctagaatgctgaatcctttctagaagattttcaatttacttagcccagatccatcagaagaatacagtatctgtggcacctgtaggcttctaaaatgtatttctttaataataatacttgatagttgaaattactctttgatacataggctgcagactgggcattgtattagcaggcatggaaactacattaatcttgtacatctccatcagagctcttaggtacgaggtacattgtcaacaagtggaatatttttattttttttattgttattgttttgagacagcctggtctggaatgcactggcatgactgcagctcaaattatcctcctactccagccttcccagtagctgggactacaggcacatgccactaggctgggctatttttgtatttttagtagagacacaatttcaccgtgttgcccaggctggtcttgaacttgtggtgaatcaatctgcccaaatcagcctcccacagtgccacaattacaggtgtgagccaccacactggaccaagcagaatatttttaaaggaatacaaattttttcccaacagtaggtctcgacagtgggcataaattattcagtaaatcatgccataaatagacgtggtctcatccagggtttgttattccatttatagagcacagggagagtaggtttagcataattcttaaggaccctaggattttgggaatggtaaatgagcttggcttcaacttgaagtcaccagcagggaagagagtcagcctgtgcttcgcagctttgaagccaggcattgccttctcctccctagctctcaaagtcctagacagcatcttcttccaacagaaagctgttttgtctacattgaaaatctgttagtgtagccaccttagtggtcttatctagatcttctggaaaacttgctgcagcttctgcatcagcacttgctgcttcatgttgcacttttttgttatggagacggctttcttccttaaacctcatgaaccgacctctgctagcttccaagttttcttctgcagcttcctcacccctctcagccttcacacaattatagagagtgagggccttgctctggattagattttggcttcagggaatgttgtggctggtttgatcctgtatccaaaccactcaaacattcttcatatgggtgataacgctgttttggtttctatcatttgtgtgttcactagaatagcacttttaatttccttcaagaactttttctttgcattcacaacttgcctgtttggcacgagatctggctttcagcctatgtcagttttcgacatggctttctcgttaagcttaatcacttctagcttttgatttaaagtgagagacatgcaactctgactttctcttgggcactgaaaagccattgaagggttgtaagtttgcctaatttcaatactgttgtgtctcaggtaatagggaggcccaaggagggggaaagagaaggagaacagcaggttgctggagccagtgtggtattcataaatataacatttatcaattaagtttgccatctgatatgggtgcagtttgtggtgccccaaaaaatgacaatggggacatcaaagatcactgatcacagatcaccaaaactgatataataataatttaaaagcttgaaatattgtaagaattatcaaaatgtgatacagagacatgaagtgagcaggtaccattggaaaaatggtgccgatagtcttccttaatgcaaagttgccagaaaccttcgatttgtaaaaaacacagtatttgcaaagtgcaataaaaggaaatgcaataaaatgaggtatgccgataatacatacagctcagtgaagaatatcttaaaaatatttaaaaagaaggaagaaaatcactcataattctgctgcccatggcaaccacaattaacccatgcctgccttccagtctttttaccacgtgttgtgttgtgtggtgtttgtcccacatagagatcattgccatacgcccatttggcacattgcttatttttccctgtctttatacatttcatcatgttgttctaaatgcttcttaactgcaattcttagtggttgtgatagtccacagaggggaagcattgctgtttatttatccatttctatgttgttggtcatttatatggttttaaatacttttggtgtcataaggagtgttgtgataaacatctctgtgcataaagcagtttctatagttcccattatgtctttaggatagattcccagaaatggaattactaggtcaaaggttgggcacattttttaaaggtttgtgagacatattgccaaattgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatgggctacattaacccagcattttggattggagggtttctaaagaggtttcgttatattaatggatgacaagtggatacttaagaaaaagtgtattttggagaaagttgcaataatacctactagagattgtgtcctccctcaaaatcggagtgccatccgcgctccatgagtctgacactttgtaggtgctttataaatatggattgaagcaaatgagtgacgttcatatgatgttttgcagttttttcaaagtgggttttacattgagaatctcatttttccaacaaggcaactaaggcatggattcaataatgtgccagcggcacacacatagcaaatggtccagccacgaagagaacgggactgtccagccgggaggacagtatgcttttcacctccctctgtacccttctctgagaactgtttggtttgaatcatgatggcagtggctggcttctccacgatgctgttgtgctgaaccctattaacctcatagggaagacactaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacatcctgccgttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggccctttctgcacttccacagtacccgaagtttaggcgcccctcctgccaagagcccccattagcagcaaaatatatctcacatggtgcccagagcaaaggaccctgtgctagttttttgtggctgctgtaataacggcaaactgagtgacgtaaaacagcagagatacatttgctcacggtgttggagcccagacgtctgaaattgacactgcttctggggacactagaggagactttgttcttcgcccttcccggcttcaggtcgcggtaagcattccttaactggtggtcacattactctatctgtgcctccatggtcacttggacttcccttctgtctgtctgaaatttccctctgcgtttattttttgttgttgtttgtttctgagacacagtctcactctgttgccccggctggagtgcagtggcatgatcttggctcactgcatcctccatctcccaggcttaagtaattctcctgccgcagcctcctgagtagatgggattacaggcgtgcgccaccatgcccggtcaatttttgtatttttagtagagacgaggtttcaccatgttggccaggctggtttcgaactcgtgacctcaggtgatccacctgccttggcctcccaaagtgctgggattacaggcgtgagtcaccatgcctggctatctgcgtttcttctgtaaggatacttgtctttaaatgtaggacccacttggaatatccagaactatcgtatcaaaaaatgtttactcacacctgcgtataccctgtttccaaatagagtcacagttacaggttccggggagttgacatgggtatcctctggggcagggggcacttttctgcctaccacagatactgaggtgcattgctaattacatgagtacagcatttgtgaaaactcgctcatgatatcttctccatagtcgcagtcagtaccagctgctgtggaaaaaattttacgcattgtgtttacaacagaatatataacatggcttagagacaaagtgttttacttatggccagtagatggaattctaaggtccgatgtcggtttgccatgacttgggcattggtttctgttcggctctgtttacggggctgtgggatgggtacatagacactcgtctacttgaacttccagggactcgggaggcctgcagttgaataacaagagaccgtgctggtgagaggtggagtttgcagtaggatttcaaagactccatggagtccaaaaggtgggaggtgtgttttggggcatgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattcgttctcagcatcagaaaagaggtcgtgtgtgtgtttgtgtttttttaatatcccatccagcccccagccccagtaaccctaagattgaacaaaaccctacttacgtgctacggatttaatatagcgtcaggctcctctaggtacaataaaataccaagttaagagcattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcaggcggcattaacccccttaccctggctattggaacaatagcgcttctaaaagccgcacaaaatcctccaatattaagaacggagaaaaggagtgtggaaaaggtgtgggcaagcacggcatctcttctttctttttcttctttttctgtttctttccttctcttgctatttcctttctttctttttccttcccttccttccttccttctctctatccttcctttttgtcccttccttcccctcattctttctttccctctctctttctccgtctttctttcctccctcccatactctctacttttcttcttcccttccctttgttttcacgctaattccttaatttgtttttgggtctgctcgcaggaaataaccgtaagctaggataactgaggtaaaatttgtacagctaagctgaatggtgaaaggcccagatttagttctcattgtaggaaaaagggccagaataccttgcccatttttgccttgggaagtgagctcaatgaaatacatcttcatatgcccattttacagaagcagcaactgagggctgttgtactgaggcttgcaatggccacctcaacttttaggtctctgaggcagcaatgggacccttgccggggcctcgccatccacatggtcattgcctcaaaatttgggattccagttgcccttttccttcttctctcttgaacaatgtgaacgcaaggtgaggatgggccttctccgccttcaaaagttgctgccttccaaggggaaaaggtctggtcttgtaatttctggtctgtgcgtgctgtataaggaagaaggtttgggtagggaagcaacagagtacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcgtgatcaggcccataaaatactgcacatcttggcatcttacctataaaaataatgcagatacattcgtaactccccaggttttcgggagtggaaatgagggcagctggggagtgaatctgtcgtttgttgaggctctttttcctgcttgccagacactgatctaggctcattcatacaccagttcattcatcctcataacagttctgtgcctgagtagattcttgtccttatgtaaggattaaggacgttgagacccagaagggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaaaagcaggcacattataaagaattatgtcaacctgatttcttgaatcccaggacaattcatatccccgtgccatccgattagtgaatcaagagaaactgattgatatacagcaacaatagttaagaaacaggcagcatcgatggaggtttgattaaaccgataccctgggtctcctgctgtatcaaatcatgggcgaattggtaccattaggataaattactacaagaggcactgcaaagccaagctaaataaactctgccttctcgagcccctgattgtcttattaaataatttctttgcctcttaagtgtggactcggagcactcgtgctctgaaagccctcctgattaactatagccttggcctcaagttgattttataaacttcggatggtgccccagagggtgaagcttcctgttgtcaattctgcccgttgctatagataccaaactccacaatcagtaattagagcgtgccccctgccccagaactggtcaaacggtgcagagcgctcggcaaatggtcttaaaagcatccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaagacagggcaggagggtggtgtggcacaaaggcggctctgtctgacctgtcacgttaggactgagttcattcttgttcagattcagcatcttttgttacacccgaagtgcattccatggccctgtcccagccatagaaagaaatgcctttatttttaagcgagacttcttgtggaatgatgaatatgttcagggaggctgttggtggcaagaaaagaagggtgatgggttgggcttatattgtttagtggagcaaaagagatgtgaaacatttgtgtcttaaagtgttttggtcaagagaaactaaattggttagaaagtgtgcaattttgcaagctttataaaaatataaaccaatgagtctggactctgttccctaaaggggatgaggaatgaaaatgaaggtttgcaaagacatcttgccagacccttacatattttaatttaaggtggtattactgtcctcattttcaggctgaagaaccaagctctgagagagttaatgattttctccagatcattcacattcatttctgttacacagctgggattataatccatgcctgtctgactctgaaacctattttcccatttttttttttttttagggataaatttctcccaaactatatgcagatcctgctagagactgcccatccctctatccatttctcagtttgaaaagaaatcctggaattcagaatgatgaatattcattttaacatcatcttaaaatgtccttatagatgtatattacagctgtagtctgccaggccaagaattcgattggcatttccagagtactgttgattgtattttagaatcttccaaacctccgtaattgtcttgttgatttcaaacaccctgagaacatttcctaaatgctcatagcgtccaatagcatgggaaagtaaatggtttatgaggagaatttgggatgtgcaaaataagcctttgaagagagtgcattatctgaagcctgacattgtaacagcttcttaattacgctttctttcatgtggcatttttatgggatccagtacgcccaggctcaaatgatagacatttcaactcctacatccaagtgtagggagtcccaactttttgaatccatccgtgtggcaaatgtagctggacccttgggatgaagacccttcctgcatcctcccaaggagacaagttctgggccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatcccttgtgttaaatatggtagggaagcaacataatgtgccctggagtttcacagaagaaggggctttcttccagcttggggatggaggtgagctgtcattctggatgatgtgatggggaaagaggatgtgagctgaggcttggaaccaagcagagcttgggctttggggtgctgggaggacagaatgctggaaacagaggtaagaagggtaagcacctagtcaacatgagtgatttagctttgggagctgatcaagtgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacggtgagtcaattaaacctctttcctttataaactacccagtctcaggtatttctgtgtagcagtgtaagaacagactaatacagcaagggagcagtgatggagcacaggctggaaaactgagttgaggggtcagtggtggaccctgaaggttagactaagaaatttagactccagcctacataaatgtagactccatgcagaatgactggatgtcctataggacatgcaaagccacagggaattttggaacaggaaattgtgctcaaagctgaattttgaggaggtaaatacagcctctgtgtgtaagacagagaaaaggagagagtgggaagtaatttatgtatcacagttgcctagagaagacagaaaataggtgcctggcttatgtggccactgctttttttttaaacttatttctttaattttatttttttttaaattaggattaaaaaatgtacatatacacataaaatatttatttttgaataggtaatacttttatatggttcaaaaatcaaaagtagaagataaaaacaaggtgtatatgtatatatatttatatacctatgtgcatatataaaatccttgtatacatatacacacacacacctatgtttttctttatgtgtgttaaaatctccctctacccctttcctttagcacctaattcctcttctgaaccgatgttatttcctggtgcatccttctagacattattatgcatttacaaggcaatatgtttgtatattcttctgccctccccttcactttgctatacacaccttgctctttttgcttgacaatatatcttagagatggttctaaatcagcatataaattatttcttcattttttaacaactgctgagtattacactgtgtggatgtttcataattcattgaaccaattccctattgatagacatttgggttgttcccagccttttgctattgcaaattgtgccgcaacgtgtaaccttgcaccgacatcgcttcccacgtgcatgcatgtatttgcaggattgagtcttagaaatagcagcatcggctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacgtgacagttacgcaaaggcctggtctgatagaggaacaagagagagagaaagtgcatggcaaagacccatcattgatgagtgactggatgtgaggaatggagcaggggagatgctgatgatttggttacccccttctccatcccccaccacccactgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgatcccattggagaaatctttcctatcacttccaatccacgtgtgttcagacaaacactaattttgttagtacaacgtcccctaatagctaagagttaaaaaaaaaataggtcttagaagtgtgaaaaacaaaaaacaaaaaacaaaaaaaaaaacactaaaccccaaatttgtccttttaacactttcagcaaccctgtaaagtcattatcatccccctgttacaggtaagaaaattaaggctcagagaggttaaataacttggccaaggtcacacagctattaaggaatggtaccatgtcttggacccaggttaactttaaatcctgagctttataacggtttgatttcagtagcaaatgcagtggcacagaagggtctgggcatttatttccaaagaatgatttcactcaactgaggaattctaatgttttaacagcatcctacttatttctaaagtgttggggtgaatttgccaaggtttgaaaagtgcatttgtaagccagtaggattcaatctgaagtcagggataacagagccgggggcggaggctaggtctccttacatattttgttcacaatgggactagaacactctgcagagtatgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcagggcctaggattggaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatggcggtttattccgaaagactgctgtatttatgcttaaataattaggattacctctacctggtatatttgcagggacaagcaaagcatacactgaaaataaattctcaaatgaaattcatttcacattagttgcatcccaacattcctttatggactgcattccatgcctggcactgtgcctatgatttattaaaatctaaagccattaataaataaattattcaatccatgcattgaattatctagctcattcaaagacagtcacagtccatccctcaaagagctcatggaccagtcgaaggagggtgacagcctgggtcaaattggtgctgagcacacaggcaggggtcaggctccctggagtgaagtgtaagcgtcgctgttcactggctgagtcatctttggtaggtccctttaccactttgccactttaagtctccgtttcctcatctgtaaaatagaggtaataaaaacagctaatatttacagagagcttactccttgttagcagttttcattaattaatgggtgtatttattggaataaccgtgtaaggttgccatttttatttccatctgtgtgttacagatgagatgtgtaatagaaagggaatttgcccaagctcacagtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgattaatacaactaataaatagtgcattagtattataggcacaaaagacagtatgaagtacagcacagatcatgaggagggtagggtcagttctacgtaaaaacagggttagtaaaggcctcagagagaagatgtcctttgagctgagtcttgagactccagagatcaggactcaaggactgtggaacctgtacattcacatcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgccacaatgtattacagatgcagagtcttcatcttgttgggctgtgatcaagtacatatgctccccagcagttctttgagatttccatgttctccgcacagtgcggagctactgcgggtgtgtgagccaagggggccctgtgacccttgaaatagaaaagggggaaatggctgcatgccaaccgaagagaccactgcattgttggccataagtgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagggatgagctctcctctgcatgtaacaagcaaggtgattcagcaagaagactgctggtctctcccttcctccagggccatttgtgagagtgagacacaaaatattagaagcaaaagaagaagctgtactcccaagaggcatggatccttgagtgagttatgtgcttggaaaaaattagtttgcacatgaggacacaaagagagcctgaaaagcaggaggctttgaggtctttttttccctcctgattcggagggaaaaaaaatgttgtttgtgttcatttatggaaattagatctatcacatactcttatgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggacatgggtgatcaagcagcagtatatctctttactccttgtattagtccattttcacactgcttgataaaaacataccctagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacaccccttcctacgtcctacatccctgtacttggaaagcaatcatatttaaatcattgctgctggaactttagttgactttataagttacattttacataaaaaggcagcagtggtgaagctggaagagggcacctagactttgatttcaggcaagattttgttaggtcccagtattggaacttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattgggaggtagtcttttcaggaatattctgagtttgtttcttgatctcgatagcagcaacctttccatttgctctctgtctggtttctctgtgtctctctttttccctcaaacatcgcttttctttttttaaaacaagaataaatcccttaggaccttgctaagttattacttatattgtcgcttaaaaaaaactttggaaagaggctctggcatactttaaaaaagttaagcacactcaagcctctttaattctaaattcagttttgaatatgcttgtactgatgtcaatgacttttcaaaagagagtgtcccaattatttaggtggccaagagaaacagctttaattctttatcacataaatatgcttcaaaccacgatttaaaccagatggatggagcactggattagtggtggggcttcttggctgatctgagtttcgcctcctcgatcttgcctgggtctgttctgtcacttggatcttaccagtcctggcaggcacacagctctgtgagattttccttctggctttgcatgaagcttttgaaaagaaaacacatacatgcaagtgacctttctagggttgtttctagtttcttcgtcttacataaagcccctgctaatttagcatggtgtgtgcccgagtttattttctttttaacaactttatttatgtaattaagcgagtgaagtcatacattttattgatctaatgaaacgcatttcatggttcctcctgcccttcatcttctgaccttccccttcagatcacagccctttactttcgtcaatgagacgccacttaacaattttccaccttgccaaatttgaggtccccctcaacattaacggggaacccaatatcagttccttaaatgggagcaaagattgatgtcaatataaactaggacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctgctgtccttgccggtggcctgcactggggagttgtatattgtatcagtaattttaaaagccagcaagtgttctaccagctgaagaagttttcctaatggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaaaaatttaaggagcaaatatgtgagccaggatctcatgctggactatctaagcaagcatgtaggaagagtttgtttcttcctgctatggccatagaggtttggttgtcactatgaagaatgggcctgtgtttttttttaaaaatatgctgatctgggtgaggtcacattttgctattctcagtggagggaataattgggattatcttatgatttttttttctctttaattttcttacaaaggaaaaagaaagaatccaatttgttataaataactgctgagggcagtacatgttgcaggtagtcactatctgggactggtggcacaggcagtaaaggattcaccaagacagttgtaggtaaagaaaggtggatttattggagaagataagaaagtacactgtaaggttgcaacaggcagcccagcatggaaggggctgtctgcaaagaggcaggggctggagggactgaagttatacagggtcctgttggagggagctatgtgcagaatgaggtcgaggtcattgtgcctgcggattgtttgttgttcttccctacccggggcccactcctacctggggcctcttcctcattgctgcttacttattagaactccacagtagattttttataaatgcagacacatacagacacccacacccacacatacagacacacacagaaacatatacacatttaggtcgcgatttcttcacaaggacattcttatagacatgtcatgaagggacttggggctcagagaaatgaagtaactcagctaagtctgtacagtacttagccaggggatttagaaatccacccagggatggctccagttgcctgtttcttttcatttgacacgggatggcctaatgggtccccaccaggggtggcttggaaaggagaaagcaactgcattcccactggaaggtgttctgtagcaaagtggagtgaatgccaccaataatgagttccaaacagggtatgtgtttgcagacaggagctacatacatttgaaaattaggatgatttgaaattgaaatgagggcttatgctgttcattggattaatttttctctcttataaataaaaaatatatacaaataatacataaacattgtttttcactgtggcttgaattttctaacaatttttttcttcttctcaggaaatgttttcttcttatacctccaaaataaccactgttgacagtgtattgttaaccttgctagaaaaaaatatttatttttgatccatacacgtaaatatgcatactcataaatatgcattcatattttgtgtatgagtacacttgttaatttacatgtatgtcttgatttatatacattgttctatacctttccttttcccataattttatggattacatttattttcatttctgtatatttagttaattcttttaaaaggctgcctgttatcccattgtctgtcttcaccatcatttacttacgtaataaatctgttaaataattttaatataaatctattcatctatccatctattaaaagagatttaagttatttctaatctttgcatattataagttgcatttcagcttataccttgactttctttgacatatacatcaataggtagagtatattcctagaaattcaattgtggaccaatgagatgtacttcaaatttttaacagatatttcagtattgacctcccaaaatgtattcacacacccaccaaatctaagtgtctgtgtaacacacagatgctgatttggagtattaccattttaaaaaaataatatagctatcagtcgtgtaaaaaaaatcctcaccattatttcttaattttacattgtaattgtgagtgatgttgggtagatttttgtacttttattgaccattcacatttcttcttttctgaactgcctttccatattctcggtccagctttctataagattgctctcatttactggtgagagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgaatttggcagaataccatttaagtcttgtattttccaaagctagtcaacgtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccctggttcaagcgattctcctgcctccgcctcccaagtagctgggattacaggcatgcaccatcacacccagctaatttttgtatttttagtagagacgggattttaccatgttggccaggatggtcttgatctcctgacctcatgatccacccgcctcggcctcccaaagtgctgggattacaggcgtgagctaccatgcctggccctgatgtcacttcttaggctaatttctgtgaaattgtgattgggaggaaaaagtgaacaggaacttaaagccagcagaggaaagctacctgcccttcactggtggtcagtgcatggattccagagacagggtgggcaccagttcctcaccgggtcctttctagttgcatgacctggggcaggtgactttatgtggctaagcctcagcttcctgacatatggcaggagtaataatatcccttgaagccaacaaaattcaataggcacatgccatgtacatgcctgtgttatgccgggaacttcttaacatttccagaatatgtgtaatcatatttgttacatgcaatatgaaattatgtgtaaactgtccaacctgcaggaggcagtagatcaatcaattacatgtgattaatcctccccctatcttacagagaataggagagaaaatagagctccaaggtggaggaaaagacaactgagaggaggctattgtgatgttttattaccataaactgccaagggttagtcgtagccctccatctgccagctaattccggtttcattaatatgaatattctcacgcttccagaaggaaattcttggaatgttatggatctctgtagcaggcacatgcaacgtccagtgcttccctgctggtaatgtggcggttttattatgcatgccatacccatgctctctatttcctcgatagaccttatagaaatcaccatgcttccttttagaagaaaatgatggtatcacatggagaacgagctgaggagcttgacaatcttggcaaggcttatcaaaagaaaattcatgtgttagccttaagttaacactacttttattaaattcagtttttatcacagctgataacttggagatgtaagcatttagagacagaattcacttatgaatgttctaaaatgtcagaaagtttaggattctcttcaggtagtttcctttctctcacttggagtgacatgttggacccgtggcattgtcccgaggcaacgttgtggaatttttagagagtgtttgtctgttagctgtttgttttgaacatgttcacctttggctctgacctgccatcatggaaaaaaagtgtcaatgtgttgggaaagaaatgggctgcttctcttttctcctccctcctccgtctccttcccccgaccctcctccatccccttcctgcccccactcctcctgctctccagcctggcctctgtcccctctgtgttcctccccttcttccttgtatccttaatgacttccaggtgtgcctgctgggtcaggcttctggccccgtcctggggaggctgggtctgtgcctccacaaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatactgttcaaccttgtgattgaaagcccaagccctgtgatccacagcaggggccacagccagaaataattccccgagaatactgcgtgtgccttcaaatggtccttgatcatttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctctttcctgttggaacaactgcctcactcctgtggccccactgtgccatagacaggttagagaacatgggccctggcatcagacctggcaggcagtcttgattaggcccgttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagcctccagagggtgagactgacatctcatttctctttgcagtcacagcagagatgcaggcccacagtagggactcaccagatgtggcagggtgagggaattgtccatagatgccttaaagatatgctatccacaggagcagagagcacagcaggctggatgccaaggagaattcgaccagggtaaggcttacaggcaatccattcagtgcagagtcttcccccatccacacatataactccctttagtattgatgacctttctctcctgaaatattacagaaactgccctgaacgaagatagatggtcccccctcagcgttcacacatggttccgtctcatccaccagcttccccggccccattccctctgtctcaggaaagtaataatagtaactcataataatagttcaaaataataataatcatacctgggatttatatttcagcgtgcctcctaagagggcaaataaaccattttacacaatgcagagagaaggacagattttctttgtgctgctgctgatcacgttaagccaggagagatttacagtcaaattccagctacagaagcaaagtgttggtgccccgttggcatgtggggatccactttaatgttgttctcttggttttgcttaaactgccaagtgaattactgtaacacactttgcctgcagttaatttgacatctagtgccagagagctgctttatatttttcaaggcaagccagggtgaaatttttgcaaaaagatttgtccatcatttttactgatgtccaaacacgatgtctttagcttctttggaatcgagctgtggaagtcacgtgggctttttcttttttcttttctttttctttctttctttcttttctttttttaaggatcacagaagaaaagcaggccgatcttgttgaaatgtttttaaaatctccaaataataaaataggtttagggtgtttgcttatgaaagctgactttcaccagaatgatttatatgcatcatgggcagaggggcagtccaataaaagaggcagaaagggctcttgaaaaatgtccctgggcacttgcccgaatgactttagtgacagtatctactaaaactgatactaattctgttacgtgttatggcgcatacccaagaccctccccataaactatttgaaagaagcaaagttgtaattctccaaatacggacttgtacatttctgatcattttagcaccaacattggttcaaactctggcagccgaccacagttccagctgagctttgctgcgctgtcagcaccatggggcctgataaagcatttttggatttttcctactcacagtgcccccatggtctcaatgctgttgagaacattaagctccttacctgtgttttgtggttgttgttattgtttttctttctggtaaaggactttatctgcagtcctaacaaattgacttacgttaacattctaactcgtggctaaaccaaaaataaacttgcagaccctgccctgaaatgcacgctctgagcagtctattggatgcggtggtgtggccgatttcttggacttgctacattcttaggcaagtgacatctcccttcatttgtacagagggagttagaattgaatcgaacttccaccgcagcatccgccagctcttataatcacttgccctttgctgatggtgagtttttagctgctttctctcctaccatacagcactgacacctgagaagtccagtccttttggagttcagtagattccttgtctctggaaaatcagcagaaaacaatgcagcctcctcttgatctcccctgaactttgcaaacctctctcagcattgaccgcatgaagggtgggtgccctgaggcaggcaagccaccaggtggtaattaagaagcaagaagcgctgctcccaattctctagatctggatttagaggccagttggcttcagaaaacatctcattcacacaaaatgggacatggtcttttgtctgttaaacataagctttcaaggtgagttgtgcagaggcaagtctgcttgtttcatcaagctgacgtttatacttctgagtaagtagggggatccggagagtcttcttgtcactcaaacagtttccgtacgtcagtttcacacctctgttctgcatgtctctgttgggaaggatgctgatgtctgggatttgaaatagagatggttggacctctgactttcaacaggaggaaatcaaaattaaaggaagaatataggcgtacgcttagaaaggacctgtgaaaggaagataaatcttgggcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaaagaagtttggggtgaaaacacatgacagtttcttgttcatatttggccagaaggaagcagtgtccattaggttgactctccagtgcttcttggtgttgtgataagcccgtctagcacggagggccagaaggaagcagtgtccattaggatgactctccattgcttcttggtgttgtgataagcccgtctagcacggagggccagaaggaagcagtgtccattaggatgactcttcagtgcttcttggcgttgtgattagcccgtctaacagggcgggccagaaggaagcagtgtccgttagtatgactctccagtgcttcttggctattgtgataagcccgtctagcagggaggagatgtctacacggtgttctccaaactgctcagaaaagagcagtaaggacaggatggggcccagttaagaggtatatatcttaccttctctttttctccttcttctccatctcctgcccttacttcttcctgcctgtcatttatttattcttttcacagatatttagtgagtccttgctctgtgtcaggccacagtgtagatattccagggatggaggtgaccaagcagacatggccatagtgacaggctaaggaagcacaaatcacaaatacagaagataattcctggtagtgacgggtgcctccaagcatataaaacagggtagtgagatgggaagttagagtagaaatggctcaattttgtgctggaactggctgcaccagcaggagccaatgattacccatctcccatgtttagtgacatcatgttgatagcttgatttcagccatagtgagaatattttcaccacggaaattggcacatgctacacatcagggctccctcctccccaccaaagctgatcattaaacattttctagaacatacctggaaggcatctgggaagaggtaacattgatcttaattgttattagagagaattttcaatttcagttgtagcatgaaaaatcacagagtccatttatttctcctcttcgagtcagtatatctcaaaacattttttcaacgttaatagaaatataagaagtgcctggatcagtttttgtttttgttttgtttctttttgagatagggtctcattccgttccctaggcgggactgcagtggcaccattatggtttactgcagccttgacctcccaggcccaactgatcctcctgcctcagtctcccaagtagctgggactacagggacacaccatcatgctgagctaatttttatatatatttttttacagagacaagttctcgccttattgcccaggctgatcttgaactcctgggctcaagccaccagcctgcctcagcctcccaaagagcagagattacaggcgtgagctaccacacccagccatttatctgttttttaaatagcattttggagatgacagaaaaaaaaataaaggaaagagaacgctcatagaagtttaaggttcagaagtatttggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtatttcttgaattttaactgtgcctgaagatcaatcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgtttcacaccctatgtcttgtgtgtggtgactcatttgaaccttatagcagccctgagggataggtgccggtttgtctctatgcgcccatgggaaactggggcacagaggtgttaagtaagtgacccaagaacacacagctggtaggagttttagccaatattccagtctcgatctgctgatatgaagccgatgcagctagccaccatgttatacccacccatagtcatgaaaataagatgagcttaatttttttcttttgagactgggtcttgctatgttaccctgggtggagtgcagtggcacagtcatagctcactgcaatcttgaactcctgggctccagtgattttcagcttactgagtagctgtgactacaggcacaggcctccatacccagctaagtttattattttttggtagagatggagtattgctatgttgcccaggcttgtcttgaactcctggcctcaaagcgatcctcctgtctcagcctcccaaagtgtggagattacaggcatgagccactgcacacagccaaggtcagctttttcactccagcacaccaggattttcatcccagctctccaatcccccagctgtgtgggcctggtcaacctgtttagcctgtcaagacttcagtcccttcaactgatagatgggagaaattaatagcacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccctacttttgactttataatattaagttcgttcatatctctcttagattcttatataaattttattgacctaatgttctgtacagtagtccttatttacagttttggtttccaaggtttcagttatacattgtcaactgtggtacaaatatattacttacaatacgatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggtcttggagtatatcccctgtgcagaagcggaggctactgtacatacatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaaccaacgaaacagcaatacttgtaactaaaattgggagaaaggaaaacactttcagtagagtcaaggatttttttgttaattatttttatttttagagatggtctcactatgttgcccaggctggtctcgatctcctaggctcaagcagtcctcccatctcaacctcccaaagtgttgagattacagttatgagccaccgcatccagcccacaagtattattccaaactgtaaaatcgtgaaatgttttgcattagaatcagaaactagacaagaatattcatgatagctgtcaattgtcacattattttagaagttttaacaaatacagtaagacaaaaaaagtcttaagtaatgggatgaaaccaaaatgttctttgttttaaacttctgtaattataatcctagagaagctaaaatattcagtaaaaattactagcaatgaaataatttgaagagttggctagatgtaaggtaaatatacacaaattagctggtatatactagttataatttaagatggagatagaaaaaaaccccattcaaaatattaacacaactatcagatatttaagaataaatgtataagagtgatcaaatacctgtattaaaattatataatttattgaaaggaattttttgaaagtcacccataaaatgatataattttaccataaaatatcagctaaaaagggggcagtcagcaaaagctcagctgtgaattaagattattttctaacccttagttctttgataacataaataccggtagaacttggaatatttcaagtaaagtaacatgctgtgttttatctgtattcctggtaacttgcatttttcaaggaaggaagtgtatgatatgaagtaggcttataatttagtcagatgagctcttggattatgttaccttgaatataatgcagaggagaaaacaaaaagagtcttttgcatttttatttcttatcaataggtccctttttcttggaatgtcagcctgaccctgaaggtattctcctaccagcagagccttctttgatgccccgtcttcaacctgccatgttttcccatctgtgaggcttctattttagagacttttcctccagaactggcttatatcatcctgtgttgctgcatccgatcacaggtctgtggctgacctgggcagcgtagtagaagggtcttgagatttggagtcgtaacgagttttcaaaactcataactatattacagtttgcgcaagtcatttaacctatctgaaccttcatttcctctcccacacaggataaaataaggataataacagccattttagagttcgtattaatatttaagtgggagaatgcagccagtaccctgagaattaaggttcattcactcagcaagtgcttactaagcatctggtttatattatgggaagttttgagaattaggtggtcagaaaggtgtggtcctcgccttcaaggagcttacattctaggaagcgaagactactgaacaagagattttagtgctaggattggagaccccagcagaagtagcaaatactgtgtgaggtttaaggaggttggaggcaccttcgcttgtacttctacatgtgtcccttcatgtctagttcactgattttttaattgaaattttaattgaagactcacatgtagttgtaagaaataatatacaatgattcctcatattcttagctcagtttcccccagtgatagcttttgcaaaacaattgtgcaatatcacagtgttgacacttacagaatctatggatcttattcagatttctcattttacctgtactcaagtgtgtatatgtgtgtctgtgtctacatatgtagttttatacagtgtcatcaaatgtgtagcttcctttatacacaactacatcaagacagtgaacagtgcatcaccacaaaattcccttgcgttgccttgcaaaccacacccaccttccttctgcgcctgcctcatccctgacccctggcaaccactaaactgttctccacttttaaaatgttgttttttcaaaattattatataagcagaatagcatagtatgtaatcttttggggactgacttttttcactcggtacaattccgtggagattcttcccagttgttgcacgtgtcggtagcttgtttaatttcattgctcagtagtattccatggtattgtacatataagtgatcgtatgtttaatcactctcccgctgaaggaaatctagtcttggctattgaaagtaatgctattataaacatttgtacacaagtgtttgtgtaaatagaagttttcttttctctgggataaatgcccatgaatgcaattggtgggttgtagggtaatgacatgattagtttgtataagaaactgtcaagctgtttccatgctattttacatttccaccagcatttggtgatctagtttcactatatcttcaccagcatttggtggtgttgcagttttttattttagccattctggtaaacatgtagtgatatttcactgtggttttaattaaattgccctgatagctaataattttaaacatattttcatttgtttgtcatctatatatcctcttcggtgaaatgtctattaatgtttttttctcattttctatttgaattgttgtattattgttgcattttgaaaattctttatatattctagttattggttctttgttggatatgtggtttgcaaatatcttctctcaatctacagcttgtcttttcatcatctttacatggacatttgcaaaataaaagtatttagttttaatgaggtccaatttatcaatttttcctttcatcaactgagcttttgttgccaaatctaataattctttgggtaaccatatatcccaaataatttctaatatttttttcctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtgggtatctttctggcttctttattccactgatctatgtgtctgtctctctgacaattatacgctgtcttcattactatagctatgtagtaagcctcatgtcaggtagagtgattcttctcactgtattcttttttattaagattattttagcttcctaagacctgtgctttttcatataaattgtacaatatggttgtctatgtctaccagaagccttgctgcagttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttataatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatatgattttcctttagctttttgatatggtggactatattgattttaaatattgaaccagccttgaagacctggaataaatcccacttggtcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgcataagaaccaatgagcatttagtttcatgtctcataaataatctgcctgcttatattttcatctgtacttctctcagctggcattctgccacagactacatttaggaccgcagccagtgggttacagcaggagaccagactccaagttctggcctcacgttgcttggtatacatcactcagttctgttggcatggatgctcctcctataccccatcagccatcttgcagtatgggtttggtggatcacacagggattcagataagagggttcagatccttctatccatcaacccacccatccacatcactgaaaaagggactctcagatgccgatgaccagtaagaccacatctgtgggcacaaaagagcccatttatgttttttatgggaacctaagaaggaaatgcttttctggtcaaatacgttcttctctgattaggcctctcattttaaggcagttgagaagactcacagatgtgattcactggcaatggctctggttcaccaagcttagctctgctcagtctacctttagcagaagattaaaaatgaaaactcttcttgttagaggtagaagagatcctttcccaaaccatagattcatggaactgtcaaagagcagcactgaactttgtactcaatgccttaatttttccagttgaggataattcacactaaacaagggatttcacctctctgactcatgcatcaggaacttggagataaagccctgttaataattcataattatatagcatagcatagggcagtttcagatgcttcaactaccaggtaggtagaataaaggaatgaagttgctgtgtatacgatgataaatggtgctaaatctatgtccccaatatagggaagacaggagaaagtgccaaagatagtgtgcatgcctcatctctaaggggcagccattattgacgtccagctgaatgttgccacgtggaaattagctataaacttgccagaacctccagtttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccagttggagtgagccaaataaaatacatctgcagtccagattcaacctgcaggccatcattctgctgtcattggtgtagaagactttttcagcctagtttattctaggctcttttcatttctccctgatttgaggctttgtaggacgttgcacaggaattatttcccttttaaacgttagttttcattttaccagtgcaactctgctattggcacatctatgaaatacgtaaagctatcattttaatactaaagaggaaacacaaatttgactcatttccccagaaaattcccctcctgctttccatatgttatatagttaactgtaaaagtggcaccacctcttaaacagccagctattctgatcatttgaaatctggaacattctttcctacggtggttgacttttcactgcctttgaggttctttccaagtaaaggcgttattctttgtggtgtgctcctggaggtcactaacaaaacgtctccagcaggtgttgtgtggattcccccaaatccgtaggctcttatttcctagacatgaagagtatgtgcgccttctttttggttaccctggaccagacattcctcagcactggcttgcattggcaggaggtggcagagggagaggacagtaaccaataccgctccttctacatgatcagtgttcaggttgaagacaaacagggctccaattatgttgtgatttagaaggcgacagagctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctccgaacggcctgccagggtgcctgacagccagagccacctaatgggcctatttgatcctggagttgctgtaatggcaagaaaaaccatggcctccagccccagtgttgaagttttgacgctaatgtgatgataattctcttttctttgactggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaagcagaagttgggaatcatagaagaccttgatgttaccatatcccttgttaaatttcctctaatactattgagaagtttatcctctactttttcctgtagagtaaaagatatcgattttgtttctgtcggcactgccttggaacttgcttgcatccctcccccacgcgaggcgaggccctgaggagcgggattcgctgacccatgctggcagaacgggtgatggatgaggcagagaagggtacaggctggctggaccatgcgatggggaatgcaggcggaacaggcttcctcctgaatcaggagtggaagaggagtctggggtgaagccaaggggaagacagttaagctttaaaaaaccaactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccgggaggcagaggttgcagtgagccgagatcacgccactgcactccagcttggcgacagagtgagtctccatctcaaagaaaaaaaaaaaaaaacaaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgggggaaatacaaggaaggaagagaatgcaggcagctcaaaagagccgggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtagtggcttgcgaaaagattccagcactaaagtttgaccccagtcctacctgacttcctttctccagctgtgagactcccctgtacaatttttctggagggtctagagtcacatgagtcacgccaagccgccctttcagtgcgaaggaatccaagcagagccctcctctgctgtgggtacttacttagggaactgtggaggtgtcctcaggtagccactggtgtgtggggtcataccaagtcatttggtttacatcgggaatgccttttgtcgttatgtctagacccctggagaacagcccacggcaatgcacttgtggaaattcggactgtggattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttggggggggttttttgttgttgttgtttagctgtttatgggtaggagaatgcgtgctcttttagggacatctcttcaaataagaacaggttgtaacctacactcaaaagagatgctcttggcaaggtatggcccctaaggtttgaaagcgttttccaggcctgctgtcaggccaggctggactgtccacaatttcttgtcctgcctcccgtgatgctagccatggatgcaccccagaagcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagtatttgtgtaagtgtcctctgccctggacaccggtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccactcttttctgaagtgatggggatattcgatggcaattttgtgttttcttcacttggaaaaactaaaaagtttgcaacatttaaaaaaaatacaacccttatgctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttgatccaaggtttaggctctcagtgcctgtttcctgtttaatacatatcatggttttggaaaaaatgaaagaaagaaagaagaggaagagctgtcattcctctgacaagtattttcagtggaattagggtcatgatgtcatgcttatttcaaaagatagcttcatctgtgccttcacccagacttagggttctagattcttctagattctacagcaggcactggcaagcttttgcttaagaaggcaagccgggaatggtggctcacgcctgtaatcccagcactttgggaggccgaggcaggcagatcatgaagtcaagagatggaaaccattctggccaacatggtgaaaccccatctctcctaaaaatacaaaaattagctgggcatggtggcgtgtgcctgtagttccagctactcgggaggccgaggcaggagaatcacttgaaccagggaggaagaggttgcagtgagctgagatcacgccattgcactccagcctggcgacagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgtcttataccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcacagtctcactactcataggcccatctgttactactaacagtgctaatgtgattgtctgtaggtctagcaattggaggttgttcgtttctttgagacaaggtctcactctgttgcccaggctggagtgcagtggtacaatttcagctcactgcaacctttgcatcctgggctcaagcaatcctcccacgtcaacctccagaatagctaagacccaggtgcgcaccaacacacttggctaatttttgtgcattttgtagagatggggttttgccatgctgctcaagctattctcgaactcctgacctcaagtgattcacccgcctcagcctcccaaagtgctgggataacaggcgtgagccaccgctcccagcaacaattgcagtttttaaaggcagaaaatattacacaggtgggttcaaatttgccacaccaagtagaaggtgttggaaggaaaattaggaattcttaagcttcagaagattagtagtcagagttaaaaaccagacaattaacaagttaaaaaaaaattgtgaagcacacacagctgttatcttccagaaacactgcttacagaggtaattgctcacagattttagggtttacagcaggtatcacaggatttcaaatttaagaggggggtgggggcctgtgttcaaagtcttaagaatatccaagggatgtatgatgtatgcataattacctgaaattgaaactactgtagtttaaacacttgctgaaagaagaccttttatttcatcttctctacaggctgaaggaaagaaaaaacaaaactaacaactaacagaaaaacttttcatgtcgaatatgtagatttacaatatgtgaattatcatcagaagaatgaggttctttgatgattgttgcagataccctgaagaactggcccttgttgtagaagaatggcacagggcacatggtaaaatggccctggccattcctttagacattttgtttgtacttatattaacttgagagaaagtattaggaaaaacagagtaattctgtagaaatattcctgatgatacactaggcaaagcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgctatgtcagagtggagggacatggggaggcaccaggactggtcaagaggcagagggagagggtcaaaccgtgggttctgtggggaggactgaacgaggcagggtaagtagactagggtttgagtaagttcagcaggctctggggaagaggggctgtccctatttttctggtacctggccctgggtgattagaaagggtggatggtggcctggggcatgagaaataaaggaggtggtggggtgtaagttctggattggttgggttgcattcaaaaggggtgcccccaagtgagttgtttgctgcctctaggaatttattgaccctgggaggggagatcccagatgtcaaagcatgggaggacagaaaagaaacagcatggttcccacaagagagaagtagacagagacctctggaagtttaaaaatatatatgttgggatttcatagatgaggtgagcaaaaaattggccgggaagaactattaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacaactccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgtttattttgttgtttattcatttgcttgtcatctgtattttcccactagaactcaagtttgtgacaacaaggacctaggtcattttcactgctgtagtcccagttcctacaacagtgcccaggacacaccaggaacgtgacatttattgaatagatgaaagaacagtgtaaaaaccacattgctcttcactctgcctgcagccaactcaagaacaatttcctaaagcagctctgaaaattacgaaagaaatagtgcatggattccagccccagtaggcttctgggcttggtgtttctttaatttcatgtaaatttctctaagtaaatatgccttaaaagtgaataaaattttatttcgctttaacaagagaatataaaagttaaaaaggtcactgtagtaatagactaatctcaattaccagggcagcctctgaaaccctcactcccacctaatctcattcggtgcatacgcagctcaccgtgtgatttccaacacagctaaatgaaattataaagcagtgttaaatttattaatcatttaattagctaaatgttcctgcaagtactggctagatgaatggcatgtcattttctaatgcaatttgcctctcaggcagccagggtcagaaagggaagctcctggcatctcgaatgagctctttatatcacaccttctactgggagacggttgttataccactgattatatttgagacttgtacacaagaccagggcactcagatgctggaattggaaaatgctctctttcttacctgggttacaaagaggaggctcagggtagctgatgagtcccccagagattgtctctccccgtgtccccttgcaggacaaatcttttcatatttaacaagccactgagcagaacagggggaaagatagcaggcagtattaaacgcatgctcaatctagttttatttcttcaaatttactcagtcgagaaaaatttgtggagtgcgaattctcctcatgctaggtgactttctaatccttctagttgagtcaggatttatttctccattctcgccttctagcctgggcttgtcagcttggggtgtatgccgcacctcctctttgaagaggatcttcatttggaggggtgatctgactcccaaccctccccaggtgaaagcaccgggattcatacctagggggctttgggatttggggctgactttgacccgtcattatttctgactgcaaaattcctgacaaatgtctgctgctgggtgctctgtgaatctgttcccatttgcagtgagagtgctggcatcaagcacattgtctaaattcactcggcaagaagccgttggagtgggtgccacgtgaggccgagaacatccaaatgaacactggtctgtttgttcaagatgggagctgtcagttgtgagagctcctatgggaagagtgttttgatgtatagacatccctggtccacagagccaccaagcaaggcagactatttcgtgagaaagaaggaagatagactccatgcaacacagtgggtgtggcaccaagcgggaggtggagggttgctacctagtcccggctccacctactgtcacctgcattcccctagacaaatcacagcacctcaggatccttgatctcatcatctgtaaaacagagatcagatgaaccctcgatattaatatcaataagagccgatcataggactgctctaaggattaaatacaatgatgtaacctacttgaaagtgtcatataaattctgaggtgaagtggaggcattatggatgcattttattttgttttattttatttcatttattctttttttgaagaggtatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatatgtctgtgtgtacatatatgtatatgttctgtgtatatgtagacatgtatagatgcatgtgtgtacgtatacacgcacacatacataaattgtgtacatacacatatacatatacacatacaatacatatattctgatacacatatgtacatatatgtgtatacatgctatatataatgtagcacgtttcctggcaccttgtttggttcaataatgttgctgggattatactacaatttccattactctgactatggcaacactgctgatataggagatcacttttccgcacaaacacctctaggtattgtttaacacagacctcatgaaataggtttgccatggattagataaggcaattctggactcacttccaggatagaaggcaaagacaagtaccaatatatttggtaaaaatatgacatgacatttgagtgcacacaggcaagtgaaggtggtttcaaatcctccctctgtcttttcccagctaaatgaccttgtgctggctcctcacctcctaagcctcagcttatctctaggatggacgtcattgtactcccttcatcccacctaaggttgttgttaaggatgaaatgaaaagtccacagcataagcttgacacataaaataagcacccgatgaatactgactaaagagagaggaggagtaggggagagaaggagagaagagaggaaatgaaaatgtttctgaataagttatgtctaagttttttcactttttattttttattgttttcaggacagggtcttgttccattgcccaggctggagtgcagtggcgtgatcttggctcactgtagctgctgtctcccggattcaagcgattcccctgcctcagcttcccgagtagctgggattacacccaccaccatgcccggctagtttttgtatttttagtagagatggggtttcaccatgttggccaggctggtctcaaactcgtgacctcaagcagtccacccgccttggcctgccaaagtgctgggattacagacatgagccacctcacgtggttgagattttttcactttaagaaatgctttttctgtcacctccctggactgtcttggatttgtttctttgaggggaaatatgaggctttaattttccctcccaggccttggaaaggccaagagaagcctggagataggaatccacctacacagagtgtctcagtaaattggcagtggccaggaccagaaccaggacacctgtctcccagatctgtccttttcttggatagcttgaagttacgggtagttattgaattggtcactggctaccccctgaatcattacctgattttttactgagtgttcctacctgtgagtaaagggtgcctggttttgcacaagtgttttcttggcccaagagatatttttatatttgcctttgggttgatgagatgctggtatgtatcattcgttcagccattctttcagtaagtcatcacggaagtctgcctctgtgacagattctggggctctaaggcggaatttacttcttcaaagtacagtttcctgccttgcaagtttggagttaaggccacgcagaccagagttacgtgcacaggttgtaatactctctcttgtccctggttgcctgattcaagttaggggcttcttctggattccgtaggtaggatgctgactctcagctgtcctgatgccactggtgttcctctagtaggcaacattgatggtaaacatagaaagtcatggaaggcctcagttacctctagccctgaagacacagggatacccttggggcggagaccttagggacaggacaataaagatcaggccttgggagatgcaaacagtttgcccttggaccatgtcttctgctttcatccttatgctctcaacagatcatgccaaggtcctgtgttcaccgccttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcctgttgctctgtaattcatctcagcaaccatctttcccatctctgggaagagaatgttgtcccccagaaaaagtccttatggatagatttagttattgcttatggtttagagaaagcgcctttcaacagtcacatgcaagtattctttcaggcatttatccaaacacacaggatgaggcctctttgtcaaaccagtgtttgttgacaagcgacatttgtgtgcaggagatggctcattgtgtgtgtttacttggagctgttatatatgctgggggagacactgtgtatacaaacctaggagggagagattgggaggagggaagaaagtgaggaataggcttagtgagaaagagaccagagaaagagaaaagaaataaacattagcagggtggttaaacatccaagcattgaaaactgcgtggtggagctatgtactaactggggggtcttgaggaagcccattagtctccctgagcctcagtttagtagaagtaggaatcgtcattaaggcgcctcatttatgaagttactctgagctctataagagataagcatacagaaaactttggacagtgccttgcacacagtcagtaatcaatgcatattcatcatgatgttagagaaaggccgggcatggtggctcacacctgtaatcccagcactttgggaggccgaagggggtggatcacctgaagccaggagttcaagactagcctgcccaaaatggagaaacgccatctctactaaacatacaaaattagcctggcatagtggtgcatgcctgtaatcccagccacttttgaggctgaggcaggagaatcactggaactgggaggcggaggttgcagtgagctgagatcgtgccattgcactctggcctggacaacgagcaaaactccacctcaaaaaaaaaaaaagagagagagagaataaggtcagagggggaaaagagagaaagtgaaagcaacagtaaggaagagaattggaaaaaaaaaaaaaaaaaaggaactgatctggctgtatctgtcgagttgcttctgccgtttctagcccagcccacggttttccctctgcagggtgtctgtgggcatggtttgcaaataaacagtgagaagtataagctaaacatagactttaggcatatacataataggcaggcgtgatcgcgttcacccattcagtttgccatataaaagcttttcctcggtgccactttatggcccagaaacaaggctacaaaaactttaatactgctttttattttatagaaaaatataaatcaatactttcatgtctgtttgacgtgtttgggagctacagcaattgaggcttgccagtgtctggatgccccaccactaccacgccacttagctcagagtttgtttttttccttccaccatgtgaaatgttgctggttaaccagttaaaacggggagatggccatgattgcttttagattgccacttccacattgagtgaattttataataagaagccattttttccccgacaggctgcccttgtgcccgcctctctgactttgaggtcctcattattgtgggtttaaatgaaggatgttcattcaggcagggatggggggatggggggaggccaccaggcatcagcgctgttatcaggaccttctatcaggccaagtgacaggcgtccagagcaagaatgcagagctcatggtggagacctccggctgacaccaaaggtgactcccctcactctaaccttgaaagggaaagttcccactttattaaaatgaatttcgaaagggccgctctgacagctgcataattaaatactggagtgtcagcgataatttattccactcgcatgtggtggtcagatccttttcactagagggtcagcaaactcagtgacagaggcaaggagacaagggattcagggccctttgtcatttatgtagcaccagccctgaaatcggagactcataaaacctacaaatacacacacaaacacaaaccaggcaaacccacacaccacagagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaatgctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaatagaatcagagcaaattcagcatagacctccttgggatgtttattctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaagtagcacacaaacccagtccatgatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaaattaatgtcatttttataactatctgcatttcaggtacagtgatctcctttaaaaaggctgcgtcccagcagcatagaccagctttacctcccagcgtagtcttcagacaagttggggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagtttgcagcttttcttcccttttgcctcctctttagttcattccaatgataaatcctccctcctttgtcacagagccactgtgtactttcatagaccatcctatttttcaacgagagttcagaaccacaccatacgggcagtagtccgcattttcaacatttcctaacagcacaattgttaggtagctaacaattgaattgactatgtcaggtagacttatttttcgagttgtgctggttaactgcaatccaagtttaggaagcaaactaccaatttcatttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataaagaccagttgaacaaataaactatttttccatgtattaattctttagtgaacttgcttatttgttcagaagagacattaagctaagtatacaacactcggtaaatttcaacttcatcatatatataataattatttttttttgagacagagccttgctgtgtcatccaggctggagtgcatggcctgatctctactctctgcaacctccacctcccaggttcaaacaattctcatgcgtcagcctcctgagtagctgtgattacaggtgtgtgctaccacggccggctaatttttttgtattttattagagacggggttttgccatgttggccaagctgatctggaactcatgtgctcgagcaatccacccacctcggcctcccaaaatgctgggataacaggcatgaaccaccatgcccggccatcagaaatattttatttcactattttaaaaaattagcaaagaagcaaatatgacaaaatgctaacaattccaaaatgctaataacttctgagtggtgagtataagtgtgattattatattattcttagtatttggtttttttctgtagtgtgtagtttccctccatgacactgagggctcagatggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccatcagcttaaggcagcgaagcgaatgcccacagtgcccaagtcacttgcccaaggttatccaagtcaaataagacagagatgagattcaaattcaggccacaatgacttcaaaaacccttgtatccttgttttgtttcgtttccctgcaaacattgttttagttgagatgaaattcacgtaatatacagttaaccattttaaagtgtacacttcagtggcatttagtgaactcagtgttatgccaccgtcacctctttttagtttcaaaactttgtcatcaccccagaaaagcatacacataaagtcatcactgccccattcccttcttccaacttctctgcttttggtctctgtggatttgcctattctgggtataccacataaaaggaatcaaagaatatgtgaccttttgtgtctagctccgttcacttagcatgctgtttccaaggcttgtctaagttgtggcatgtgtcagtactttattcttttttatggctgcatagtattccactgcatggatataccacatcttgtttatctgttcatccattgatggacatttgggttgtttccgccttctaggtataatgacttgtgttgccataaacatttgtatacaagtttctgtgtggacatgttctcacttttcttgggtatatacttaggggtggaattgctgggtcatatgatcagtctaggtttaactttttgatgaactgacaaactgctatccacagtggctgcctgtaccattttacagaaaatctctgcttttaatacttctggatgtgttctaaggcactaggcttttcattaagttcatttctgcagaaagagttaaggagtgttctcaggtaactataatcaacccccagggacttactcaagttgtgcatgtgcaactgaaatatctggcaggcatccagtccctgttatttcagtctctccccgcctccctgcccacacctctgaagctccatattacccaggaagggacaatggggggcctagaaatgtggagggaggcaagagagtgataattatgccatctacacttgtcgactagaatttccaggtactttcacctctaggctcttacctggcttttgtgaagcccctcagggaagaggaggaaagctgggcaagggggaggggtaaaccaagtcccaggaaagtcattccagtttcccaagatcccggagcttgtttgtatccagctgagatccagttgagaccagaattcactctctccacacctccatcagctgtggcctcgagttccttaacattttttaaaacaaaaaacttttgcatgggaaaaatccctttagaaagttaaaggttttccttatacaaactatctcactttgaaaactggcccactgtaaaaatcttgattccggagcttccttaaaaatcttttcacccctttaaagtgaaagttatggagaatctattagatacaaattaatacgggcaaggcgtgtgctagctgttttataaacatgatcccacttaatcctccacttcacaattctgaaaagtcaacaaatttggcccatggtagagaggaggaaaccaagacttgaaacattaaataacatgtccaaagtctcccatttcagagacaggggcatttggctccaggtttttctgactctagacagtagtttgtttttagcacatcaaatgtctgagacttgtgatgtgttagaaagcacaaaggactttgatcacaagatcaagccccagagggccatgactgcataaaccacaacaactgcgtggctgcctgtcacgtcttcatctgcaagttggaggaacttggagaaatgcagtgcttccctgcagctgcagagggtctcactgagcactattcttggaattcttaaaagctgggcctgtaagccttttttgcatttcctttcagccacctcctggctgtccttttaaagccagggtaaagtccccagcacccagaatcaaggatggggaagaggaattttgagaatgtgcttcctgcttcacacaaatagctaaagacagaaatgatggcacaagccctaaccaacaactaggaaggtaggttgtccaagacaaattgcagtttagaatggacctgccaaatgggtgggtgggcaggatggctgggatcgccagtgcccaaccttgccacagcctccttttgtcactctagggactacccttttcctccccagacgtttttcctgactctaaatagtgggaaaagtctggtttgagattgctgtattgcagggaagttcttacagcgggcttgatgggcccagaaatcaagatggaaaaaaacaaccctctatgttgatggccatgcacagtggctcagcagaactggctctgttgaccaggcttgggtgctctcctgcagggcattgcaatctttaggacaccttcattacccctcctaaaaggagattttataatgagcgccaaccagctcaaacaagttaggatctcctaacatgtctggtgaaaatacaggagtatttttcatcatctctggaaaagttgctatcatgtccttcaataacccagtctaaccatgtttttccagtggaaatgattcccggtagaatgtcctatgttccttttgcacatttctccttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttggattaaaaatggtaccactctcataaatcaatgagtttcataccctaaattatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcctacaaatttttaatacattgacttatctaaatattcctgcatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagataattacaacatagggacacccggggaaaatgtagacgaggtttaggggttgctcagaggaggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgaaaacagtggttggtggtttataagaagttttttgtcggtgtgatctttcacatcagtttgctacccagaatttaaacattccttttttgctgctgttttaatttgaaataagaatggtagcccccaggtcccctaacagtgggtgctgatttcacagtgggcttacaaatgctcttcaagagtatctcagtgttgagtccagccacccaagggagactggttcttcactgtgcatcatggccttttaatgccattttgcttttttatcatccaatcagcagatgttctttcttcattcacgttgaaagcacttcgctatggaaacgagtaaagttcattgtcttattttttgtttgttttgttttctgatgtcctgacagcagaatcaatcttcggaatccttttcaataaaaaaaaaaattaccaaaacaaatatgatcacagaagcttttaaaatctgaaatcccaggaagctaattagtgcatccttttaagatggcttcctgcatttcgatatacgcataagcttgggtttcagatgcagttggcagtttgccatgagtcagacaggtcatcctgactctcaggaacacggagctcctgcagaagcctgtggagcgagggcaagttgggatcctcccctgtgttagcacgtgactgtcctctgtcaccatgtagcaggtggaggccaggaactacattttcttgggttcctggtggttagttgtacgccccatgaacttctctcatttccttaattatatccaaaataatgcccttgttttatttccccacttggcactgagccttagggagcaggaactgtgtatatcccacagctttgcatggcacttggcacgtaggaatgtattaaatgcagctgctttcgtgcaggaagcgcggacttcagatttggtcaaagatccatgatttcagagcaggcagcccttttaaacctgtatctgagtcacttcaatgccttgtgtttctgctctgggctgcaaactcaagagcagcaaccacttatcttggtacctgtagtcccgagccctgtgtctggctcagagtaggccctacataaatgtttgctcctcctcactgagtggctgcatgaattgcatccagcatgtctactctgggaaagaacctgtggagcctctttaggagtgtgtttttgccctccctcggaatctggtgatctcactaccaatggcaaagacaaactgtgaggtgtttttttgtttgtgtgcacgcgcacgtatgtgtgtgtgtaaaaaggccatggaaatataaaattgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccaggtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaaataagtaaataaatgcctctgtgaatccatttcattgcattggaaagacctccaggattctctgcagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttggggtacaactcagtaacccattggtgcagatatgtgattcttaggatggcccacatgggtctctttcacacacccacgtgcatgacccaagtgagcaaacaggcagagactgggaccagaagctcactgtggttctaagcaagcagttgaactggtggcttctgatggcctgagaagcagtttcccttgataagtcttcagccacacaaaaagagactgtagctcacaacactcacagtcaaagccactggaaataactatttcctatcaaataaagcctttctcttgaaaaatttgaagaaaaaaaaaaaacccacctagtgaaaccttagaatcaacctgaaggttcaacagcaggtgaatgattccataaatcatagtatattcacttaatggaatactaggtagccactaaaataaaatgacagttggaaaaaatacttatgataaaaggtttaatgacaaagtggggttcaaaatgagagatactctctgactagaactatattaaaagaaagatggatgggggagaggacggtgggtgatatattatctacatagatactttttttcacttttcaaagtgtttaatgtgttgcacagcctttagaatttgaaaatgtctaacttaaaatgcctccctagtgaaatctgtggcagcttataaactggcaggatactgtattttcaagatacgcaattgtaagtggtgctcacatacagtcagaatgtttatttgaccttgatcttgtgagggcttggttcccatggctttgtagagtgaaaggtcctgagaggcaggttagtgacgataccgggacacgtattgtagacaggttgataaagcaagcttccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagtttgagattagcttgaccaacatagtgaaaccccgtctctactaaaaatacaaaaattagccaggcgtggtggcgcatgcctataatcccagctactctgggcctgaggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatgagtgagcagtactcatggttaattttagaagctaataagtatatatttgataactttaacagaaatattaatactaattaagagtaaaaagatgatgaataaagtagcttcacttattgagcctttactagatgccatcttgcataaatggttgtcattttgcaaaatgtattccatctaatattagcagtaaccctgaggacttggtattcttacctggatgtgtcttatatcaacatgcacgcgttctctccctcagcataccgtgtcttattaacttctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttctcagtgatgaaatgttacagatcagtttgaaatccaactttattcaacataagaaagcctatatactctggagcttaaagactgaccttttcacttactgtaaggtatctaagacttctgggtgtgggttttaaatatattttggatgagctttgttcatgtttacacatggccaccaggtcggccacaaagctgtggctctggtcagtctgactctctttagcaggaatcacgtgacaatctgtgtctgtgattagctccgtggatattactaggtagatttctcacttgtccttgttttgatcttcattcctgggtgaaagaatcccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacacatcctgctccccactcccctaattactcatgattgcactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcagctgttacagtttgaagtgacccctatatggattgtttgcacacctgtgttgcaaatgtattagttaggataggctgagctacagtaagaaatagcccccaaaatgcattatagctgaaacccccaaagggggatttctaacacagaaagcaacataagtgggtagtcctggccaatggcagctacgttccacaaagtgactcagggatccaggctgcagccacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgaggatacacacagttttctccccattagcatctccagtctctggtataaacttgagtcttctctttggtccctgataaatatacatagaatgtatggatgtgagaaagttaaactgatgtctgtgtgtcttcatgtcattaaactttgaatctacggacatgtctttttctttctggcatagtttggaggtcttcattttgtgattgaatacaaaacaccgagggctttaaggaggcatagtggtatgttcagctgtattttctcataatatagagtcataggaaacctgagccttggcatttgtaaggcgaaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactcagtgcacaagtccttctgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttgttcttttacaaaaagggtcagcagactttctgaaaagggacagatagtaaatattttaggctttgtggaccatagggcctgtgtcaaaagtactaaatgttaccattttccttactttgttcaggctgctataacagataccataaactaggtagcttataaataacagaaatgtaattcttaaagttctggagcctgggaagtccaagagcaaagcaacggcagattcagcttctgttgagggctcgttccctggctcatagatgatgacttcttgctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagctcactacagcttcaacctcctgggatcaagcagtcttcttgccttagccacccgagtagctggatgacaggtgagcaccaccatgcctggctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgggatgtgcctacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaatcagtctactgtgctaaacctggccctgcctcagcaatattctgtgagcctggaggtcaagagttaggggaccaaggtcctgctaaggacacatgggggaactaccagaaactcatcatctcatttaaactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacataaaaaccgattacaacatttttccatttttatgtttcctctgaaaccagccatgagaggtactgttagcaaatcacgccttattcctaggcagacttcttgggtacactttccaccctccccagcagtaatgcctgaccaactaatggaatcctaactaatgcagtatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttccattgtatttgagccactggaaatctattacctgatctttctttaccagatccttctttagttgggtatggccaggctcagtgaatccagtagatgtttgaatgggaaaggactgaaagatctcaaccttgaatcccttaactccttgggatgtgtaatggagatgtataagctgtttttaaacatttcagcagctgtcatggaacttaaccaaatgagtctaagtaccctatgaacacatttgatttaggttggaattacagcatagatgtgaagtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgacgctggtgcctaacttctagttccagacaaagaaggagagagagagagatcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctatccgttaacaggtttatttcttcatcagatattaattccagagggtttcacccattataaaatggacataaagcctggggtggtgatggtgctgcctctgtaaccaggctcagctgtgtgtcttcgtgagcctccttgtggaccctcaaatgtgggaaggagataggggcaggaggaattggggaaataggaaccttagaaaccctgaagaagtggaaagagaaaaggaaggtcagtcattcattcaattgcttaatttgcttctttctttttctcttcttctttctctctcttctctctctctttctccctccctccctccatttcttcattcctttcttgtctccctgtctatctgtctgtgtatatctattcatctatccatccatccatccattcatcaatccatttatccactctgaatagaaacctaatatagatatacaaaatgaaaaactaggaaaatgcaagaaaccttgacaaaattgctactgtttctaattccaatacttaataataaccactgctacatacaaggacatttgtgtctggtctttttccctattccaggcacatgcattttaatacagttgagatcatattgtatgtctgattttttagcgtattagattttttacattattaagttaatacatgctcatttaaataagtcaaacaatatgaatatataagaagaaaacgctcgtaatttatgctctacctcttccctttgctaagtggcaattttggaccttctgtgaccgtgcaaacatgcagattatacatgcactataggagtggaatgtatgtgacttaatagcgtaatattttgtccattattttaaaacttgctttatttggtcaagacatacggaacacgtatagatcaaacaaaaatttttaaaaatgcttgcatactgctctgtgctgtggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattttgtatcctgtggttttacttaacactatgcagaacgatttcctcgtattgttgaaaactcttggtaggggttttttttttaattggctggaagcacttcatcatatagttgtaccaaagtttgcttaacatcccccttattactcagcctttgggtggtatccagttctttgctttgataaataatgctgagatgaacatctttctgcatggctctttttccttcttttgacatacttggagttctagaagtggaattactgggtcggaggtcacaaatggagaggtcttttaaatctcagcctgcaaacaatcccactgcaggtttaggctgcatgtttcatccatttgcagctgtagcattttacaaaccacagcataaaccctaggaataattctgttccccactgggatagagcattgttattaatataattttacaaacatcattcgtttgaaagctttatccagcctcaccacagctcattagtgaaccttctgacaatcccggggcagtttgtggattctgcagcagacaggttatcgtgtgctgaagggtaccgcaaggggaaccttccaacatccccaccctacccaaaggatgattcctgctcacaccagccagctggagacattagagcattacttctcggtggcaagggagggactcttgttctttctggtggttcgttttcatcttcaggtcatgccctgtgtcacctgactcaggcaccattagcatctggggctgtacacgtctttgtactgcacactgtagggtatccaggattcctggccctgccccatgatataccagcgccatgttgtcatcaaaacgaccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatatcagggtgtttaaaagccaagattctggagtcagaaggcctgggttcaaatcctgacccctcctcttgcaagcttgtgacaccgggcaagttattaacctctttatgcctttattttactataaatatgggataattatagtttttactgcatagttttgttatgaggagtaaatgagtcactatttctgagacacttcgtgcctggcacagaacgagcactgtgtgtgtgttacagaaatatatgtgggtgggtgtgtttctgttttccgtaattccagctaggcaaagacatatttaacaaaagccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctgccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagccttgcccactgtctgtggctgaccagctagactcttttccttttcttgcaaacctaatgtaggtacaaggtcaaggctccctgtgaggcttgcatagcaccttcaaccttctagtctttgtcctcccagaaggaaaaaaatgagaggagggagggacacaagaaaagaagatgcattttgtcagccaccgtgctatgaaatgctagcgcagatgacgttcagaactgccctgtgagcagacataaaagcttaggctcaaagagattaaatgtcttatttctgcttttggaagatacacattttatttttttctgtgtctctgaattggcatccaaccataatcattgtgctaatttactgtattcttactctccctctccagtgctgtgagtaaatcagtgtgttccttatacttaataacatactaagtggcaataataattattataacaaatgtatcaaataactatgtgtgaactctgcatgtttcagcccatttaatacccattacctacggaggtggtttctactattgcacccactctacagatgagaaaatggaggcacaaaaagttaaatcatctgccctaggtcccagagctggaatttgaaccaaaggttctgtgcctcccaaatttgtattcttatctctgcatcacactaacactgtcactcagtccttttctcactgctctggtctctatacttagagcttcgagacctgccactcagatgactccagaagaaaacacgctttggtgtcgtgcttgcctttgcccttgtcactttctcaactctcctcacctctgtgactgcatctttataactctcctttattagtgcttttgctggaggaggcaagcatgaacattgtcaaaaggactcaaaatggggaaaagtggcagcaattgccagcacaatcactgaaaaatcttctgaatggattgtaaattaaaccctcccccaaatgctcagaactgttgaattgactaattcaaattcattgagtcagatgcagttagtgtaacagtctatagtaacagtgtagactattagtttgtagagtccacacagaagagtccaattttctttgcacaaagagcctaccattcatttattcaacaaatgcttttgaacacccatcactgtgacagacagtggcaatgcatgtaggaacaaagtgtgtccatgggggcagagacctggaataatcagtcaccatgtaaggaaattcaccagaccaccaatttccacgccttgtatgtttctgttgtctttgctgcagactgaccaaaagcacaagacaaactcttgtccacttggattttagcatctttccctgaccctgcctctgactctggtgttgtgcacccactctgcaactctccaagctccagccctgtagtgccagcctgtacctgcctctcctgagggtcaatatggcatccagccttggtgaagtctcccaccccgtggtgattcatatctgaccctgagaattttccacctttcccagaagagtgggagtctaggaagacaaatagccaagataggagtttgaagaggaggcaccaatggcaatttgggttgttaattcctccagctaatttagttctgatttccccatgctcttggcagtgagacagttggctccagaggaaggtgataaaaaggaatcagtcaaggaacaatcaagaacgtgttacttttttggataatcattggctgtagggattctcctttacattttaaagagggatgaggttgagtctgtccctagcactgacaatgaaacatttatgctgtttataaaaatcaggaaacacacaaataatttgattaacgctcaccttctggtccttttgtgatttgagaggtcttgagataagaaaaactgtggatgaattttactgaactattgaattgagaatggctgagggggagaggccccttccctctgtgaaatatagggaaaagttgtttttcttttctcctagtttcagaatacttggacttacagtcccaaatagcatcatttcctggtgaagccccctgaaccagacaggaaactgcctctcttcaataagagcagaggcagtctcaataaaaaacaaaatttcaacccatcctccgctttggtggcaggcagttcatcttctcacctctacttatttacagtttgaggggaaaaaagaggtaatacttgaaagtgtatttgaccatattttctaactgggagacaatttttttctttaacaattacttttggacatattacttgttagttaaaggagatgtgacacctcctgcccccctggccagccaagatccatttgtcatccaggtagcctcagaacggattgagagctcgccgcacagatctcatgtcaaagacaggcgcgtctgtctttcacggcttgggttgtcaggatgcagggagggccttttgtcaaacacctgccgatgagcgtttggcagagcctgtgctaagacatcatagatttccttctgtgttgtcttgagagcagagaaggtggcaggttaaagggaatcaggaaagaaatgagagtgaggataaacgagagggtgtggttctcagggtagaatgcatcggacactgcctagtgtgagaagggactcatctgttttctaggaagtactataaaaaagataaatttagtgctcagatatctgaggcctgatattaggaaaaatacggtaaggcatacatttagaacagatgccatgtctgtgtgtgtgtgtgtgtgcatgcgtgtgtgtgtgtgtgtattattaatatgtctgctggccttgagaaggtacattcagagaattttctgaagtctttttcacatggcctgtattgtcaaaaaatgatgttgggtgttttctgcctgtggctgtgggcctctgtgttcacacagatggtcatatgttcctaaaggatacatccaggactgtgctgacttatttggggtggctgagaagagacatgagccagatgataacaggaataattcagtgtgtgcttcccatggctgctgtaacaaactgcacagcctagagggcttcaaacaacaggaatattatctcacagtcctagaagccagacgtctgagaccacagtgtggacagggccatgctccttctctagagaactctccttgctcctctcgcttccggtggttcagtggcaacgcttggtgtttcctggcttgcagctgcaactatctgacctctgcgtctgtcctcccacggccttctccctgtgtgtttctggatctcttctcctttgttatcaggacactggtcacattggattaagggcctaccctattccagtctgactgcatcttaactgtttaactctgtattccaatctaattacatgtctatttccaagtaacgtcacattctgaggcaatggcggttgggacttgaacatatattcttcgggacatgattcaacctataacaagtaatactagtaatcatctcactcctgtaaacagtacagttgccatacctcaagtatctagtatacttgggacattagtctgggaatttttctccaatcctcacgctagcatttctagtaatgaggaaactgggggtcagggaagcttagtccacatttctcaccttttctccttttctcccatcccccagccagtttttcaacatattggtttttcaccacatgctcactgcagtgaatgttcactcccaagcccaaaagtagacatgtggagtgacaggtgtcactatatcataatatgaagaatttcaaaagccagaagtgcttgagaaaatataaattgtgcagtaaaagaaaacaccctaaatgtgcagagcaggaagtagaatgactctttgggtattgtgtttgttaggggggtcattagaaaatcatagacactgagccgaaccccctgggttcaaatcccagctccaccacttacgaattgaatgactttgagaaagttacttaaatgctgcgtacttcattttcctcccctgtaaaacgggttaatatcagcacttatcacatagtttttgagaaagctaaacgtgcttatctatagtggttattattactagaaagaatatcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacaccgcacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcctggctaatttttgtatttttagtagagatggggtttcactatgttggccaggctggtctcgaactcctgggctcaagcaatgcactggccttggcctcccacattgctgggattacaggcgtgagccaccatgcctggccccctttcacttgtattttttgagaagagaaagaaagaattatgaatgaattcttctgagctgtgagtccttcctgtgcaccaggcatggatggcaaggcacgattgataatgttccctcttatctcgaaatgtccactctctctcccatgcacggggagtcaagctgtgctcttcaaacacaaattccttctcccacttcctgggtagttatgctcttttcttccctgaggttgctaattgtgggcagtacagtgtagagtcactttgatttttctcatctccttcctggaatgtgccacagaagaaaacccacgaagtcttgagctaaacgaagcagagatgggagaagggacaaggtgggaggcggtagtggtgctgcatgggataaaaatggaaacacacacttttgccctctgtacccaaaaggaaatgtcggtggaggcaggcgttcaagctggcctcgtgtttgtggttttagacacagctttgagtcgtgaccggtgtggccaagacctatttcccttgcaaatgctctctctcttttttcggtaactgtgttactaaagttctcttagatactttacatttcctttcacggatttccaaaatttctttctttgagaatgtcaggaccagtaggaggttcagcacgcattgccagagaaatcacagatgactaattggaatgcctcagaatcattctccttttgtttcacctaatttccacacttacgaagtcaaactctcagttaaatgtttatctagcaattcatttcttctgagccatctgttgctaggcaggatctgcagacctcttggttgcatgtgctgggttgggtcctccaagtctcttagcacaaagtcctgatgtttaaatcctgcaagcgaattgccacctttatttccaagttctcctcgaaatccacattcttccctacagacaacggtggggttcagtgtttgcttttcctggggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaacttgtctgctagaaacctagggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacgcagttgttacctgctcccggtgggaggggggggatatttatttggcatcttgcaattgataggagctgagtgattttagtaggtagtttaactccttaaaaacttccagtggtttcatattctacctagttttaggtgacagctggtatggggtggggaaggggggggggataaagatattaatttggaagcatttgattgctccattattttatcatcttcccatggaaatgttttcataacgccttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcgtaggtctctgaaaattcagacccacagaggccttaccccgctacagagaggccccaagagagaggcctcacaccctctggctccactgaaattcacttcacgtttccaacttggattaaactggcacgacagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagttttattggaacacagccaggtgcatttgtttacctattgtctatggctgcttttgcactacagtagcaaagttgagtacttataaatgtagagcctgcaaagtctaaaatatttactatctgcccttttgcaggtaaatttgaggactcttgagttagacagctaattagttggtgttacctaaattttgtgaattgtggctaaatctctcatttgtctacacattcaaataaaatcatgtatcaaaggtgatgtgtgtataataagatgctgggaagatgagcaaagcatgacttcttttttttgttgtttgtttgtttttaagagacggggtctcgctctgttgcagtgtcgcccaggctggagtgcagtggcacaaccttggctcagtgcagcctccgcctctcgggttcaagcgattcttctgcctcagcttcccgagtagctgggactacaggcacctgccaccacacctggctaattttttttgtattttagcagagacagggtttcaccgtgttgcccaggctggtctcgaactcctgagctcaggcagtctgcccgcctctgcctcccaaagtgctgggatcacaggcgtgagccaccgcgcccagcccatgacttctcttcatgggagagaaaggccaccgagatagtaagtggacatcaggacatggattctattaaatctaacacctttatctttgcatttccatacattttgcttatttcaaagtagctacaactgcacaaagaatgggctgtcctctcctgctactttataaaagccaagtttttgcttctagctggtcgaaggtcctgtgggagctcacgtttttctcaatcactgatgaccatttgagacataatttggagaaggtttctatcaaatcctagttggactgcagtgaaatgttttcaaactagagaagcaccaaataggccatgataaagaataaataccacctaccccaacctggcaaatgtgtgctcacccaaaagtagtggagcctcaagctcagggagatgtgactggaaaatccactgaataaatgtctatttaaaaaaatcatagcgtctaggggatatacacttctaagcccattcttcaatggagaattacttatgcgcataagtagtttaaacaaaattagtggaaaaacagggagtttaagggagcaagagatcaggtcttctgggctcaccacacatcaggtgatttaagctaaaaatggcttaaaataccgcaatcacttgaaacgccttacataaactgaccaggaatctggggcattcgcgttagagacaattttcttctcctcaagataagggatggggaattagtcatagggtatttccagataatgtagttaacacctcgtgtaatattaggtgggcagggagctctgctctcaggaccaaaattgctcctgccagctctaatagggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattggtcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacgcatcccttttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcgttttactccttgtctcacattcctttctgctacttctctttggctcaccaaaaggagacagaagtttgtgtccatggctgtgaactgccaaagagttgccaattctctacgatctttgacctctgtgatcccaggggcaaggccagcactttccattccattagacttcattctcttgtgggtgctttctgctggaatctcccaatacagaacagaaagcacaggttatggaatcagatagaccaaagttcatctccaaatttgattccctctgcatacaagttgcttacccttgggggccctgtaaaatgaccataatagtaagcacctctgaggctcactggaagaactctttgttgtctgcacagaagatctcagcactaagcctggaacagaggagacttcagtcgatgtagggcatctccccaaactgcttttattctttatgcctcactgaaacttgaatcaaaaagcggctggaggaaaaagagctttgccaccgggcagtactgctgggtcttgcgtcacagagatgccttctgctcccttcttcagggagacctcagggtatgaaagtgctgcttacccagcagatgagatttagtccagtcatccatctgcgtggtctctgtggataaagtaagcgtttcattcaacttttaaaaatattgcaaattgaccctcgcacatcttttcttactgccggtcacctagccagcaaagaccccaggtgagatcccactggtttggaggaaggagaggaaagtccccacttgggcaaaaacaatttaggatacctgaagattgcaaagcccagctcctcacaaagggggtggcagctggggagaagctgaatcagtagacagacaagattgtggtttaacgagttcagggacaagagaaggccccagtaacctacagaagcaactagctccttgccttctgtacaacatggcctttggagtcacaggacgtgagtttggatcccagctctgccacttagtaattgtgtagatttgcacatgttgctggacctctctttgtctcagttttctgtaaactggggaaaatcttagtaaatctagctaacgtggttgttatgaagattctgtgtgtgtgtgtctgtgtgtgtgtatgtgtacaaagaaagtttagagcagcgtgtggcacgtaatgcatattatgtaagtgtagctccaatgtgagttgttacttgtagagaacagctatgtcaaaaccacaccaaaaacgatttggaaaggaaataatttgactggtcattttgtttatccatcaactgagttggattgatatatttttcctttggccttcaaaggaaatttgagcattcattcattcatccttttagagaaatattctctaagcacctaccgtgcgccaagctttgggttggatacctggaacccctctcagtgagatcacagtctaacagcacacacccaactatgaaatatagatggactgtgaagatgaagaaaggttctggttatgaactcacagaggaagtgacggctgaactttgtaaggacacaagtggtttaacaagtttcctggcccatatgagatctcggctccgacgttacaggcagcagtgtggggcctcaccttaccttttcccacttccatccttctccacccccgttcagttcccaggctccccttgtgtgaactggctcatttctcactgcctttctgttctacagcccccgctctgctgagtcaggaggtgctactttctccatctgctttccatcgtccaaaatttttgttgatgtttcttgatcactgagttaaataatttttccccgtattatacattcagtagagtttctggagagagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagaggagaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctcctggagtgcgtgttgctttggtagggagctcgctttggctgtgggcagttcctgaggagggactcataggacagcctagcatctgaggaaatgagtgcctcctggcccagaatgggggatctcagcagcacactacaatatccactacagtttcttgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtgaggaattatagttgaaaggggaaagaacatttcagtttttcatttcctgcgtcactgtttttcttatttggagatgctgttcctctcaagtgggaaaaatttggttatctcaggtggtaaagatgcctttgtttaaaatattcttctgttagtggggacaataatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagatttcacaatgagagaccaagttgaaaaatgcttaaaattcacaagtctatatcattctgtcctccaggtaccccaagctggtttgggtttataccagtttgaaccgagggaccttcagctgaggaacatgtgctctgtgtgctggaagctcctggaggccccagggttatctctgctcacttaggtttgtgatgttgggcaaaaggagaaaatgctgagtctattcggacccaacttccattaatgcctgagaaataatttaaatcgcaagatttccaatcccataagcagccctagcctctcttctcctgatactccacatacccagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcggtgtcaccctgagcatctttcaattccttgaacttcagtctcctcatctctgaaatggggttattatctacctgcagaggtgctgcagtattaactgaggcaacgttgcaccgtttctagaatgatatttagggctcatattgacccagtaggaagtatagttaccttgggccaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttgtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcaattggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagagagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctaactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttggcctcccaaagtgttgagatcacaggtgtgagccatggtgccaggcctctcctgtctttaactggggataatgtgtgcagaattccccctaaaggatctatcatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctctcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactggcaagtgcctctgtgctgatattgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaaccacatgaaggttatattattatgtcgactttccagatgaggagactgaggctcagtggcttgtcataggtgtcaaagacaggagtccagtgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttcttttctttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaaccttgacaatgtaatttgtcagaggaaggcagcctgttttataagctcaggtgatttcatttttgttcacctgtttatttcatgacacttgcaggaaaaagaggaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgccttttttttaataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttgctgggagaaggtcagagctggagtggggcactcgattccggcaagagaaggcaaacaaaagaagccacaacagtctaggaagaaatctttaatttctattcagctttaaagagtttgagagcgttttttcccctctgttaacaaacgagttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttgaaaaagacatacctttgtaactttctatgctaaggtgttgcataatcaaggttaatttttgtttgtttctagtctatgggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaacagcttgtttgtggttcgtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagctggaaaatttcagtgacatgccatcagatttgttccatgtagaaggacgacactatcagttagatgcttattttgttggcaaatttctatggcacttctgcttggccacttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataacagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgacagcgtaccaaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgcaaacaggaaaggccacaggacagctcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtccccagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcatgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacatgcgtgggaactgataagatgggggttgtgtccacttcacttgtatgggatgtcggtgctttgaaaaaattctatcatcaaagagtaggtttcttagttctgcaaatctggcacctggagatggcattttgaatcggacgacctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagagctctgtgagggttaggcaacaatgcttacaaagctctccatgcagagcctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttggttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtagacggccatctattccacctgtgacatgagggctcaccccctcatctccaccgcagcagctctctgataaatgtagctctctgataaatgattctgttcctagtggtgtattcacagagtcagtggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgcttttttttttctttaccatatattgtttatcagaaacctctgtaccctttcctttaaaggagtcaatattcatttgtattctgtgctgacaactataaattgatggctagcagttatcaaatgaatgttgatgaaaagcagctacttaacattttcatcccaacaccgagttttggaaggatggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattctactgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtattgcttcagatattttataacggagttgttaacattatttcctttagatggctccttcatcttttctgcattatgaactgatgccccaaaaggtggtatgaatgaaagtcatctgatggtgattaaagtgctctttaaatttttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtgtgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcatagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattagacttgagccacacaaatcaatgggaaaagaaacagctgaatccaggataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacaacaatgacaacaacaaacccaagtctgccttatggcacattcttcacgtcgtaacaccttccttgggaccctatttctcagtatggacctgactctcccagggatcctagaatgcaagcatagtgattgcaaaccagaccatttgagggaaactcctctagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttaattatggcttgcaaagcaaagtgatttcttgccctctttatagcatccctgacagtattctgtcagtttggatgatatgatgcctcatcactgcacacgtccctagccacagccccaactgttactcaaaaggtgaatgaaagtgatcagctgcactctttgcaacttacattttgaagtgggctgggaggaaatgtacccccttacctgtggtcccattgtaaatctgggtcaaatatgacatttagaaaaaggttttcatgggatctggatgaattaatgtgttatgtgtttgtgctaagtatgaatgtatggtgaggagtgtgtgtgtgtgtgtgtgtgtgcattaaatgttttaacacaacattgccaacccttcccctagcagcaccgtgggcaaagcataaagggatgatctggcagcagccccacttgggttttctacctgatggaccacaattaagagtggttggtttgtcagacagaaggttctacaaacgatttggtatcgaattacattatacatggagaagtcgaggggttggatgaatttgttcttgcacgttcagaaggataccatctttttctctgtgtggaagaggcgcctgccacgacgtattgatatgtgtatttattttccaagcctgtccctgtatgaggtgtcaaaagttacaccagctttacaagcggagtttatgaactcgtttttccaggatagtcacattatactttttacagtcatgtgctttcagcccagtaccctttgctatgccaagatccagctgaaactgaaccaggtgggggaggcctgctaatgcccaggcagtcgaaatgacgccatctcatcactccttctcttaaaatttttttttgtctttcttcttggatttccagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcattcacaacagagtgaaaaatcttaagtaccaatgggaagcagggaattcctggggtaaagtatcacttttctggggctgggctaggcataggtctctttgctttctggtggtggcctgtttgaaagtaaaaacctggttggcgtgtaggttccgtatctccctggagaagcaccagcaattctctttcttttactgttatagaatagcctgaggtcccctcgtcccatccagctaccaccacggccaccactgcagccaggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaagtttgtattgtttctttaaatgtttgtttcagtttgtttttgtttttcattttttagaaaagaaatctagaggaaaaataaagcgcttctaataaagcgcttctcgtagatgccaggaaaacacgattcttgtttcttctctgagtgagtttgtgttttgtttttgtgctttgtggctgtccgtgggccaagttgtctcacgcgattagcatgccagcatattttctgttaaagaaagaaagaaaaaagaaaaatgactattgtttcatttcaccttaagatgttttgttattacttacttacagtgagttattttagtcctcaatggtctgctcccctgcaattagcaagtacttagtgattgattagcgggtatctctatgtttgagaatgggagctgtgcagaagctcttatctgcgcatcccatctcatggacaccatgctttccagcccgttccagcaagcacatgagaaagtccactctggcaagacggagaaaatgcttctgctgaaataccaggaaggtgtggaggctgggtgtcattgttccccctcctgatcatggcagcttcaggccagacaatgtcttgaacttctgtgcctctgcatctgtggtgcagagcagtcgaacaaacaaacaccattgccctccagtggcccatagccttgccacatcctcccatctggctatagtcttccttacgtaatccttattatcacaggacctttgaaactatgaatcagataatgtcacttttcagacattattgtcatttgcaaaagcagccgtcagaactccactctcagaatctacacctggaggggatcacccctcccatatgacctctgactttggccatgtgactggccttggccaatttggaaagtgctttgcactggggcttgcctttccttgttgatctttggaaccctgcaacttccatcatagggaacggctcctgggctagcctgctggatgatgagagacacgtagtcactcccagaaccggcatccagcagttacttagttagacatgtaagtgaggccatcccagactatccagccccagctgtgccaattcagaggagaagaaactgcacatttcactcacagcactgcaaaaagatagtaaaagtttattttaagccactaagtttcaggattacatgttactcagcaaaagctaactgatacagcttctcagctcactaaggttaatttttttctaccctacttctcttataatttggtctccagctacctctctaatctcaacttccagcactttatccactagaagccactctagtcttcctctgttcctcgaacatgccaagcacactcccaactcaaggggtgcatatttgctgtttcctctgctgaaatgctttccttccagaaaccagcatgcctttcttcctcactgatttttagtctctgctcacgttatccctgtcttcatggtgtcaccccattcttattccccttcccctctattttttctccacaacacttaatattattgtacacattatgtgtctattttttctgtctacccactataagaaactccatgaaatttgtctgttttcttcacaacttggccacagtaccttgaactgctcctgtcacacagcaaacttactgacttaataaataaccactgaaagaatgattctgggtgactaggctttatgttcaggaaaataatttccatcattgtgacaatgatcccgagccacacactgtgctaagcaggctacattaccactgtcgcccgggctgcagtgcaatggcatgatctcagctcactgcaacctccacctcccaggttcacgcgattctcctgcctcagcctaccaaatagctgggattacaggtacacaccaccacacctggctaatttttcatattttaagtagagacggggtttcactatgttggccaggctggtcttgaactcctgaccttgtgatctgccctcctcag

SEQ ID NO: 14034 - DNA, 4493 bp, Human
tacccttgtcttagttctccatctcctttctatcagccttcaccttcagccgcctcagtcacctgctgccatgccacagcccgggcccggaactgctctccctggaggtcttcagccaaaggcccagtctctctgacctcaccttccagccatcttgctcacttcattttggccctggccagtacctgtgtactgtctccccacctgcccaccttcctcttggccttgggcttgtgtcccgtggtccatcacatcacctgtcccttgtcagtgtcattcactcattcatccgttcattcattcattcattcgatcattcgttcattcattcaacaagcatttctgaggcctctgtgtggcaggccccgttctggttgctggcctagagtaatgacaagacacacttcctaccctctcaggactgtgtgtcacaggcaaaaactgagcaactcaacaaataaaaagcagaatgtggtgctgggaaggttagaaacagctcccccatgtggaggaaagggaagcctcccatggtagttccttagccaagttgttcccctctcccctgcccctccagctacaaagcaaaaggttctgtgaggatcaggcagtttgacatctagctgtatggttctctcaaatacccttgggggaatttctgccaatgacccccagaactgaccccagggcttgcagtgtggttttaacaggaccgggtattctgtctcccttggtgcccctctgctgttcaggtagcccaggatcccactgattgattagccaccatctcacaattgaccgtgcttgtggtccactagacccttcagattgttttccgttgtgataccttggccttgactctgtcctcttttctgtgtgtggcgtgttgtggcgacggccgctccccaactcccatccccactctctccccaactccggctccactcacactccagttctttcatttccccagtataaaggctgagcttctggttccgccccgggccctggggatataaacatttgccagattcttcctcggcccctgggggaaactgaggattaattcaggtggagtaagtggtgggatttgggtagaagtgaagccttgtcctgttgtggccatggtgcagggctgcggcacagccagccatcagtgtcatccgggtcagtaatgctcaaggcacagtccctggcccagcagcatgtcacctgggaggtggttaggaatgcagattctcaggcccacagagccctgataaaccaggagttctgggagggggtccagcaatctgtgtgttaagtcctgagagtgagtctgatgctcactcaagtcttgagaaccacgggtctgggtgagagatacggtagctgggctgagatcctgtcaatgggactggaggggaagggtcccggggtgtttgggaagcagaatcgacaggctttggtgattgggtgtggaggagtgagagggaggcgggcgtcaggggtagctccaaggtttaacttaggtgacttcagatctccaatcaccaagccctctctggtcctgccttctccacctgctcctgcgggtcttgcatcttctcctgtgtacctccagtgaggagtggtccccaccaccctccccatcagtgcacttacgaagtgctctcatcttcacaaacaagccagcacccagcccagccctggtagtcagggcggttgccacagcaattgacatcagcgacctggtccccaaggaacctgccaccttccgcctgcctgcagggcctgcattatcgcttctgcggggactggagtggaggcagatggggactcccacccctgacacacaccccattttgagaactgagtggggctgggaagagccagtggcaaagggaggggaagagggaagggcagaaagtaggtggggcccccctttggtggcctcttctctccacggccccaggctccagcccacttgggtccttggcgttggtggcagcagcacttgggccatggcggaggacaggccgcagcagccgcagctggacatgccgctggtcctggaccagggcctgaccaggcagatgcggctacgcgtggagagcctgaagcagcgcggggagaagcgccaggatggggagaagctgctgcagccagcggagtctgtgtaccgcctcaacttcacccagcagcagcggctacagttcgagcgctggaatgtcgtgctggacaagccgggcaaggtcaccatcacaggcacctcgcagaactggacgcctgacctcaccaacctcatgacacgccagctgctggaccccactgccatcttctggcgcaaggaggactcggatgccatagattggaatgaggccgacgccctggagtttggggagcgcctgtcggacctggccaagatccgcaaggtcatgtacttcctcgtcacctttggcgagggtgtggagcccgccaacctcaaggcctccgtggtttttaaccagctctgacagcagctgccagctgctgctctcctctagcccacctgtgctctcccctgcccctgccactttcccccctgtatttttggggccattattctcgctgctcagcctgtcctctgcttgcccagaggccccctgagtcccacacctttcctcctctgcttctccctggggccagcactccagctcacaggaagaagattctgaggctccatagcctagaagctggactggctgctgcattgctatagacgatagaggcctactaggggccagtgtgcatggacagtgaggccagggccatctgccttctctctgcttcattgtgggagagagagactgagaaagaccaagagagacacagagacagagattgaaaaacccagcatccacttcctccagagtcagggagacagagatgatggggcgtctccacggggagtccagcaagccggcattcactgctccctggccttggtgccctttgccggagcctgtgtctgggctgctggtcccataacacgtcgacaaccctcaggatatggggcagggttgctgcaggggtggatttgggcagtggagagtggctggcaccctggaggctgtgtaggcccagctgtggctcttctgggcctgacttcagggtggagaagtgaagggggaggttacacagagatctgtctctacgcacacatatccatgagacagagtgtgctgtattcatatggatgtattctagaggtctattcctaccctaggaacaagtgcagttttagattatctgttcatcattgctgctggttcaaggatggctcttaacaggggcctggtccggatgaccttggcctgggggcttgctgagctaggagactgcagttcagatagtgaaacagggagtggattagtaaagggggttccctttgccttgagggaagttggagctggagagagtggattctccagggcctcaggtatcccctgctggggagtcaggctctttagagcttgcaggtcagggaaggcaagtgcttcgtcctgacatagcatctgttggcatttcttgggcttcttcaatgcagctgaggggggcagggcgaaggcgtggtgggcagttacgacggctgatagtcccaagtgggctgcaggcggcagtggtgtgacggcagaatggtaacctctggggtcattggatgcaactcactcaccaaacagatggggaaactgaggcacaattttcatcagattcagttctgactcttagcctcattccccttcgcattgcgcagtcccagagagcccccccttttgggggagtgcctgacctgcacctaacatcagccaagtacagctaagccactgtccccagcaccctgacttaaggccagccctgtgttttgtcctcagccagtcagggatgtgtccaagacatttcccctcatgaagcaaagctgtcaaggaacttgcggctctggaacagatgcactgagggccagagggtcagggccatcccctgtggctggggctgccgggagggtgagccccacctcggaggtgtgcaggctggagcagcatgctggagctgagattctgtgggtgagagagtgggagagtgtctgtgggctgagcactggtcctttctgactcacagctctggggcccattccgggacaggcttgaagaagtctcggccattgcctgccctgctgagcacgaggggaggccagaaccgtgtgcagtggccctgcccttctgcttgagctcttcctgcagctctggggaccctcttagtcccgactgcctgtctccccagcctatctgtcccggggcctgagtccctctgctgtgcccgctgcaggtccccaataaagcctgtgccctggcctcggtggtgtgcagtgtctcgccatcagcccccatccctttcacaatccctcacggccccgagcacttgctccctggccacttcccacactcccccagcccttgccaccttccaaggaggaggcc

SEQ ID NO: 14035 - DNA, 7056 bp, Human
caccagctcaaaatatatacgcaaaataatgaggtggctgtcacattccagtgttctggagttttgtaagagaaagagttttacgtggttgcccagttttgccattccacaacataagtgactgcctgcattgtctggcactgaccaggaggtgaaacggaagatgaagggacaataaaaggacatgggtgcctgttgtgcccaggagagccggaggtggaaatcctatggaataaatgagcagtgttttctatggtgagctcagtttttcctcactcctcatcctaggaatcacagcagcatcttgggctcaaaaagaagaaatgttgaaactccagagcagatagcaacgcaaagagacactccttggggaattcaatctgacaagtatgtaccaagtctccaccatttacaaggcactttggtagttgctagaaatataagttggctaggacctactctgtgccctagagaaccccatggttgggagtggtggtgggaagtattgaccacaaatcacttacttaaaattgaattgtcagctaactttgggtgggtgaggagctgtctagacaatagttcctcttctgtaaatgatttgaatgatacaataaaaaacagactttttaaagcctagggttgagttatattagattgctaaaatttctggaaacaaattgtgttcaaagtaaccacaataatttggaaaaataagtttaaagaagatacatgtaagttatctctgggcccagatcaagcaagaggtacaagttgcagaatgaatgtccttccagtttaacaactagagcgctgcaaattccctaccacaagggcagtgccaaaatattaagtaaaaagtctaggtacaggtcctgctctcatcccttccacgacaggcttgagtcataaagctggactttctaaccacacaacttcgacttcgtgaatttcctttcccatttttcctcttatttccccgccaacaggaaacctgtgtagtggataaagaccaggctgtcactgctaatcccaatcagaaacttggtccttgattcttcccagtggccgacatctccgctgcgaaaacgggtgtgaactattcactaaagcagcagggcccgaacgcctttaacaatccatttccttcggactccgtttgcgaagcccatcagcacccattactccctttggcttcgcatcctagcagaagctaaattgtttaaacccccgctcctccccagggtttggcggtcctcgaccctcaagggaacctgggatgccggcgccaggcttgcctctggcccagggcgcccgcctggcctgcactccctccctggacactgggcccgcctgccctccccgggctgtacctaggggtgtggaggccagggtgccggcgcccgcggggccgcggcgggagctctcccggcccacgggccgaaaaccctggcgactgggacgcggccaggcgggccgggggcgaggggcgctgaccagaagcgggcggagcctagggcccgggccggcagcctgactccccgtgggccggctctgctgggtgggcattcccgcggggcgccgaggtacaacatgagggctctttcgctgacaccgaggggccttgagggctgcaagaaatgcaggcccggcggctgcccccgagagcgggacgcgcgcccgcgcggtgggcgggaatcctaaggggacgcggaggcgggcgcgcgccccgcaggggagggggcggagagcgcgagaaggagggaggaggcgtccccgtgcgggagcccggctgaccgcgccagacccagacagagcatcgcggctttggctgcaacaggcggtgggctcggctcgggggcggaggcggcgaaagggcggggagcgcgaggaggagcgacctggcctcaccgctgccgcctcttccccgccgcatggacgagcgcctcagccttctgcgctcgccgccgccgccctcagcccgccaccgcgcccaccctcctcagcgcccagcgagcagcggcggtgcccacacgctggtgaaccacggctacgcggagcccgccgcaggccgcgagctgccgcccgacatgaccgtggtgcccggggaccacctgctggagccggaggtggccgatggtggaggggccccgcctcaaggcggctgtggcggcggcggctgcgaccgctacgagccgctgccgccctcactgccggccgcgggcgagcaggactgctgcggggagcgcgtggtcatcaacatctccgggctgcgcttcgagacgcagctgaagaccctttgccagttccccgagacgctgctgggcgaccccaagcggcgcatgaggtacttcgacccgctccgcaacgagtacttcttcgaccgcaaccggcccagcttcgacgccatcctctactactatcagtccgggggccgcatccgccggccggtcaacgtgcccatcgacattttctccgaggagatccgcttctaccagctgggcgaggaggccatggagaagttccgcgaggacgagggcttcctgcgggaggaggagcggcccttgccccgccgcgacttccagcgccaggtgtggctgctcttcgagtaccccgagagctccgggccggcccggggcatcgccatcgtgtccgtgctggtcatcctcatctccattgtcatcttctgcctggagacgctgccggagttccgcgacgagaaggactaccccgcctcgacgtcgcaggactcattcgaagcagccggcaacagcacgtcggggtcccgcgcaggagcctccagcttctccgatcccttcttcgtggtggagacgctgtgcatcatctggttctccttcgaactgctggtgcggttcttcgcttgtcctagcaaagccaccttctcgcgaaacatcatgaacctgatcgacattgtggccatcattccttattttatcactctgggtaccgagctggccgaacgacagggcaatggacagcaggccatgtctctggccatcctgagggtcatccgcctggtaagggtcttccgcatcttcaagctgtcgcgccactccaaggggctgcagatcctcgggcaaacgctgaaggcgtccatgcgggagctgggattgctcatcttcttcctctttattggggtcatccttttctccagcgcggtctactttgccgaggcagacgaccccacttcaggtttcagcagcatcccggatgccttctggtgggcagtggtaaccatgacaacagtgggttacggcgatatgcacccagtgaccatagggggcaagattgtgggatctctctgtgccatcgccggtgtcttgaccatcgcattgccagttcccgtgattgtttccaacttcaattacttctaccaccgggagacagaaggggaagagcaatcccagtacatgcacgtgggaagttgccagcacctctcctcttcagccgaggagctccgaaaagcaaggagtaactcgactctgagtaagtcggagtatatggtgatcgaagaggggggtatgaaccatagcgctttcccccagacccctttcaaaacgggcaattccactgccacctgcaccacgaacaataatcccaactcttgtgtcaacatcaaaaagatattcaccgatgtttaatatgtgatacaagtgacatgctgtgctcagtattgtgtggaacgtgcccccttggtctgcctatgcccttgttttatacatttccagaccattcatcaaggaaaggacctgaagaagtggaaagcacacttcattctccctctccctgctgcttcatactgaaacaggtgcctgttttgcaagtgggctgcattctctcagctctccttttccctcttaccctctctctcttaacattgtaaacaacagacttacgttaaacttcatttctagtacacgccctatttaaaaaagagcagtacatcctgggaggaaatgaaactaaagaacagttagagtaactgtttaacctcagaattttaaaggcagttgtttctttcctaagcacatcaattcgtagtaaatgatgcttcggtttgatggacctttcaacgttatttattgaatatgtatttcggttgcctaccctgtagatatgtggatgaagagtctaactagaataatgacttgtaaacccaccatgagttatttggtttttgacttaaattcctatttgaatcccctttcccggaattttaagggtctctacaactttgaataaagggaaatgcccccaagatgtcctgatctgactaattagtttaattctttcgggcttgctaagcatttctaaagcattagactaacagattcctgtgaagttctgtgcatatgtcccagccccaacaactatcaaagtctagaaacagatgttttcagtgttgctgagagaaacaaaaaatttcctaatgcatctgagagataagcttcggcagtatcacaagaagattaaagtggcagacaccccttccagcggaagttactaattcggacctgactgatgcagtttccatagcaacccatgtttcctgggaaacccgaaaaaggttgtcatggcatctcttgctctctagccccacctcccagcccctgccgtttccacagtaacctttccagatggttcctacttaaatgatttcataaggaaaaccactgtttgaataagccgcacaaaaaataaagttaagtctgagactctaaggaggtgaaatgaatcccaaatgcattttttaactatgaaaatcattatgtcattccataatgactgaatcaaggaggaaaatatggtgtttggaatgttagatattaaccacaataaggcatgatctggattaaatgccatttattaggcaataatttttaaagatgcttctctacagttttctttctccaagaactttcaagccaacaaatgaaatttaaaagcaaatgtaaaagtgttctgtacataagcaaatgagagattcgatcagtgtgcctgaaaccttactacaagggaccttcaggctttctctttaaaaaaaaaaatacagatcccacaacagctctgtcatcatcacagcacttgacaagctaaataaacttcaaataaataaaggatgcacgtttaaaactgagtgaattgcagacaatcaattaaaaggagggacaggaagtaaccagatcttgggagaacacctgcaagtttcagccatatgccaagggttgccagaagacagacagaatcaggtgagcactctgtgatctactgggagcagtcccttttgttatccagagccagggaactgtcattcatgtatagactgatggtatttgccaaaccaacagttttatcttagttacatgcttggtgtctttttaaaaataatttacacctttctcatttgatttccatgttgctaactgtcgtttagtttccattgtttattacaaaaggatgaaaaaacagtcattgctcttcagaataaccttcactcaagccaaactgaaaattattccgttccttttactaacccacttggcctccaagcaacctgtttccctttaaaaaggataaatggcagaatctactgctgttagattattggtccaattttaatttacataattatttaatagtatgcagtggtacagttctttgaaacaaaaaagggttaaaaataagagtaacattttatttaaacataatcattctgtttcatatacattatataaattatacattatctacagttgttttttggttttaatagcatataactattctatccttccagagtaaatgagagtaaccctatttttaaagcccatgaagtattttcagttaggagtacatttataatgcatgcattgaagagagaggaaaatagtgattgagactataagagagagctgaggaaggaaaagaccaaacaaatagaggcaagaaatctaaatatacctggtcatagatttgttgtttgttttttatcatatatttgtttttatctatgtatatctaagtaggacttcattatctagttttctttgctttttgtttgagttaacctttgacattgatctacctcttgaccaaacgtttggtacccttaatgaccagaaattatttttatgacacattttgataatatgttagatacattgtaacaattacattaaaataatttttgtatctgttcttaacatagagatggaggaagtgcaatgacaattttattcacatttattcaggagatgtagaaaccttgattagttctataagtaaattatggttgtgccataattcttatggttattaaatggcagtaatttaaagggggcctttgttctttaatccagagaaatatcctggcttttgactcataactttgaggtaatatgattgcttgtagtcaccacattgtaagttccctaaaggatataagctctgtgtcttgaaggttttaggtactagtgcctagcacagaatgtggcaccttttatatttgttgagtgaatggctgttatcttacataaatgttatttccaggcttttaataaagtggttaaaagcataagctctgcagtcatatttccaggatttgagtcctgactctggtatatgatcttgaacaaattacttaacctctctgtgcctcagtttctttgtttgtaaaatgagggtgataaacagtacctcacaggtttattgtgaatagtaaatgttaatacaggtagaacacttagaaaaaataattccatgacacggcatcagagattttgctaagagattatattgtgatcatcactcacaagcactgtataattaatacaatgttttgtgaatatgaaatacacaagtaatcagtgtcttcctatttcctttctattataagaataataattaccatttattaagagtcaaccatgtcctggacacttgtcaactccgcaaggtaagtgctattaacctcattttaggagggcataaaatagatgcttaaagttaagtgatttccctaagacttcacagctagca

SEQ ID NO: 14036 - DNA, 9009 bp, Human
acgtgtgtggcagggacctccgactcatagcggggcaactccaggacaggctccaggggctggggcacaggctcctctgtgggcacagcccctgagtctccctgggggctggcattaagccctgggtcagggaggaaccttatggatgtgagagctccatcatgtcagtgaggagatcggctataggttcctgagacctgggacagcagacgcagtgcaatcctggggaccctaaacagggcccccatcccagaggaatggacatcccacacggcctgggcccaggcagattcacatgggcctcacttgacttaagtccagtctgaaggagagaagcttctgtccaattaggcaagaggagaccttcaagacagccagggtgatctgagcccccaccccaggggtgctccacaggggcaatcagcaaggccaggggatggtttatcaccatccctgtgagttgagggtcactacatgactgtggttttcttgagaatgttgtcaaacatcctaggatgcaccacagagtcccccacagcatagcactgcccagcccaatatgtccaaacggccaggatcaggagccctgacgtcctccgggcctggccaagagcagcatccaaggccccagcctctgaggaggcagtactacagctctacgcaaagcacttggccagcagctggtggcttgtcggctcccggttctgcctgaccagctatgtggccttgaacaagttactgaaccactctgagttcacctttcccatcctatgaaaatggaaattacaagacatatctttagacgaaaggcaatgtctgcgattgcccctagaaacagggctgtcatgtgctttaatcagcagcattccccaggccaggaatgtcacagggctcagacaataatcaaaccaggctccagggtcctataaagtgaaggctatcacagttgggaggagagggagatgcatgaagtgtgtggaatctggggagagcctaggcagaattcaggtaggctgggtttacacagcgcctctgagccctggctgtgtgtcacggtacagtatcccgtccctctggggacagagcttctctgtccattaaataagggaggtcagtggagatctccaaggactgttgtggtgtgtggaagtcattgctgatcctgacttaacccacttccttagtaaccctgggcaagtcccttatgcttcccgtgccccagtttcctattttctaaaatgggggccagatgctgtggctcatgcctctaatcacagcattttgggaggccaagtagggaggatcccttgaggtcaggagttcaagaccagccagggcaacatgacaaaaccctgtcttcactaaaatacaaaaaattagcctggcgtggtgtgcacgcctataatccccgctacttgggagactgaggcaggagaaacgcttgaacccgggaggcggaggttgcagtgagccgagatcacaccactgcattccaccctgggcggtagagccagactctgtctccaaaaatataaaataaaacaaaatggggctgtggcatttgcacctcaaggtcattacagaggtaagtggagctgcagagagcaaggactcaagacccagccggccaggctgagggatgcttgcttttcctgtttgctgaccttgggcttgagtctcacctctctgggctttggtttcctcatgtgtaaaaggaagatagtagcattaccacctcacaggattgttacaagaaagcaatgagttaacacacgtgtgcttagaacagttcttggcataagctaagtaccttacacgtgcttgctatctttcttattctttcaatgatgatggtgtaggaaagtgtttgcaatgggctgggcacatggtggatgtttaataattcatggttgcaatcacacaatgtcagtccctggtcactgggagtcatcatgtgccctgacttggggcctggccctctgcctctgtcttgcaggacaatgccattctctgtctcatggggcgtcctcctgctggcaggcctgtgctgcctggtccccagctccctggttgaggatccccaggaagatgctgcccaaaagacggatacatcccaccatgatcaaggggactgggaggaccttgcttgccagaagatctcctataacgtcaccgacctcgcctttgatttgtacaaagagctggctgatctatcacaaaccagcaatgtcttagtcaccccaacaagcgtggctatggcctttgcaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggtaaggtagcactacctgtccaagcccgttccactgaaataatccaaacatattctcaaattactagttcttaagctttcctagacaatgtactatgagatatggcagggcatttaacatggattctgcaattttccaaacacaaacaataaaatactttccatgatcaaacaagattgaagaatgatgagtttaagacagccaaaccatcatcttctctacagaccttgtcagagcctttattgtcctaatactcattggaaatccctaatagggagggggcagaatatgaaatgcttcccacatgctaaagccagaaaaatattttgtggcacatgcataaaggaatagtttcatggaacatactttagacgaccctagtgtcccagaagcagtgtcagctttgccgtctaaaatattggggttcaaatcctgcctctaccacttactagcttttgataaaggacaatgcattctacctctctgaggtgctaatttcccgtcttagcatggacaaaatagcatccttgctgtcaggttgttttaaggattaaacaagtgacagagaccatggggatggtgtgtggcatacagcaggtgatggactcttctgtatctcaggctgccttcctgcccctgaggggttaaaatgccagggtgctgggggccccagggcattctaagccagctcctattgtcccaggaaaacagcataggggaggggaggtggaggcaaggccaggggctgcttcctccactctgaggctcccttgctcttgaggcaaaggagggcagtggagagcagccaggctgcagtcagcacagctgaggtccgggctctgctgtggccttagggcaggcccaggcccctctccagcccccgtctcctccttctgtccaatgagaaagctgagctcaagggtccctgaggcacctgcccacttggcatgcctcgatggtgaagctttcttggtacggcagaggggagtctgcctaggcatctgcatctcccctgctcatccagggaaaggcctcaggagaagtaagcacaatgctgtcctcgtatctcaacagaaccagccctctgcatgagatcagaagcctccagccaaaggtggcaaggcataaggagttccgattttactcattaactttcattaaccatccccaagccgctatcgaataaacagagccaaatataaatgcttcttctgtggcaccaggattttgccaattagttcaagtatatagaaactctggattcttctttatcttcaggtgattctcacaaaagctctccagcagccagatagttccatttgaatcccattttacagatgataaagctgaagcagagggaagtgtcctgccaaaggggctcagggctcctttcattcacacacttccacccttttatcccacacctggctgatgcccaccttccttttcttccaggcaagtggaaagataaattcaaggctgagcgcattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtgatttccagttcaggggctgagtcagaagctgcccagacctttgagccatgtcaggactgaggcccaacaggactggccagagggctggggagggtggacctcacatccctgggtcacagctactgcagaggccaccactgagttcaggcaggaccatccatgctccatgaggaggacagtacccaggggtgaggaggtaaagatctcgtccctggggacttcccactccagtgtggacactgtcccttcccaatatccagtgcccagggcagggacagcagcaccaccacacattctggcagaaccaagaaggaacagatgggcttcctggcaaaggcaacagtggagtgtggagttcaagggtagcatgtccttcaggggacgggggaagagcctgtgtggcaaggcccagaaaaacaaagttcggaattggaacagccaggccatgttagcagaaggcttgcgtttctctgtcgctttatcgatgctgttagattgggtgtcctgtagtaaatgatacttgagcataagccatacattagtgtatgtgtgtgcattcgtgattatgcccatgccctgctgatctagtttatttttatttttacaccgtaaaaccaagatgaaaatacgaaagtctcaggttcataataggaatcgaggctggaatttctctgtcccatgcaaacgcctcctgaggtacctgctccaggggttgagaaagaacaaggaggctgagagaataactgatcagagagcccagagccaggctgcccgctcacaccagaccgtgcttggggcggctctgtcttcccacggaaaaccagaggggagcattcggcctggtgtgatcactcttctctcatcccctgaacgggtgtcactgcgcactgctgccccacgttcccctgggtgtagggccctggggatgttccaggctgggggcccggtgacccaacactacacagcaggatgagacacgcttccaggacacctagaatctgcctgaagggcttctcaaaggaggtggcatttcaagctgccttaacaagatggttagtctgatactaacattctttgattctgggtatagaggagctcaaaggagaacaaaccaaggtcaacttctgattgttttatttttttttttaacttttcttttaggttcaggggtccgtgtgcaggtttgttatataggtaaaccctggggttttgttgtatagattattttgtcacccaggtactaagcgtagtacccaatagttattttctctgatcctctccctctgacttctgatcttgatatgggtgaggacatggcactaagtgggagacgcaatcagaagagaaagcactggcactgtggtgggttccagaagaacaggagaaatgctgctccatgccttgattctctttcctgcatggcaggtctatcaatctacattttcccaaactgtccatttctggaacctacaaactcaagagagtccttaggaatctgggcatcaccaagatcttcagcaacaaggccgacctctctggagtcagtcaggaggcacccctgaagctctccaaggtgaggtcacccagaagaccgtgttgtcccctggtgtcggctggcagattgtgtggaggttgcagttctgtcctgaggctgaagaaggggctaagagacacaaatgaagacccaggccgagctcctgaggatgcctgagattcactgagatgggccatggtcagacggcggagctggggaggcgcctcctgtgcagctggcactttcagggcctcccccgctgttgtgtcattgaccctttgcccagaaccttccagtttggggccttaatttatccgtattgatacaagaaagcttaggctcatttcaaaagactttctggcccctttcatctgtgaggttttgagtttctggtgcatcaccaagcccgaatcaatgaatgatttgagctaaagatgacgctaatttaggaaaactaaaggtggccaaaggacaactttggcagttctgtgaatggctgcgttctcttggggtctgggcaccatgaaggacactgtcagagtccatgtccccaaggagcttcaagctgtgtacaagaaaggagagagccctggaggcagacgtgcagcggggatgcccctccactttctgaattgtgggtgcaccctgagcaggggagaggctcttatagggaaggcagacggaggggagccagccccatcagccaaagccttgagggggagcaaggcctgtgtgacagggagggagaggacgtgcagggtcagtgccacccgagtggagaaaggctggagtgagttcctcacctcctaggatgaggctgtccacatgggcctcgctccaggcctgggctggggcatggctcagcctcggaacgtatctctgcttctctccccttcaggctgtgcatgtggctgtgctcaccattgatgagaaagggaccgaagccaccggagccccccatctggaggagaaggcctggtctaagtatcagacagtcatgttcaaccggcccttcctggtcatcatcaaggatgacatcaccaactttccgctcttcattggaaaagtggtgaatcccacccaaaaataactggctgtcactcctcagcccctcccctccacccctggccccctccctggatgacattaaagaaaggctgaattgccctctgcctgcgtgtgactgcaaacccctcccctgttgtttctgagtctccctttgtgcactgaggctgtgtgtggactccaggtcacagtgctgtctccgggcctcctgaactgtgttcatggagcacctgactgggcaggcatgtgctaggccaggatggagggggctgaatcctcagtttaagggcctggacctgggagcttatggaagagcaaggggctaccaggagcggccgccaagtgcgggtcacccagagagagccaggccagggcctgagtgctagaacgctgtggcactgtgtgacccagaaaagccactttgctgagcctcccgttctcagtggcagcatgaggagagaatgcccccacctgtgagtgcaaagcagcccgtcagaggcgacggcggggacactgccacaccttgcctccctgccaggccccaacccggaggttggggaagtcagatgtgcagcctttggtggcgtctgtgtggcccagagtgagagggactccaccacgtgtgtttgtgtgtgtctgtgtgtgtgtgtggctgcgtgggtgtgtctctgcgtgtgtgtgtctctgtgtgggtatgtctgtttgtgactatgtgtgtgtgtgtctctgtgtgtgtttgtgtgtgtctgtatatgtgtgtgtctctgtgtgtacatctgtgtgtctgcgtgtgtgtgtgtggctgcgtgggtatgtctgtgtgtgtgtgtctctgtgtgggtatgtctgtgtgtgtccgcgtgcatgtgtctctgtgtgtttgtgtgtgaccatgtgtgtctgtgtgtgtgtgtgcgtgtgtgtctgtgtgtgtgtctgtgcatgtgtgtctgtgtgtctaggtagttctgtctttgtgtctgcatatggctgtggatatgtctgtgtgtctaagtagttctgtctttgtgtctgcatatggctgtggatatgtcctgtgtgtgtctgtgtatgtgtgtgcttcctgtgtttgtgtgcccctgagtcaatgtgagtctgagagtctgtgtgtctgagtctatgtgtgttagggtacctaggtgtttcctgtgtgtttgcatgtggttgtgggtgaggctgtgtgtgtgatgtttctctgtttgtctgagtctatatgtgtctgtgtgtctaggtgtttctatctagactgaggatgtgtctgtggctatgtgtctgtgtgtgtgtgtttctgtgattgtgtgtctctgagttggtgtttgtctgtgactgcatgtgttacatgaaacagaagcagatgtagtgagaatgaaggggtcttaattctctttattctgaaacaaggacccctcactggagtggagagaatgagtccttcccagtcacaccctggagcccttggatggcacttgtcagctggtgtcaccaccctaagtacccacacaaatgggctaggaagcccaagctacatgaatttcagctcctgatgagagattcttgggccagggtcttggtagacacaagcctggtgacttcaggcagctggcaattactgggcatctaccaagggtcagccacggttccaggcccctagcgtgtatgaattccttggctcctctcgtcacctctctgagggtgtgtcaaggagagaggaacctggatcttggatggccatggggctcccttccacccacatccccacatgactgcacagcacaggctggttctgctggactgagcccatccagggaagaacagcgagaccctcaggtgagatcgggctcactggagacaaacagcatggcaggagctggaggtgccccaggctgatttccaggatagggggttcctggacacaggcactgagcatccccacagccccctagactggcccatgagcacgagaagccctgagagtgcgtgggggtggcctgtgtgcaaggcagca

SEQ ID NO: 14037 - DNA, 12909 bp, Human
actctaaattgtaggtatctgagagcaatgcaaataattcttgtccataaatgtttacatgaattttgccaggtggaagtacaatggatttccctcctcctcccagtgtggaatagccagttttgcatctatttgtaaattcatttcagcattcctcgttgtctctgtgcatatggctctttgtaacatcttactggctctgccatttattaatgagtcaagatacaatctttgacacatgttcatttcatatatgtcagagagtcatggtaagaccatgttttaaaagttaccctttgacactagatttgatctccacatccaaatctgaactccatcaataaggactgtacaagtttccatgtgagccctcgccccatccatctctattctttatcctcattgtgacacctccactctctcactctttccaaacttcatctggtccacgtccctggctttcttccaaattctgaccccacctcagtccttaatccctaatcctgtcccctccaccccctaggattaactcagggctccacccagtcatagttcctggagacacctactcattctcaaaacaccaccccttcctccttcctctcccccacccccaatccacgtcttcaaagctttccggctcctgctttttcctctccacctaggtccccgtggactccctcaccccctctggccctgctcctaaaaggccatttctggaaaatgttgctttctcaggtcgcatctctgcccccatccaagtccgagggagctgattttctatccacccagctgatgatttccttcttgtgtccggtggttggcgggagcagggaggcaggatgatgggataattgtgggtgtccttgtgtctttcaaaagaaaaagggttgagatgagactgggaattggaacctggatgtgttgagagctaaacctgagatgaggttggagatgggactggggttgaggaacaggctggagtacttggtatggttagggatggatagggaggtgggaatctgatagaacacggccatctgggggctgactgcctattaagaattatgcatggggttggagaagaggttagaaaactgggtgcagaatgggttgaagttagggatgggcatggaactcagcggggtagggggaaggaaatgggctttccccttacccttttttgggtcctgaggcctgaaagttcacagtgggttcaactctgccttgggcggggtcagacctaggtcccagcacgtcctggaagctccgccccaagcagagggccaagcccaggtcgggggtgcctggagacatcccgctgagccactgggggtggagagggggaggccagggaccaggaaatgctgagtgagctgggggagggagttcaggggttaaaagccatggttcggggctgaagttctagacagctggcggctgacgctcctcgtgggcccctcactcaggtagggtctgcctggggcgggggcggggagcggaggagggcagggaggggagagaagaggggataggaaggatggggaaagcagaagggcagctgagtcagggagagggagagtgaagctagagtctcagatctagagagaaacctgcagagacggagagaggcgaagggcgcggacagataagaacttgggctaataccaagcgtgtggacagacccagaggggtagaatggaaggcagactctggaggaaaagggcgagagtgcaccgaccacccagctcgccagagggcaggggaggagggacggcttcctggggtgaggggctgcacgccggagccccaggaggttgcacactgttcctcccacctcgccactgcacccccaccaaggatggaattggaggcggggggcagattccagggtcagggctgtcaagagtgaatgaggcgaggagacattcaggagcagagaggtttcagacgcggaggttccgggcacgccctcaacacccccttcaccttctcctcaggccccgcccgccctgccctcccctcccgatcccggagccatgtggcccctggccctagtgatcgcctccctgaccttggccttgtcaggaggtaagaatgcgcgggggtggaggcgcggcggccattcgggacaatggtaggaggggtcaggccggagggggagggggcgtgggagccgcgagctccgccccccgcccactcggggccgggtccagtggggacagctcagagctcttcctgcttgtccctgggtgacctggtttcccggctgaggttggccctccgaccccagacccctcacctcccaaaataccctcgcagcagcccctcccgagttcaaggcttcctgtcctctctggaaagctgaaagacatgggttcgcgtcctgacgctgccgctttgagccagtagcctagcagctgctttgtgcctaaattgttttcatctggaaaatgggcttaatctataagtgcttaccagagaaggtcactgtgaatattgaaacgaggtaatgcgtcgagccttcagtatgtcgcaggtagaagggacttgaaagttagccacttagccgttattactttattagtagtattcctttttttttttttttttttttttgagatggaaccttgctctgtctcccaggctggaaggcagtggcacgatcttggcttactgaaacctccgcctcccgggttgaagcgattctcctgcctcagcctcccgagtagctgggattacaggcgcccgccaccacgcccaactaatttttgtattttcagcagagacggggtttcgccatgttggttaggctggtctcgaacttctaacttcaagtagcccgcgtcagcctcccaaagtgccaggattacaggcatgagccaccgagcccggcctctagtattctgtcttcatactcagccccttccagaaccttctagattgttattttaatccttgggttgaccccaaacctatgtgacctcaccccaaattggtagtccttaagatccttatggatctttcccatctttccctgccgttgtaggcaggttctctggaaaccccgttcatgaatcatttattcattcaacaaacagctattaaacaccggccactgtgctgggtgctgtacaagcagagacacagtccctgctctcagcacctggagtctagcggggacagatgcagatgttattcaaacaattatccaaataattagttaataattatcttgacatgaggtgaagacttcaaggagccaagccaggggcctagagatgtaatggcggcttcccgaccagaggccttcccaaagggcttgacccttgagccaagacctgaaaaaggagggatctgtgggtgcctggcacctggcaccatccttggcctgaaggtggggtggcttttctcctctggtgacactccctggattcatgcccgtgccactcctgagtgccacaccctaggctaggagacccacacgctacgccttgtggagtcctcaacaacctggcgaggtaggtgcattgtaattactccaatttcatggcagagaaacctaggactcaaagacagaaggctcctgctccaatgacaccggcgatgcctgagtcagaatcctaatcaaggttgttttccctgtccatatcctggacttgaggctctgaaaaccatttttataacttttgacctaatcatttgcttaaagttagctttttttcttcttttttcactcaaacaaaagcatgttcaactttatattactgtcctgaatagagaatagaattctttgtcataaatagaaggtaaggaaggaaataaatcctgcacaatgaaaagaaaataatatgtttattgggttggaccacctgaaattgctgatacttgaccctttttgaccttcctaaaacaacttttgcagatggttcagtgtaataaatgttaggtggcctgatgaggcttctgtgtcctcctggctttgaaaagtgagctcagtgaggattagggaggtgttaaaaccatattagcaccatcctgagactttatccttgacaaaatcaggtttaaaagagaactggatgctggttcagcgtctgagtgtgcgatttaacgttacttaaatctcatctctctaccatctaaaatgatcctgtgctcaccgacaacttctgtccctaactgcaaaccactgagctaatccaactgcttgccctgtagttggggaaactagctagggaggcagagggacctcctgttgtagctaataattaataataacatttcccactgactgagtgctctccatgccacctgctgtgctgcacggtttgaaatgcaggatcatcttgaattcttcaactgcgcaatgagagatgaactattactttttctacttgacagctggggaaactgaggctggtgatttgcataaggtcacacagtcacaaaatggcatgcatgttcaggattggattctccctgtcccacggacccctgctgtgctttcaatgccagacacagtgcctggcacacacagcatttatttattgagcccccattgtgtgccaggcgctgtgttaggtcctgggaatatggtactgaataaagcagttaaggtgcctgttgtcaatggagcttacagtcaaagtggagagatttttaaaaacgaatacatacaaatgtgaagagaaatgaatagcaatcattgttctgatgaagaccaactggaagaatgtaatgggggaggagtcgggaccaggagagtcaacattagaccaggtggtcagggaaggcctttctgaagaggagacatttgagctgacctctcagaattaagaaggacccagacatacaacctctaaattctgagggtcatccagtagaatattccatatatgtatatatgaaatatcctatatctgtgctgtccaattatccactagccccttcaggctattgaacatttgaaatatggctggtgtgacttaagaactgaatttttaatttagttttacttcattttaattagtttaaatttaaatagccacatgtagctagtggctaccatattaaacaacataggtctggagaaaggactgtgcagagagaggaaatagcaagtataaaatgtctagtatgggggcatccaagatgatttaaattcttcttttctttaaatgcctggtgtgtttgaagaacaggcccatgaggctggactagaggaagtcagaagaaagaggttggagatggggtcaaagaggctggcaagggccagacagcacagagtcctgcacaccttgggaaggctttttggattttattttaaagaaagttgagcctgggaacaacatctgactttctttgtttgaagagtcctcagcctactttgagaagactggatcggagggatgtaaaagtggaaggatttaggttaatgttgtagtcatttgggctacagaagatggggcatggaccaagatggtggcagaagtgtggagataactggatatttgggagataaaaccaataggaactggttgtgagtgatgaaggaaagaagagaagcaaagatgactcccaggtttggggctgagcactgaggtgggaaatactggagcgaacagttttgattgagaagaatcaagttgggaatacaaagcttaagatgcctgtaaggcatccaaatcaacagtgtttgagttttgagcttaaagaagagttcagggctggagatgattagcctatagctggtatttaaagccatggaggcaaccagtatatatgcagtgaaaggatagagagatgggtggaaagatgattggatggatgcatggatggatatatggatagatggatggatggatggttggattggatggatggatggatggatggatggatggatggatggatggatggatgaataaatggaccagtggatggagggacagatgagtggatggatggttggatggatggatggatggatggatggatagatggttagatgactacctaaatggatgaatggatagatggatgagtagacggatggacaaatcaataggatgaatgggggatggatgattggatagattgatggatagatattgcctaggtggatgtgtaggtcagtctcacttctacctcctgaaatccatcttctggtagaatgatataaaaaatgcatgtggagagaaagtcaggctcctgcttacctatcagcaacatcctcattttgtgaactcttctgttaacccccagtggaggatttggtacttcctgagaaaataatgtcacccctttgccctaattcatctccacttggtcaagaatagcaactgccataggtcggcaaattcatcttcagttcctggtcacccagggcaataatctgacccttaccccaaacccagaaaccacaaccccagggctcctctgccccctggatcccagttttctaacaatctctcttctttaccaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggagtatgtgggggccgggggagcatggggtagggatgagaatgggactgggattgtggatggggtagagttggatttgaggatggagttggagttagggttggggatggacatgggagtgagaatgaggtttggggttgagatatggggattgggtatgggaatagaatcaaagtaggggatttggatgggattgaagttgaggatgggggagatgtatttggagatgaggaaggtaggatggagaagaagttaggttggggatgggaagaggttggggctgggatggggatggaaatgggctcatcttctttcctaaccaccttctttctgcacccacagggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccagggtatgcacccacacaggtggcctgaggccccataggagtggctggggaaacaggggcagagatgggagggaaggtctgaggtaggttcctttatatataaaaatataaataagtaaataaatatatatatttaaagttagctgtatcctttatataaatataaattcatgaatatataaaaatatgagtatataaattcatgaatatatagaaatataaatagatctaatatatgaatatattatatgatgtatattatgtattatatagtaatataattatatattatacaaaaagtatacaaattaaatgtattttataaattataaaatttatcaattatgtattttaaatatgtatttctgcataatgtatatattatatataatctatatttaaattatatattataaatgtattttataaatgtatacatttatatatttatatactgtaaatgaattttatcatttataatatataaatcatacatataaaatgtttatatttctataatttataaaatgtttaatatattaaatatggttattaatgaaatgtctaataattcaatgtaataattaattctatatcattacttagtaagtataatacattatatatgtgaatataaagttgatgtatataccgacaagagccctttgcatctccctagcaatccctgactctctcccagcctcatgtttgtatctttctcctcaacatgccctgtctctcttcctaccattctatccaactctcccgtaactcttcccatccctgttcctgcttttcccatctttaattctctatttctgaccatctccctattccaactccctctctccaactttctctccccaccgctggctccaccactctccttatcaaccttccattctcttgtcccttccctccttgtccttccctccacttttctcctcatctctcccttcgcctctctcccatgtccctccatatttctgtcacttccgttgctttacccagataggtgctcatctcttctcccatctttctcttcccatctcaattttctatctactctttacccattcaactcgcctatttcaccttcatcccatatcctatccaggtcggataccttagaccttctctttcttctccccagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgaggtgaggccgggaggctggtgggtgccttggacaggatagaaagccagaatggaagtgacagatgctggggaaaaagctttgtttccagccttaggggaaccaatctttataagatacaatgtcccctcacataggaggtcaagacaaaaaggggtacccagggatggcaggaataattcatcataagccccagctttgactgagtggctgccaagatccctgtgttgagatgcataaaggttggtattctttcacttgtgagtgatagacaaccaactcaaactggcttaaacaaaatgcaggcttttgtaactgaaaatccaggttgtctggctttaggcacagatggatccaggtatgcaaattgtgtgtttggaattctgtctttcttttaactctcagctcttctttattctgttttggcttcattctcggttagattcttcccatgacaagatggccccagcagctttgagcttacatcctaccctctaggcaaccctattagaaagagaacctctcttttccaatagttcacacaaaagtcttaagcatgattctcactaggctgacctaagtcatgtgtcttgagccatcactccaccagagctgtgggattctctgatgggccaagcctgagtcacatagttaactgtgggtgctggagaggggcagggacaaactgcatggattggaagtggagaagggcagttccccaaatgaaaaaatcaggagaggctgttaccaaaataaggggaaatggccaagtacagtagttcatgcctgtaatcccagcactttgggaggctgaggtgagaggattacttgagcccaggagtttgagaccagcctgggcaacatagtgagactctgtctctacaaaaagaaaaaaaagtttttaaattagccaggtgtggtggagtacaactgcagtcctagttactcgggaggctgaggcagaaggactatttgaacccaggagttcaaggctgcagtgaggtatgatcatgccactgcactccagcctgggtgatagagcaaggccctgtctctaaaacaaaaagaaataaatagagcaagacactgtctctaataaataaataaataaaaatttaaaaatgaatgtttaattttttaaaaataagaggaaatggatactacatgagcaaaaaatagccttcatcaataaagaagttgagattggattcagtgagaaagagtatgatactatattaatgatatgtgccttgatcgattagtgatgtctgccttgggcccaggaagagaaatagacttacacgtgtgttgcataccctgcccagatatgaatgggttcactcaatagtgagagacacaaatgagccttaaataggagcagggtcagctggtgtggggcagggggtgcaaggtgggatttcgtaccagggaaacaaaaatgggtatgaagtaagttgttaccattttaatgaaactgaggaacagagaaaaacacagaaatttctctgtgtctctctttctctgggcctatctctgtctttctgtccctatttctgtctcttgctgtctgtccctctgtgtttgtcttcttgtctgtttctcactgtcttcattgctttctctcacactgtgtgtgtctgactctgcctctctgagtctccttctctgtgtgtgtctctctccatctttcactctctccccacacctccctgtccctgccttgtttagccccagcaaggacccacctctctctctctttctttccccaactcagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgacaacatcctctaactcttcaagtatttattcaatgccagtatcctagaccttctattttttgcactcaagaaggctctagactcccatgatagttcatcctgaaaatattctcttatgcccacaatcttctgccctgacaacattctgtgtacctctgtgactcaccacagctaacattggatcctcagaatatttcattctcacactgttatgggtgtctcagaagtcccaacccaacctacatcccacattcttccaataccccacctctgccaacattccctctctgaatcaatggcaccctagtctctagagttatagggttcagtataccaaagggtcttcttgcctgaactttattgtctaccaaatattccgtcttgtatcccctccatgaacatccttggtcagtgtcccttgctgttacatctttgtgcatgaccctaaaatgtagtgcaaatccttgctttggacaagttataaaactcacagtctctgtgctttctcatctgtaaaatgggttcataattttttttaattgtaacattattacaagaataaatgtcaagcatttatcactattattatttgcatggttcccataaaatattaccttagaatgttaataacagcccttcgaatttgcagagtgtccaaaaaaagtgttgcactgatttattttcctcaggagacatttcttcagtgttgactatgtgcaagcactctcctgggtgttgttaaatatagtttatttactcaacaaatatttgtacctatcaagagccaggcactgttgcagagacaagtgataaccaatgagttaaacagataaaaacttctgcccttgtagaacttacattcttttcaagaagtctccataacaatgaataaagaaataggctgtcaggtggtgctgcaagccatagcaagaaatgaaacaagggccatatgtggtagctcatgcctgtaataccaacactgggaggccaaggtgggaggatcgcttgacaccaggagttcaagaccagcctggacaacatagcaagatcccatctctacaaaaaagtttaaaaaattagctggacatggtggcacaagtctgtagtcccagctaatcagaaggctgaggcaggatgattgcatgagcccaggagtttgaggctgcagtgagctgtgattgtgccagtacactcaagcctgggtgacagagcaagaccctgtgaagaagaaggagaaggagaaggggaaggggaaggggaaggagagcaagaggaagaggaagaggtagaagaaaggattaagaattgggaatgtagggttgtatatgtggaaggggtggcattgcaatttaaacagcatggtcagggaagaggacctaactgagatggtaacatttaaagaaagaccgaaaggatgaagggaaggagcaaagcacatatctgaggagcagctgctggagcaggggatacagctagtgcaaaggccctgaggcaggagcctgtttggtgtgtctgaagatcagtgaaaaggttggtgtggctggagctgagtgagcaaggaggagagggtgggaggtgagggcagagaatgaacggagcagactgcattgggtcctgtggggcacgacgaggactttgttttcctctgagggagccaggagctatgagagggctctgagcagaggagggacttgaactgatttcaatgtgcacaggattcctctggctactccatggggaacagactcagggggcccagcgaggaagggactacattagcccaggcaaaaggtgacggttcctggaccaaggtgatggccgtagaggaggcgagaggtcagattctggatctgtttgatgggactgttggaccatatctgccaacatcagatgggggaatgtgagaaaaagagaagagtcgaagatgactccagcaatttggcctgagcaacaggaaggatggagctttcatttacaaaaatgcgagaaactgagaggaac

SEQ ID NO: 14038 - DNA, 90472 bp, Human
  misc_feature (1)...(90472): n = A,T,C or G
aaggctgctttcttctggagttaaataagaggtttagaaagcctccctcggagcactcaaggactgagcctgccttacccatgtgctggggacaccaccctcctgtccctgtgtaacccaggagtctcttctcagtaacttcattcagaaaatgaggggactggccagcacttcagggaccagaaggcaggccaggtggggtgtggtggaggacttcaggggggcgtggagggcttcagggatacactcacccatctaagggcaactgccacttagtgccagcccacttctctcccttttttcttttttctttttcccccagggtcttgctgtcacccaggctggagtgcggtggtaagatcagggctcactgcagccttgaactctgggactcaagggatccttctgcctcagcctcctgagtagctggggcgacaagcgcatgccactgtggctggttaatcttttcattttctgtagagactggtctcactatgttgcccaggctggtctccaactagtggcctcaagtgatccctcacctggaccttccaaagtgctgggattacagttgtgggccaccatgcaccgggcctgttctgttttcttggagcacttgcctgcaattatccttcattcatttgctcacgtgctcatcattggtttccctcttcattagaaagtggggacttggtttgggttaactaagcttccctgtgcatcagttttcatttctttctttctttttctttttcttttcttttttttttttttttgagatggagtttcgctcttgttgcccaggctggagtgcaatggcgctatctcggctcgccacaacctccgcctcccgggttcaagcgattctcctgcctcagcctcccgagtagctgagattacaggcatgcgccactacgcctggctaattttgtattgttagtagagacggggtttcgccatgttggtcaggctggtctccaactcccgacctcaggtgatccatgaagtccacccgcctcggcctcccaaagtgctgggattacaggcgtgagccacctcccagttttcttattgtaaaatggagccattgtgtgcaaagcactcaggacaggggccagcacctagaaggctcctcagtcattcattctagaatatttactgtgagcaggcattccctgccaggccacgttctagagctcaggacgcgtgggggggggggcccgcctcacgggttggcatcccagttggagcacatggtcagaatgcaaggacgcaaatgaacgtgaacctgccagggggtgctcagtcatagggtgatggtggcaccagcgttacgaaggatagggccaggcggatacctgggagaacagaattgcctgtgcagggtgtatggnnnnnnnnnnnnnnnnnnnnnnnnnnnnnnnnnnnnnnnnnnnnnnnnnnnntgtgcagggtgtatggaggccctggggctggagcctgcggggcttcttccagggacagtgaggctggagatggactgcggagatgagggtctagaaggtggtggcggggcatgtggaccgttgtaagggctctggggttcctgggtgggctggcgaagtcctactcacagtgaccaaccatgatgatggtcccgatagaggaggagagggaggaggagggaaaaggaagggtgaggggctcagaggggagagctgggaggaggggagacataggtgggggaaggggtaggagaaaggggaagggagcaagagggtgaggggcaccaggccccatagacgttttggctcagcggccacgaggcctcctcagctcccgccccaaaacggaagcgaggccgtgggggcagcggcagcatggcggggcttgtcttggcggccatggccccgccccctgcccgtccgatcagcgccccgccccgtccccgccccgaccccgccccgggcccgctcaggccccgcccctgccgccggaatcctgaagcccaaggctgcccgggggcggtccggcggcgccggcgatggggcataaaaccactggccacctgccgggctgctcctgcgtgcgctgccgtcccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaaggtgggtgagggagaccccagggggtccgcgcacggacccgggctgttgggcgctgggcgccgggaggacccgcgcgttgcggtgggtgggcgaccgcagcggaatcggcgcccgggcctggcgccgcagagcacgagggaggccaggcgcttcgggaggggctgctgcccgcctccccaccaccctcaccgccccagactgaggctaggggggaacccaggggctttgctggaggcgcaggccagggttggggaggcctggacgggagaccacccgggcgcctgacccgccctaaagggtctgggcgcccacgacggatcaggagtgtggacaggttgcttccgtggtgccgcccgaaggagcccaagagtgtgtgtgaacgtctgctttcacagcagccggtagcagggtccggtaaaattagagctgcactttgcttgtatcctgtgagcccaggaggacaggaaccttctgtgagacccacgtgggtgcccagctcacatggtaggtgctcagctgagcatcctccactgcccagaatctccccataggaaccctctcccagaggcagaatgcgcgactctgttctccctgctcactgcctccatgattcagtctggaaactataagccgcttttctccccagattcatgcagaggcaggcagcagcccaaggtcctctgagtgcacgcagccttaggtctttcctctgatcctaactttgcataccattgccctttcaaccagggagacagattaggcggtcagctggtctgcagacggacagactctgccctgggtgcctgggtggcctgtttgaatgagcctggagttaggggaagggctgggagattgcagagtatcacatttgaactaaaagccatttagagttttgaagccctggaacccacacatgcagtggcggggaggggaaactggggctcactcttatcaaagttctagccagatgcagagctggggtgaagatgtggacattgtcactctaatggacgtcttttccccttggcctgcctctttggactgggtttcttaagaatggttccttgtccacatttcatgtctgttccctcattcacagagcgaatgaatgagtgaatgaatgaaggatctgcttagatctggctgccacacttcttgggacccagctagctggccttaaagatggagcaacatatggtctctctcaaggtctctgggtgagcagttgtctagggcatcttagccacgttgtgtctatttttgatttttcaaatcttgtcccgccaaagcctgtaatctgactgcaaagaggtcccggtggatggtgacactgtctctggggatggcaggaaaatcagcagaatggcctcttctcccccatgacagctcagaggctttctctgttacactgagggagctttatttttctgtggcctactcatactgaaacgtgtgtgtcagtgacagccttgtggctgctgcagtgccaggaccccactgtgtgtatgcagggtccctagaggggctatcactcaggcagttcaagcatgtgaccctgtgctgtgagtgagcacctggtctcttgctatgggagtgtggggacttatgccaggtaaagagtcttgccaactcagttattcgggggcttatttcaaggtgttttctttctcaggatgtcatcaggttaagtatgtcagtagggtgtgtgtgtgtgtgtgtgcaccacacatgcatgcaccaccaaatttccccactcctctcctgggcttctaaagaggaaaaccacattgtcctcaattgtcctggagctaggagcatctggcttaaagttgaacaggagcctcccagcatccttctgtggatatcccaaaggcgattggtttggggccgagtggtgtgaaggcaggaagacacgcccagcccaagacggccacttctggaaccgcccaggctggagcagcggccaagtgccttagcatggaagaagagagcctgtgttcaggggaccaggcgggtgagacacacgcataagcagggactgcccgctggtgttttctttggctacatgagtctgtgtgcaacttgaatgggaggccttgtgcttttatttttttttttaatatgctttttggttaacaacagaagtccctacagttggccctctgtgtctgcaggttctgcatccgtggattcaatcaactgcagatgaaaagttttcagaaaaaatccccccaaaataacaatacaactaaaaaaagacataaaaacaatactgtataacaactattgacatagcatttacatcgtattaggtattataagtaacctagagatgatttaaagaatacgggaggatgtgcataggtgatatgcaaataccacagcattttatgtcggggacttgagcatctgcagatcttggtatctatgggggtcctgaaaccaattcccctctgacattgagggacgactttatataaaatatatgaatacttgctcgtaaaaaaaagttcaaatggaggaaaagagagaaagtttcccccattttattcccctcctgagctattatcaccatcattgatgtggatctttctagacccttttctgtgtaccaggagcctgtatgtatacatattaatatatattttacataacttgaactaagtgtaggtgaacttgaacatgtataattatcttgcaatttgtttttcaattcaaagataccagctgaaaaattttccatgtctcagcaataagtctaccccgcgttttccttcatcactgctggtattcctttgaatggttatagacttgtttacctgtttctccattgactgatcattttctctgtcacaaatgacagcgatatcccgacacatccctcttcgtgtggttcatgaacatttccatagggtggatttctagaagtggggccttgggagcaggtgtgctcagtttgagttttgatgattacggccaaattgcccttctgcacagctctgttgctgcatccacccacaaggtatgggactgtgctacttcccctatctctgccatcactggtaattactgatttatcattaccattttttggtagccaagttcccgtgtgtctctggtcctccaaggaaggcccagctggtggacatgggggagaggcccctcactgcagctgggctgcaaaaaagggatgctcatcttccgaggctgctgtcttcaatgatgagctggggtgaagatgtggatattgtcacactagttgacatctttttccctttggcctgcttctttagactgaatttcttaagaatggcttcttgtccacatttcatgtctatgtccttttcacagaacttggatgtgtgcccccagggatctgaaccatgtcttcattattcaccggatcacctgaggtcaggagtttgagaccagcctggccaacatggctaaaccctgtctctactaaaaaatacaaaaactagctggacatggtggtgcacgcctgtaatcccagctattcgggacgctgaagcaggagaatagcttgaacctggaaggctgaggttgcagtgaactgagatcacgccactgccctccagcctgcgtaatagagtgagactccatctcaaaaaaaaaaaaaaaaaaaatgaaggaacttagaaatatgtctcagcatgggtaggccataaaaacacattactaattgaaaaaagctctggtgctatttatgtttaaaaaaaacccaccaaacaatattctatattttctttccatttttatttttattttcgtagagacaaggtctcactatgttacccaggctggtctcgaactcctggccttaagtgatccttctgccttggccttccaaaacactgggatgataggtgtgaaccaccgcgccctgccattattttcaatggcttaatattagaatatgttaaagtttgggaaaaggtgagactaacagaagtggccactctaatgagagaaggcaggacactgggggtgtggccaaaggaaacctaatactttatctgtaatgctattttttttttcttttttgagatggagtctcgctctgtcgcccaggctggagtgcagtggcacgatctcggctcactgcagcctctgcctcctgggttcacaccattctcctgcctcagcctcctgaggagctgggactgcaggtgcctgccaccacacccagctaattttttttttgtatttttagtacagatggggtttcaccgagttagccgggatggtcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcctcagcctcctgagtagctgggactacaggcgcccgccaccgcacccacctagttttttgtatttttagtggagacggggtttcactgttttagccaggatggtctcaatctcctgacctcgtgatccgcccgtctcggcctcccaaagtgctgggattacaggtgtgagccaccgcgcccggccaaaatcccatctcttaaaaaaaaaattacgaatgaacagatacatagttttcctcaaagactggccagatgaatgcgccacacagaccgatgaggcacactgcaaaggggccctgtggtcgaggttgcttggagaggctttggggaagcgcaactcatttcttttcccttctgccagtgggtaggattggagagaggtgtttggacaggcacactaagggccgtgattgtgaacttcatggcatccattcatgggcagcttactgtgcaccaggcagggttcaaagcacctttgtgaaaattgtctcatttagtccctgcagagggccgtgacatatgatttattgtcttcagtgtccgttaaggagacaagctgaagagagtaatttgccccaagtgacctcgctagtgtatgtgtgtgcgtgcatgtgtgcacgtgtgtgtgtgtgtgaaggtgtctgtctgtcccagaggcagatgccatgagaatggggactcttgctcccattgccctggatctgagcctggcatgcagctgtgctcaggtatgtgggtgagtaacgaaggcctggttcaggtcctggggggcacacatccaagttccccgtatgtgctctggtcctccaaggaaggcccagctggtggacgtggggagaggcccctcactactgctgggctgcagggaaggggtcatcttccaagaccaccatcttcaatgataggcctcatggccttcttccatgtccaggagagaacctgggtcccctctgctgtctttaagttggttttctagatggactcaacctcggttgccttgtcctgctgctgggcttcccccacctatgatccctgtctcaataaacggcacctccttttgtttcccctggggtagaggcaaaaaccttcggtcatctttgcctgcatgcttttttcctgatacccctgtatctgctgaggcaggggctttcccatcactgtcactgcagcgtccccgagggccatagcagcgcctgagctccttgccaccccttcaacaccagtcaggttacagaatgaatgaggcgggcgcgacccccagccctggcctcaggctctttagctcacccctgcctccctcagccagagccacacagtgagccttggggagccccggcaccagggccagccagggatgtcaccggctgtccctgagtttgtgccttttgggaaatctttgtcaatcagttaaaagatgggggttgatgggagataacagtcaatgggcactcgttgtggccggatactgttccaagtgtttatgtgcattattcattttagtatctaaaataggtactattgtgtcttattttattgagggaaatggatgcacagaggcggaaagtaacttgccccatgtcacatagctccaagcggttgaatcaggatttcaagtctgggggccgactccacagctggtcccggtggcctctgcgcactgcgtcctcccggttctccgtgtgtctgagcaggtcgactgcatgcttaaggcgggcggcggggggtgcccttcttatattctcttcctgggctgccccttccttttctgtgcatcaccagggaacagcagggtcccttcgaggctttgtcctaatcatcaccccgccaaactttgctggtgcagagtgcaccctggcctctcccttccgggggtagtctgagaccagggacatgttctccaatcaaaggcaccaagtgaggctcccggggaggccacctgttcctagcccagggctcccagtgaccccgggggctggactcccacccatcctgcaggggccgcccgctctgcgcctttatcagcccccctgcggaacctgggggggaggcccagtgtctccacctaccgggcgtttcctgtaggacccccttgtttggacatgtggggcaaagccctagaactgatcactgggcacaggtggggagggggctcctcgaggacagcttggatcacaggtgtgtgccaattctgttttgtttttcttcctctttcctgccattgaacttcctactccttctagcatgtgagagacagcttcaacttactccctggcgacggctgaaaaacatgggctatttttagtttgtgtgagtctagtttatttgctcctggtagatttgcctctccctgtcttcgtgagtgtgtgtgtgtttgcacacacgtgtgttggtgtgtgtacacaagtgctgatggtgaaaacagtgacacacacacctgtgtaggcatgcacacacctgccttgatgtgtgacgacgtgatgatgtgtatgcagacacctgtgttgatgtgtgcctacatatgttgacacaggcacacatggtgtgtctgtacatgcaaatggacacacatgaacacacgtgtttatgcatgtccttgtgtgttgatgtgtctgcacatacatgttgatgtgtcccgctgtggttggcctttctggggccaggcccagcacctggggtttccaggaaacattccctgtcccttcccggaatggccggtacttgctgtgcctccgccgggagatgcaccctgattaactagaacgtggcgaagctcagccacctggaatcgccttaccctggcctttggtttctagcaaatgggatggaagtgagtccccatggagggcttgctccatgaaggtgtttttcctggatgagtcttggtcccagtggcgatttgctgcaggcttgttggcactgtcattcgtgggtcctgcatggaggttccttagtgtccagagggtgattccatgtctgtggtcagcaaaagagaggcccctggggccataagccacaccccccaaggctgaacccagagagtttgtggtttaaatcttgggcctggaggattctgtggaggagagttcggtccaggccttctgctccaggaggcgctggcagctccgacaccacagacacattaattgtgcggagaattcaacgctagggctcagtcaaaaatcaaaaacgcaaaacaaaaagagaatcccttttatttacctcgtctccctccccctgtttggacatgaccttgagctctgctggcccacaagtggccaggctggagctgtcttgcaaagagaaacaaaaacaacacaaaaagctgcgttcttgactttgaagccttaaagggcccaggggctggctccctgtgggtgttgggggcgattttcctcccaaagcctgcgtgagatatggagacactccgcctgctcagaagctccccaggtcccgggttccaggaagcctcatggcccaaggcctggccgtcttaattttcttgttttctttccctccactccactgtttcttcctgttcactgattgcctgtgctggggagggggaaggaacgggaggggcctgaccttgttcacttcctggcattttgggtgaagttccttacaccttctctggaagcttctagaaggacccttgaggcgctttaaatctccattctctgggttttcctcccaccttcctggctgctctgtcttcttgcctgctgatgcctcctcatctccctggcctcctgcctcctgctggtggagctccaggcatcctttctgtgtgtcctcatccctcatccctggggtgggctcctccagccttgcgcctgaatggcatctctgtcctgaccactcccaaattggtatccctgggcccagacctttcccctgaaccccacccccgagtgtccaacagcagagtccgtatctcaactcggggtcaaaggcagctcacgctcgccccggctggctcctcatcaccctcggccacacctgtggctcccaccagcttcccactccatcatagcccccccatcttccagttgcccgggccaacatcttgcactcagccttgactctgttctctccacttccctcagagaacccgtcagaaagttttctagcttcatcatctaaatatacccagattccaactacttctcaccacgcccgaggcgccatcacctctggtccaaggcaccatcacctctcccccagattcctgcatccgcctcctcactggcctccctgtgctcatccttgctccccagtggggtttctcaataagcagccatgggagcccatcaagattgcacttagcacctcctcccctcaaagccctgacatggccagacccgtcccctaggagtcacagccaggtcctaacctggcccagggcctgtgccatccacccctgccacttttctggcgacgtccgcattcccttttcccttgcacaatggcctcctggccattcctcagccccatgggcccaatcgccttagctctcctgacacaagccctctcatctcccgtaggtctctgttcagctctcacttgctcacggagaccctcccctgattccgtttgtgcatcatgcaggttcccccttgtccccctgtgctgccagccctccttacccgctctgcttagacctgtcagccactgtagataccctggaacttccctgggtatcatgttgattgtttattgtctatttctccccatgagaatgtcggactgtgagggcagggacctttgtgttattcgttgccgtgacccaagcccctggaacaatgcctagcacataatcgcaggttctcaaatatttattgaaaggatgtttaaaagacaagggttgtttcacaggatggttcgtgaccagtggcaggttgtggtcctgtgcagggcaatggggcctactcctccacctgccgtggccgtcgccccagaccgagctgccaccgttgtttcccagtggatgctggagtgtcatcatggggctgtttgctctgctgatttataccacactgttgtcacttctccccatcaaagccaggatgctctttaaaacatgcaaattgggccgggcacagtggctcatgcctgtaatcccagcactttgggaggccgaagtgggtgggtcacctgaggtcaggagttcaagaccagcctggccaacatggtgaaacctcatctctactaaaaatacaaaaattagccaggcgtggtggcatgtgcctgtaattccagctactcgggaggttgaggcaggagaattgtttgaacccgggaggtggaggttgcagtgagccgagattgcaccattgcactccagcctgggtgacagagcgagactccgtctcccaaaaaaaaaaaaaaaaaaacaaaactatgcaaactggatcatttcaagaagctgaataaaatcttcctgcatttggtatcaaagctgtgagcctcattttcgtgggccctgcccatctcaactcagcattctcaccccactgcaacctcacaggccttccttttcctccaacgtgtcacatgctgtcctgcctcagggcctttggaagtgcttttctttctgcctggaccgtctttttgtctccctggctcttatgcttggttcctcttttatgtttaaatgtaaccttttgaagcttaaatgtaaccttttgaagaagacaccccgtgattgcccaccccacccaatggacagttgccccccacgtccactgtctgtgccatctgtgtggtttttcagctggagggcaatggccccatctcggctcactgcaacctcctcctccccggttcaaacgactctccagccttgcctcttgagtagctgggattacaggcgtgcaccactatgcccagctaatttggtatttttagtagagatggggtctcaccatgttagccaggctggtctcgaactcctgacctcaggtgatccacctgtcttagcttcccaaagtgcttggattacaggcatgagccaccgcgcctggcttgcgccatctgtgttataaccacaccatgctattcccttctgagcccttaatagtctctgaaattatctcatccacttgtgtgagttccatgaggacagagactttatctgtctcgttcatggctgcattccatagttggagacccttgtccagggcagagaaccacctagcgtaggaccttgggctaaggcagagaggccccagtgggggtcctccgcagcgtggactttggaaccagactccctgagttcagcagtggctcttgcacttcctgtctctgtggctgtgggtgagttgcataaccctgccgggcgtgtttctccgggcctccctcctcgggctgtagcaaggggtaagggaggtcatacgccctggggaacaccccaaagcctgggtccctgggatgcatccacagattgtaggcctgagtcttaacacactccatctggatttcaatgacttctgcctggttccagtgctgggctgtttccctgtctgagctttggtggcttttgattgacccctttcctgccccagcatgaaggtggagtagccagaaggaagggatgcgggtgtataaagatgtcatcggggctgtctgtggatggtgggtaaagagacagcacctgtcatggtggaagggccacaggaagcgtggaggctgtttctggggccacctcctgcctccaggaggaagcagggatcctcctgttggcatcttggtcccatcaggtgtcttggatggggctggggctgggagtgtttctctccctgagcatttaagccaaggttcattatttagaatggaaccatttataggccgggcgccattattacattattcctaaagtgttaggattacaggtgtcatgcctgtaatcccggcactttaggaggctgaggtgggtggatcacttgaagtcaggagttcgagaccagcctggccaacatggtgaaaccccatctctactaaaaacacaaaaattagctgggcatggtggcacacacctgtagtcccagctacttggaaggctgaggcggaggactgcttgaactcgggaggtggaggttgcagtgagctgagatcgcgccactgcacttcagcctaggtgacagtgagactccatctcaaaaaaaaaaaaaaaaaaatggaatcctttatgtttcactttgttctcattagcaggactgtgcgaggctgagtcaggagaccgaggtccattctgcttgtgattttgctccgtgcaggaatgtggaggtgtggcccataagcatgtcattcatgcaaaatcatctacatgcattcaattagaaaaaaaaaggaaaacagcagtgaccctcataagtagacttggttagtgtcaatgtagggagtgagtttcttgtgaccctgctgttcttcctgggtcccgtgacagggcatctggacaggctgaatgcgattctagaattagattcctatgtttttatatgtacgccccagtctcacttgccagtggcttcctctgacgcttagaaaataaatggcatctgcaccacgtcagggagaaactgactgctttggaattcccagaagctcttggaagggaaccttcctgagggatattgaaggagaattaaagaattttctcagtggctggcacaacttatggagtcaatgctcattggctgtgattggctgagctgggatcacatgtgcatccttggaccaattgctgtggctcgagtaatggactgctgtgattggtcagccttgggtcgcctgcccatttggagccagggagggaagtagttcttgcccacagagactcaggtaggagtagggtggttcccaaaaggcaaaaaggaggggctgttgtcgggggaagaggcggccataggcagcaaaaatggggctgagcccctttgcccccaggtagcttcccacttcatccccacattgcctttcactgtctctggctgttacagtattagagattattttgtttggctgactattctgtttaccaaggcctcttgaggaggtagtagcttaccagctgtttattatgtatgtatttacttatatttacttacctatttattttgagacggagtttctctcttgttgcccaggctggagtgcaatggtgtgatctcggctcaccgcaacctttgcctcccaggttcaagcgattctctcacctcagcctcccaagtagctgggattacaggctgcgccactgtgcccagctaattttgtatttttagtagagacagggtttctccatgttggccaggctggtctcgaactcctgacctcaggtgatccgcccacctcgacctcccaaagtgctgggattacaggtgtgagccacgaagcccggcctatttatttatttttttgagacatggtctcagtctgtcgcccgggctggagtgcagtggcatgatcttggctcactgcaacctccgcctcccgggttcaagtgattctcctgcctcagcctcctgagtagttgggattacaggtgcccaccactacacccggctaatttttgtatttttagtagaggcgaggtttcaccaggttggccaggctggtctggaactcctgacctcaaatgatccacccaccttggcctcccaaagtgctgggattataagcatatgccacagtgcccaccctttattatttatttatttagattttttgagacagggtctcactctgtcacccaagctggagtgcagtggcatgattacggctcactgcagcttcaaccactcaggctcaatcgatcctcctaccttggcctcctgaataactgggactacaggtgtgcaccaccatgcccagctaatttttagattttttgtagagacaggggtcttgctatgttgcccaggctggtcttgaactcctggcctcaagcaatcctcccaccttggtcttccaaagtgctgggattacattcatgaatcactgtacctggcctaattgctctaacggggaaagtttcatcagctgtcagattgttagatctggactgacttgggttccgaagctcagttctatcttttatttttcctttggaaaccaaattctgtaggtagcagaggtttactcaaggccacggagatagttagcagccagtgctgggtggggccgactgtcccaggctagctggatggaggccaggagggcccgggcagcaagggtggaaggggcctgggtgggtgccggaggaagtcactaacgaatgttcttcaggcagaaagttcccagggtcccattgatacccctgcctgttcacatcctggcggcaggactgggatgaggcattttttaaaaagttggggagatatcagggctggtgtgccaaagttcaggctttgtccacccaaggtgagaggctgcaggggtgtgccgtgggcagagaggggatgaggtaggggtgggagggatgagctgcccagatgcacccgtggaggagttgatctggaatcctagccactgggtttaccctgcagtgtgtcccagcagcatcccaggcttctctccagcctttggcagggctttagcttccagcagctcaggtggaccccagcatatggactttgaaggcaggcagcccaggttcaaatcctggcttggccacttcccagttgggtgccttcaggcaagtgacttaccctctctgtgccttttttacttttctgtaaaatgaagttaataaaagtgtctcctacatagggcttttaaggtggcagaattggcacatgtcacacttcaaatagcagctcggcaagtgtcaagtaagggctggctgtttccaacatcttaaccggatagacacagacatagagagggatccatctgtcagcagtttgctgaaatgggaccatactatgcacgctttgctgcaccgtgggtttctcacgctgtcatcgcttgtccatgtcgtcctcagtcagctgggattttctggtgatgatcacgctctgattctctagatgcctggaaacgctccacggtgcggatgtaccacggctcgttctgccgttctcacgagggaggcatccagcttgtaaaataaagcagcccagtgtgttcttccaccaccacatcacccaaggttctattttcaaagattttattttgtaaaaacgggaagaaaagtacaagttgctgcatgtgcatcctctctctctcgttgctgagccttttgggtgcatcctaaggacaaggacgtccttctccatggccgtggaccacggccccactcaagaaggccacgaggatccacacctttaatctgacagtctgtgttcagattcccttacggccccaataacactttttgtcatagttgttcattaaaaaattttgaattggccgggcgtggtggctcacgcttgtaatcccagcactgtgggaggccgaggcgggtggatcacaaggtcaagagattgagaccatcctgggcagcatggtgaaaccctgtctctactaaaagtaaaaaaattagccaggcatggtggcgcacacctgtagtcccagctactcgggaggctgaggcaggagaatcgcttgaacccaggaggcggaggttgcagtgagccgagatcgtgccactgcactccagcctgggcgacagagtgagtctccgtctcagaaaaagaaaatttttttttgaatccaaggttgcatgctgtgtctggttgcctcatgtgtttttcctctttaatccagacctgttctccagcccttttctctttgctgggtctttcaggacactggcatctgtaaaggggccaggcgggtgcttttggcaggatggcccttgatttggatttgtctgattgctttctcaggagtgcacgtggtcttcccacagactcccacacaaaagcctcattgtgtgaatcagattggagcagagtgtttctgatgagccggggttgggtgcctggatcctcccccagctcccagcctggcagtcacagtgcaagtctgaacctcttgggttgaagaagcctgcaattcctcctggtcccttcctccacctgctttctaaaatttctggctctcattccttgcctttgagcggtgatgtgtccatccttcagcggccctcggccagcctctgcccaccccagtgccatcacatgggaagagatggcggatctgatccctgactcatcccctgggccaggaagattgtggaaaccctggggtctcagggctggtcgggtggaaacgggaggctggatggagtggcaggtgggggcttttcctgttttgcctctccctaactgggcctcccggcagccactagcccagatgcccaggcctcagagccttgtggaaattcttgtgccagatcatcttggccctgtctggcctcctggcaggcaggtggaggtcaaactggccttacttggccgagagcccattgcagccaggatcccttggcagctctgggaacagccaagtctcccctgtccttgggatttccttccactgtctgttcccaggctcctggactccacctgctgcaacccctcgctttgcactttccacccagagtcttggatttctgttttttgtgaaatttgctcactttgaggaaagtgtaagacatatgcaatcaaatatgtaactaagatgaacatgcatgcaatcaccccacgtgaagaagagggaaagctcatctgccccgaagcccctgcagaagacactgtgtttggtcccagcttgctttgctttttatagtatcactccctcatagccatccctaaacaccgggattagtttggtccggttttggacttaacttggatgcaggcatactctcagtatttttgtttggtttggtcttgctggtgttacttcatatggtatttgtgggatccacccacattgctgcgataagctgcactctattttcatggccatgtcatatcacagttcatgatgctaatcggaagaagctgagtatcacagttcatctgtcttttttttttttttttttttttttttttgagatggagtcttgctgtgtggccaggctagagtgcagtggcgcgatctcagctcactgcaacttctgccccccgggttcaagcaattctcctgcctcagcctcccaagtgcaccaccatgcccagctaatttttgtatttttagtagagatggggtttcactatgttggccaggatggtctcgacctcttgacctcatgatccgcctgcctcggcctcccaaagtgctgagattacaggcgtgagccaccacgcccggccagttcatctgttttaaccctgatgccggtgactgtgttcacttctgggttatgacacactcgtgtccctgcctgcaagggacatgtgcctgaatccctctagggcccgacagtcagagtagggggtctggtcatggcgtgcgtgtcttcacctgcatggagaagggccaagctcttgtccaaagtggttgcagcgtttccaatcctatcatttgtttttcatttaataatttattgagttcaaattcacataacatataattaatccttgtaaatcgaataattcagtgataccaccacttctacctagtttcaaaacatttccatccctcccaagtagaattgcccattctccactctttgcagctccccagcccctggcaatcactcattttctttctgtctctacagatgcacctgttacggacatttctttctttctttctttctttttttttgagacagagtcttgctctgtcgcccaggctggagtgcagtggtgcaatcttggctcactgcaacctccgcctcccgggttcaagcgattcttctgcctcagcctcccgagtagctgggactacaggcgcctgtcaccacacccggctaattttttttttttgtatttttagtagagacgggtttcaccatgttggccaggctagtctcaaactcctgacctcaggtcatccacctgccttggtcccaaagtgttgggattacaggcctgagccaccgtgcccggccctggacatttcttttttttttgaggcagagtcttgctgtgtcacccaggctggaatgcagtggcgtgatctcggctcactgcaacctccgcctcctgggttcaagcgattctcctgcctcagcctccccagtagctgggactacaggcgcccgccaccacgcccggctaatttttttttttttttttttttgtatttttaatatagacggggtttcacatgttggccaggctggtctcaaactcctgacctcaggtcaaacacctgcctcggtcccaaagtgttgggattacaggcctgagccaccgtgcccggccctgcacatttcttataaatgaaatcatgcaatgtgtggccttaagtgcctggctgcttccgcttagcgtcatgttttggggttcatccgtggtgtggcatgtggagtgctgctttcctttttgtagctgagcaggcctccacggtgcgggtgcactgcatgctgtttttccgcgcctctgtggatgggcgtctgggctggtggctgccgggagcggtgctgctgggagcgcgcatgttcgggaactcgcttggcttctgctttcagtggtctccttttatgccctccttcccctcacccctctcgctcttcagcccgccctgcccctgcgcccatcctctgtgtggctgcgtctgtaaacctgagtgtgtccttggaccttgtgcagtcctagattccggagcctgcaggtgtgggtccagatcccggccctgcctcctgctgctgtgtgaccatggacaggctcttcgagtctctggtctctggtgggtgtctgagtctgcatgggaggcagaggttgcagtgagccgagatcgtgccactgcactccagtctgggcaacagagcaggactctgtctcaaaaaaaaaaaagaaagaaagaaagaaagaaaaaaatgtccataacaggtgcatgggccaaagaccatgtattcccgtacagttctggagaccggaagtctgagatcaggatgttggcagggctggcttctccggagacccctctcccggcctcatagacgccaccttctccctgtgtgcgcacatccccggtgactctctgcgggtcctaatctcctcttttaagggcgtcagtcagattggattagggctcaccccactgacctcatttaaacgtaatcaccgatttaaaggccctgccccccgcgccaatacagtcacattctgatgcaccgagggttagggctgcaacatgggaattttggggggacactgttcagctcataatagtagggtgcctataaaatgggctaaaaccatgccttcctataggattcagtgaggaccgagggagctagaggtggaagtgctttgagctgggggtggcacagggaggcccccttcatgtggcctgtcacgtctgaggagagggcggcttttccatgccatgcacggtaactcgtgtcaacattcctcgtgctgccctgtttaaaatctatccgtgttcctatgtgtgtatcaggcttattgcttccttctgctgcctggaccccctaattcatgttcatcctgttgtatttattcccttagcgacgggggtaccttggttatgtctgactcctgcctccacaaacagcaaatatgctggaccctgctgccttgtacttctccacaatttcctggggatgcgcaggagtggaattgctgtagggcagagggggagccattttcacccaacatgccttccagaagggccactgctgttcaccctcccagctctcacatcctctccagcacctgagacgatttagtcttcgagaatgtctggggtctcagtgagggtacgtggtgcagcattgttctcatgtgcttttctgaggtgtgaatttgagtcttcttcctttcataagtcctcaggtgggggtctgaggctcagagattttgagggccatgttggagggtcacagagcaaactggggctagaccccaccagcttgggcttggagggcctccagcttggatgtagggcccttcataaatccaggatgatctcatcttgggatccttaacttggtaacatctgtagagaccctatttttaaataaggccacattctgaggttctaggtgggcatgaatttggcaggggacatgcttcagaccagcactatgtgtgcaggtgcccaatcctcagatctgcagagctctgggttcaaatccaggtcccattacttgggtcctgtggaaactcacttttttcctaaaagccgatttccacctctgcacatggggccaatgttcttccatctcacaaaccagaagtcaaggccaggcgcagtggctcatgcctgtaatcccagcacttagcgaggcagaggtgggaggatcgcctgaggccaggagttcaagaccagcctgggtaacatagtaagaccccccccccccatctccacagaaagtaagaaacaaaaacaaaacaaactggaggccaaggagagcagctgcggatggtcacgtgcctctccctgggtgtgcccagctcttacccagaaagccctggctggcattaaaaataaggaaggtaaaatagggatatgatcaaacaaattaaaagtgtacggaaaaagagtcagccttctggaaagatcacagcacgacactgctcccctggccccagctggtctttgctccagaggtgacttgggttaatagttccttgtttttccttcctgcaataaacatgtttgcgtccacagagggggacccacacccgtatccttcccgtccgtggcacacgtcccacaagggcacacggttcccatgcttttctgcctcttggctggggcacctaggtggatcttggcatctcttgttcccgcacagaacccatcctcatccgagccctgggcctctgtctcccagcaggctttgcaaataggaccttgtaaaggacagggctgtgtttcccaaaggccagagcagtgaagaggggcatgtggggtcgtggggcacacctctaggacattggggtccaggggtcctttccagtaagaccttgctgtgctggaaacacccctgtgtctttcagggcttttttcagagtcagggttgatgtgaccgccacgtttcctctgggcctgacagctgtaatctgtggcttgggagtgcagataagtgtgatgaagctgccagcaggcctgggcatctgtgtccttggtgggggcagggagaagagacagggactgggatgctggggccagggccagagccccgctgagatatgaggtccccttccaccctgggaggtgtgtggggaggagcttcctcgaacccctttagctgggacggatggaagaatgagcagctttgcatttccggcagcgtctccagctttcctggggctttctcggcttgtgttattgatgaactccagtgcgtgaggccattggagccttagaggcctgtttcccctggacaggtgactgcctgggccagaggcagcactggcatggtgccctcttgctcctggctgggagtgacacggggcgtggggcgctttgcattcatccccagctgtttgggcacatttacaaccctcattttacagatgggacaaaccccagtggagaatctgctccgggcagctgtttatgaaccacctgaatggggcacacaggactgtgggaggaggaggagggacccccagggctgaagtggcagggaaagctactcatcctttcggcccatgtttactgctcacaaattgtgggccaggtctcgtgccaagtgttggagctacagccgtggacaaaagagacctggtcctgctcacggcagctacgctttagcaggagggatgggccatggagaagcacatggaagaggtggggtggcgagaagagctaggaaggggacgaggcaggtgagctgacatggagccactgctgggaaggggactccttctgatgtgggagtcaggagggcctctcagaggaggggctctatgagctggggagcagctggcaaagagcacagcaggttcaaaggccggaggtgcgaaggagcctgctgtgttggaggaagagggagcaggccagtggggttgggagaagtgactggagggggtgaaaggggacaggcatgtgggggccttgcaggacacctggaggagttcagatttggttttcaattccatggagggttctgagcagggaagagccatgatctgactcagtattttttttttttttttttgagacagagtctttctctgtcgcccaggctggagtgcagtggcatggtatcagctcactgcaacctccgcctcccgagttcaagcaattctctttttttttttttttttgagacggagtcttgctctgttgcccaggcgggggagtgcagtggcgcaatctccgctcactgcaagctccgcctccctggttcatgccattctcctgcctcagcctcccgcgtagctgggactacaggcgcccgccaccacgcccggctaatttttttgtatttttagtagatacggggtttcaccgtgttagccagcatggtctcaatctcctgacctcgtgatccgcccacctcggcctcccaaagtgctgggattacaggcgtgagccaccgcgcccagcctcaagcaattttcttgcctcagccttctgagtagctgggattacacgtgcgtgccactacactcggctaatttttgtatttttcgtaaagatggtgtttcaccatgttgggcaggctggtcttgaacccctgacctcaggtgatccacctgccttggcctcccaaagggctgggattacaggtgtgagccaccacgcccagcctgactcagtcttgaagagctctctggctgctgtctggagaagggagtgtcgggggccaggctggaagcggggaggcagagaagatggtgatttgagccaggtgggggtagttttctaaatggaaagaagggaacatattcgagttttttttcagggagagtcaacaagataggtcagtggactggggtgcgagggaaggagaggaatcaagggtggttcctcaaggtttgaggagtttggtagatggtggagccattttccgagacgagaagatcgggggagggaggttgagagcagatggagtgtgggccttaactctggtcctaaaatcaagcgaggacaactcaacaacaagagtcagacaaccccattaaaacacggaccaagcacctgcaaagaagacatgcaggcagccaggcgcggtggctcacgcctgtaatcccagcactttgggaggccaaggtgggcggatcacaaggtcaggagttcgaggccagcctggccaagatggcgaaaccccgtctctactaaaaatacaaaaattagccgggtgtggtggcaggcgcctgtatgtaatcccagctactcaggaggctgaggcaggagaatcgtttgaacctgggaggtagaggttgcagtgagccaagactgtactccagcctgggcaacagagcaagactcctgtcttaaaaaaaaaaaaaatgcagatagccaacggggacatggaagtgtgctcagcgacactcgctcatcgttagggaaatgagaatcagtgagacacactcatacccattaggatggtcacttgagaaaacagaaaatctcaaatattggtgaggatgcggagaaatcggggcccatgtatgccgttggggtgaggatgcggagaaatcggggcccatgtgtgccgttggggtgagtgtgcggagaaatcggggcccatgtgtgccgttggggtgaggatgcggagaaatcggggcccatgtgtgccgttggggtgaggatgcggagaaatcggggcccatgtgtgccgttggggtgagggtgcggagaaatcggggcccatgtgtgccgttggggtgagggtgcggagaaatcggggcccatgtgtgccgttggggtgagggtgcggagaaatcggggcccatgtgtgccgttggggtgagggtgcggagaaatcggggcccatgtgtgccgttggggtgagggtgcggagaaatcggggcccatgtgtgctgttgggaatgtaggatggtgcagctgctgtgtggaggcccccccaaaatttaacatagaattaccatatggtggggcaaccccacttctgggtatcaaagaaatggaagtgggaacttgaagaggaatctggccaccgcgttcattgcagcgctgttcacgatggcccaacggtgggagcaacccgagtgtccgctgatgggtggtgggtaagaagctggggcccatccacacgttggaataggattcagcctggaaaaggaaggacgtttggacgcacgctgcgacatgcacgggccttgaggaagttatgcgagtgaaataagccacaacaggacaaataccgtacgattccatttgcatgagctccctagagtagccagatccacagagacagaaaagagaatggtgggtgccaggggctgggggagagggggtgcagagctctttttcagtgggtacagggtttcacttttgcaagatgaaagagttctttagatggatgttgctgataattgcacaacattgcaaatgtccttaatgccactgaactgtacacttaaaaatggctaagttgggctgggcgtgtagtggctcatgcctgtaatcccagtacttttggagcccaaggtgggtggatcacgaggtcaggagttcaagaccagcctggccaagatggtgaaaccccgtctctactaaaaatacaaaaattagcctggcatggtggcaggcgcctgtaatcccagctacttaggaggctgaggcagagaatttcttgaacctgggaggcagaggttgcagtgagctgagatcacaccactgcactccagcctgggtgacagaccgagactccatctcaaaaaaaaaaaaaaaaaaaaggctaagttggtaaattttatgtttaccccaattaaaattaaaaactgtggcagggtttaacctgaagggagaaatggtactggcccctcctgcttgaatgggttgggctgttggtttgtagatggtagaccagacggcccagcctgttggccagggtcaaattccaacatgctgagcctgttgcagaagacttagcctttgaagcaggcagccctgagcttctgattcctccaggcccaaaccaccgttgccctattttacaagaccttggctggcttcatgacgtgttcttgaactggagccagtggtgagctcagggaggctcgtgtaacaatagttccctgaggcatgtttatagccgggtgccctcttcacaacagacacatgtcctgggtcatctcattctctctgcactgccacggggaggatggggaggcagtcacgtctccatgtggcatatcaggggaccggggtgggaggggctgactgagccgaggccagaactaggtctgcgccctggccctctccctaatggccagatccggcctcacccgtgaagctggcctggcaggggatggcccttcctgaatttctgtgtggtctaggctggggttggcatgcttttctgtacagagacagatagtcaatatgctcagctctgcaggctgcacgggttgtgtctcagctactcagccctgctgctgtgatgctgaggctgccattgacgacacagaaataagtcgaggtggccgctgtgggccagtgccactgcatttatgaacaccaaaatgtgaatttcatataactttcacatgtcatgaaatggcatttttctttcaattgtttgtttatttatttttaacatattttttggagacagggtctcactgtgtcacccaggctggggggcaggggcaccatcatggctcactgcagcctagacctcctgggctcgttatcctcccaccttactctcctgagtagctgggacaacaggcatgtgccaccacgcctggctcatttttttttttataggttggtgggtgggtgtgtagggggggtcctcactatgttgcccaggctcgtcttgaactcctggcctcaaagtgaccctccccaccttggtctcccaaagtgttgggattacaggcgtgcagcactgcacccagctggctgactttctttcttttcttttcttttcttttcttttcttttcttttcttttcttttcttttctttctttttctttcctttcttttctttcttctcccttccttccttccttccttccttcctttctttctttccttctttctttcttttctttcttccctttcttcccctctttcccttctttccatttgaaaatgcaaaatgattgttagcttgtggggtgagtagaaataggcatcaggctggatttggtccacaggctgtagcttgttgaaacctttctaagaacagagaagaataatgtttttgcttgaaaacagccagctttattgaggttggggtgtttgaaagaaggcatattcactgtctgacttgtgtggaaacagtggggctgggatcagccctggtagaaattgtttttgtccaaaaaagcaagtagaggtgggctgcctggagttcccgtcatgcaggtgcaactggggagcaggatgaggccctgatttggcggggaaggagagattgtgcttgattcatctctgtgcccggggaccaggactgtatgcaccttccagcattctcttcgctggtctgagctccttacttgccacgcctgtgctgggcctttaccaaggcagtgcccagcctttggtcagacccaaggtcaagactctgtgccaacattgggtttgtgctcttgggcaagcgagtggtttaatctccctgtacttcactttcttcatcagtaaaatggagacgaattattagctttattctattttattttatttcattttattttgagacagggtcttgctctgtcacccaggctggagtacagtggcacgatcatggctcactgcagcctctatctcctgggctcaagggatcctcctgcctcagccttccacgtacctgggtctacaggcatacactaccacatttggcaaatttttaaacattttttgtagagatggggctcactgtgttgcgcaggctggtctcgaactcctgggctccagtgatcctcctgccccagcctcccaaagtgctgggattacaggtgtgagccaccacacccagcctaattgttaggtttaaataaatgaaagcattgctttaaatgggatgctttgagctggaaacaacataaaacttgcctccagtggcttctgtaatgcagatgtttactgttgtgcttcctgagagatgggaggtggtggtttccagatgcgttcagcagttcagaacatcgtgctctgcctcagtagattttgcccagtggctctccgaggtggctgtactgatggacattctggccagtgacacatgcgcgagacctctggtgcttgccagtgcgtgccagtgaatacgtgtgatgtccctgagctcttcctactgggtacctgagtcacttgtgaattgcgtgtcctcttccccacttcctgctcagtccacgagggcaggaatcctgttggattaactttacccctgtagcactgatcgcccgctttggatgctcaggcagggttgaaatgaatgaatgactgagtgaatgaatgaatgaatgaatgccacgttctcatcgtgtgttactataggacagggattgcaaactgtgcaggaacatacatgggggaagggccctggcatgaggtgatagggagtggtggggcccgttgcaagctggagggcacaccccaactgtgaagcggctcctgctttgctccagcgggctgggccacgtggcgtgcaggcccagagctggacatcacccaggttcccaaaagaagccagaaggcaggaatttacctgctggtttaagatactgtcaacagattcaaatattttgaaatatgtgattcaaaacccatctactggccaaatctggcccatgggcccagtttgtggcatctgtttcaggaagagacaagacctagtttgtgttttttttagtgggggcggggaggatgcggtgtataagaaattttgagtgaattaaaaaaaatttatgaaaaatttcaagggctgggtgcagtgtctcacgttcgtaatccagctctttgggaggttgaagcgggagaattggtttaggccaggagtttcagaccagcctgggcaacatagcgagacccctacaaaaaataaaatctacaaaaaatgaaaaaattagctgagtatggtgacagaagctgctgtggtcccagctaccaaggaggctgaggcaggaagatggtttgagcccaggagttcaaggctacagtgagctcggactgcaccagtgcactccagccagggtgacagaacaagaccctgtctcttaaaaaaaaaaaaaattcaaacatacataaaaatagaccggtgcgatggtcatgggccctgtaacttgctgaggagataccaagtcttgccttctgcacgtgcctccatacactttccccttttccacattgttctggggctcatgtcagacattgcctcatccgtcagtgtctctagtatagccacggcacttcatggtgcattggagtctggacgctggagggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggcatgatggctcacacctgtaatcccagcactttgggaggccaaggtgggagatttttgagcccaggagttgaagaccagcttgggcaacatagtgagaccccatctctataaaaaatttaaaaattagccaggcgtggtggtgtgtgcttgtggtcccagttatgtgggaggctgaggaaggaggattgcttcagcccgggagttcgaggctgcagtaagccgtgatcacaccactgcattccagcctggcaacagagtgagaccctgtctcaaaaaaaaaaaaaaagttaaggatcttgagatgggagatgaacttggattgtcccaggggccacaatgctttcacaaggatctttgacagagggaggcaggagggtcagagtaggagatgtgacctcagaagcaggggttggagtgataaggggacaggagccaaggaatgcagaggcctcttagaagctgggaaacggaaggcaatggattccccctgagctccagaaggaagcaccctgcctgcaccgtgactttcatcccatctcaggggcagtcccagtttggacttctccccccgagaactgtaagatgataactttgtattgatctgagccagtgttaattgttaattcttacagcagcagtgggaagctaatacaatgaaaatgcttccattaaagccaggtcattaacatgatagtataatctggtttgggtgggcttaaataaaatatttaaacttaaaataatgttgtgttaatatgtgaacttttgaaattgtcagtgtttttacaaaaagactttaatgttctggaaaaagtataaatatggggtgcacattttttccttttgcttgaagctgtaatatgattcggtgaggcactgatttggccctccctgtattgccgcgacagagcctgcttgttttaaaataactttctgttttagaacagttttttttttttttgagaccaagtctcactctgtcgcccaggctggagtgcagtggcacaatctcggctcactagaacctctgccttccaggttcaagtgattctccttcctcagcctcccaagtagctgggaccacaggtgcctgacaccacacctggctaatttttgtacttttagtagagtcgggatttcactatgttggccaggctagtctccaactcctgacctcaagtgatccacctgccttggcctcccaaagtgctaggattccacaggtgtgagccaccgcgcccggcctagaacagttcgactttcagaaaaattgggaagatagtgctgagttcccacatatcccacagccagtgtcccctgctattaacatcttaaaggaatgggatacatttgttgctatgaatgacccagtgttgatacatcagtaataactaacatccagacaggattcacgtttccttcgtttctccttcgtatcattttctgtcccaggacccaatccagggccccacattgcgtttgtccctcacgttgccttaggatcctctggtctctgtgggttctcagactttcctggctttggatgacctggattgcgttcctgagcaccggctaggaattttgcaggacgcccctctgctgggatttgtctgttgttcttctattgattaggccctagttccgggttttggaaggaagatcgcagtgacgaagggctgttcccagcacattatgtcaacatgacctgtccctgctgcatgggtcctattctttattccttgttacaggtaaagaaacaggcacaggaagttgtatcaggcgcctgctggtaggtggaggatgggcagggggttgaggggacagggagtggacagagcccctttgctggtaaagaggggaccccagacctctcacgtctctccagggcccctggtggtctcctggctggcctcgctgctctgcttcagaaatcagatttgacggggcactgggaccctgattgggccttggtggctgtaggtgctctcttattagcgacaccacttgagggtgtattgaacatctgaagagtacccacccctggatcaataattttttgctttaggccaggcgcagtggctcacgtctgtaatcccagcactttgggaggccaaggtgggccgatcacctgaggtcaggagttggagacctcagcctggccgacatggtaaaaccccatttctgtcaaaaatacaaaaatcagtccaggcgcggtggctcatgcctgtaatcctagcactttgggaggccgaggcaggcagatcacctgaggtcaggagtttgagaccagcctggccaatttggcaaaaccccgtctctacttaaaaaaatacaaaaattagccaggtgtggtggcgggcatctgtaatcccagctacttggggggctgaggcaggagaattgcttgaacccgggaggcagaggttgcagtgagctgagatcacgccactgcactccagcctgggtgacagagcaaaactccgtctaaaaaaaaaaaaaaaaatcagctgggcatggtggcatatgcctgtagtcccagctattctggaggctgaggcaggagaattgcttgaacctgggaggtggaggttgcagtgagctgagatcacaccactgcactccagcctgggcgacagagtgagactctgtctgaaaaaagaaaaaattttttttgctttaatttttttctttttaaaaattgaagtatcaaatgcattaagaaaagtgcacaatttcggttagaggttgatggattttcacctaggtatgcacgcttgtaatgaccccctataccaagtgtaaacgcctcccccgcacccctccctgtcagtatccacccctgaggtcctgctgcccccacctctatccccatggattggttttgccattccccgggacgtcacttatatggactcatgcacgtggtccctgtgtgtgatttaccctgtcattgtgtgtctcaattggtcattcccttttgtctctgggtagcattccatggtatgagtgtgtccccatttgtcatgcattcacttgcttgtagacatttgtgttgtttccagttttgggctgttatgggtacggctgctatgagcatttgtggataatctttgtgtgggtgcatgctttcatttttctgggacaaatactgggggtgggattgctatattgtagggtgaacgtccagctttggtagaaaaagtatattccacagtgactgcactaatgcacttccaccagcaatgtgtgagcactctggctgctccacatcctcaccagcacttgttattgtcagtctttttcattgtagccattctggtgtatggcatgggatctcactgtgagtccagtggacatttctctgatgactaagccacccagggctggtgggtggctccaggaagtcacaggaatcctttctcctatctcctattctgctccgcccttcttcatgtgtggctttcattcttaagggtgcctcatgatccaagatggctgctctagctccatccattgtgactgaattccgggcagcaggaagggggacttatcaacaactacatagaaatttcagatattgataatgtcagggagataaaacagggtgatgaatataatgtgatgggggaagggctgctttaggaagaatggtattttcatccattttgttcactattgaagtgcccaggcctagagcagagcctgccatacagtggggctcaatagagatggttaagggattgaaaattgctcagggaaggtctcacggagaaagtgactttagacttgagaagtgaggggctcacttttgtgggcatcaggggaaagattgcccctggaggagcaaagagtcagtgcaaaggccctgtggcagaaacttgcctggtggctcaggagcacagcaaggccagtgtggctggagcagagtgagcgaggcagataggaatgggggaggagactggagtgactatagggagctgggttgtgcaagacctcataggtcactgtcaggaatttagattctattctgagataaatagggaggcatgggggaggtttgagcagaatgacatgctctgactttaatcttaaaaggataacttggattctgtggggagaacggggcggggggcaagagcagaggcaggaaaacagcagggaaactacggcacccatccatacaagccaggatgggggccaggatggtgttggagagaagtggatggatttgaggcatgctttaaagcgagagcagcccagccttgctgatggagggtgctaggtgggaggaaaatggaggactcaggaatgactcaacctcttcgcttaagcaacttacaagcgtgggtttcttgtaaaaaccttttattttagtcttcttaccttagtcctttaaaaatcaaaagaagttggaacatgagccaagggtgtggtgttcccaagtcccagattggattagcctgtgtcgtagttgttcctgcatcttaaggccccatggagctggggatgcctggagccctgggattgagagtgtagtcagccactgactgctggtccagagtgggcagggcctggccttgtcccagaactaggcttcgtctgagcaaattggcttcttggctcatttggtcagaggtgtgtttcttggaagcctgttttctcttctcataggaggaggaattagaccttgcaattcagtggccaggtcaagttaatgattcatttgtgaagctcccgtgcaaggagcccagcggggatggcctaggagagaagcgtgagggcacaggcctagacgtggatacggagcctggggctctgtctctccctgctcctgtgaccttggtcaggcatttggctttggagcctcagtgtctgcttcgatgagatgagccattgagaatttaagaggtgaagtaggtggaagtgtttcgctacctgaacagggccgggcagattgtccagacgattccgctcccctggtgtctgagggcaggggcgtctcagggcaggggccccatcgtgttcatccctgtgtctttaaattcctagcatagcatctagcatggggcggatgattgtacagggcatgaactgcaatcccaatgaggtcagagcagcctcactgtaggccgaggtcgttccagtgggcttcatggaggaggtggcacctgggcgagcggggtgttaggtttggaggtcaggggcctctccaggtgcaggggagagtgctgtgggtggtaggaagagaatgctaaaaattaatgtctatgaaatcttcatctcatccatcacacatttaccgagttgttgccccggcctaaacaggcggtactctctgtgtatttaaaaaaaaaaaaatcccttcttaagtatgagctgtttaaaacacacaaaggaggactagcgttaccacccgctagacatttccacgttgattatatggtttcaggtctcacttttgctcattcacccagaaaatatttacagagctcctgcaaggtgccaagagctgtcccaggccctgaggacagacacatcgccaaacaaagcagctgaggatcttgcccttgtgggtttatggccaggcaggtgatacagatggacagcaataaacctgataagctaattataccgtgtgctcgaaggccacaagcagcatggaaacaacacggcaggtcgggaggtcaggagttttaggggcaggttggatgagccttctgagaagggggcatgtaagcagagattcgaaggggtgagggatttgaccacgtgtttaggaggaagcagtgggtgcaaaggccctggggcaggagcgtggcctcttagacaggatagcaaggaggctgtggggctgggctgagtaacagacagtggttgtggaatgagaccaccgcttctgctgttgtccttcccagcttctccccagcctccccttttccctagtttataagacagcagaaaagggagaaagcaaaaagatggaaagaaacagaagtaagataaatagctagacgaccttggcgccaccacctggccctggtggttaaaataataataataataataatattaacccctgaccaaaactactggtgttatctgtaaattccagacgttgtatgagaaagcactgtaaaactttttgttctgttagctgatgtatgtagcccccagtcacgttcctcacacttactcgatctattatgaccctttcacatggaccccttagagttgtaagcccttaaaagggctaggaatttctttttcggggagctcggctcttaagacgcgagtctgccgatgctcccggccgaataaaaacctcttccttctttaatccggtgtctgaggagttttgtctgtgacttgtcctgctacagttggatgtggggccagagagaacacaggggccagaccaggcagaggggcttgtaggccaatgttcggacggtggctcgtatgttattttcaagaaataacatgttcacaatgacagttaaagctttccccacatccccagcccccagccctctcctgagattgtttgcaggtatcatttccctgaatgtttttctacatttccacatgggtttgtcttcagaaagaatatagagtattatttcatgtgtttggaaaattcacatcaagaggcccatgtcaattgtttctttctttagccttttcttcactcaagatttttttttctttaaaaataaaaattgaggccaggtgcagtggctgacacctataatcccagcactttgggaggctgaagcgagtggatctcttgagctcaggagttcaagaccagcctgggcaacatagtgagaccttgtctctactaaaagcaaaaaaataaaaaaataaaaaaatagccgggcgtggtggtatgtgccttgtagtcccagctactcaggaggctgaggtgagaggattgcttgatctggggagatcgggaagtcaaggctttccagcctgggcaactgagcgagactctgtttcaaaataaataaataataaaaattatgtatatttaaggcatccaaatgctgttttgctatatacacacacatagtgaaatgattactacagttaagcagattaacatatgtatctcctcatatagtcacctctttttttttttttttttttgagacagggtctcgctctgtcacccaggctagagtgcagtggggtgatcacggttcactgcagccttgaactctcaggctcaagtgatcctcccacttaagcctcctgagtagctgggaccataggtgcgcgccactgtgcctggctaatttttgtattttttatagagatgggctccctatgttgcccaggttgttctcaaactcctgacctcaagcgatcctcccacctcggcctcccaaagtgctgggattacaggcatgagtcccggccacctctttgtttttagtggtgagagcacctgaaatctgcttccagtatacagtacagtattaatcacagtcctcgtgttgtgcatgcaacctccagaccacccatcccacatgactgcagctttgcgccctgtgacctgcatctccccacctccccagcctccgccccgtaagcaccattcaactctctgtgtattcaatgtcttcagattcctcacctctaaaagacaaatctggaagtatttgtcctgcagtatttgtccttctgtcaagattctgcctttgagatatctgcaagtcgatggcgtttactcactgtgcagccaccgtgtgcagaagcccagcttatctttgactgagaacctggctgggctctctgttgtttttcaaggcagggtctcgctctgtcacccaggttggagtgcaatggtgtgatctcggctcactgcaacctccgcctcctgggctcaagcgattctcccacctcagcctcccgagtagctgggactacaggtgcatgtcaccgtgcttgggtaatttttgtagttttagtagagacggggttgcaccatgttggcccggctggtctggaactcctgacctcaagtgatccacccgcctcggcctcccaaagtgttgggatcacaggcgtgagcccccgtgcctggccctctgttctttttttgaggtctgacaattcttctggcgctttcttgcacacttaggagaatctttctagggcagagttttcaaactgtcagatgtgatcagattgtgggttgtgaaataagtggggtgggtggggatcagcttttttttttttttttttttttgagatggagtctcgctctgttgcccaggctggagtgcagtggcgcaattttggctcgctgcaacctccgcctcctggattcaagcgattctcctgcctcagccacccgagtagctgggactacaggcatctgccaccacgcctggctaatttttttgtattgttagtagagacagggtttcactgtgttggccaggatgatctcgatctcctgacctcatgatttgcccgccccagcctcccaaagtgctgggattacaggcatgagccactgcacctggcctgggatcagcattttaaaaacagaatggaataggatagaataccagaggggcgaataatggagtcataacgtaagttgcatcatgctgggaaggtgcgtattccctcatgaggcttctggtgggtgtgcaggtcgtggccctagcctggcaggagctgggaagctggtgctctgcaccatgtctgaacagggaacccacagaccatggggctttgctcacacctgacccgattagaaactgtcccgactccccagtggcctgacccccgctgtgcacagcggtcctgtttccaaacatctttgcctgtagttgttttcttggatgtcctaatttttgctcatctactgggaaatgatatctcattttaatttggagttaatctttctttttgaaattgtgattaagatccagttaacgtaaaattcaccaaaaccatttacaaatgtacagtttagtggcatttagtgcgttcgcaaggttgcgcaatcgttaccacgatctagttccaaagcattctcattaccgtgtacccattaagcagtcacccaccattcctttctgccccagcccctggcaaccaccaatctgctgtctctggatttgcctattctgggcatttcgtaagtgtggtcagacactaagtgtggccttttgactggcttctttcactccatgtcaggtttttgaggtttgtccatgtggtggcatgtgtcagtgttgcattcctttctttttctttctttctttctctttttttttttttttgagatgaaatctcggtctgttacccaggctggagtgcagtggcgcgatctcggctctcactgcaacctccgcctcccgggttcaagcgattctcctgcctcagcctcccgagtagctgggaatacagttggctgccaccatgcccagctaatttttgcattttttttttttttaatagaggcggggtttcaccatgttggccaggctggtcttgaactcctgacctcaggtgatccacttgcctcagcctcccaaagtgctgggattacagatgtgagccaccacacctggccgcattcctttctttaaaattattttttttggctctttaaatacatttcttttttacgcagtagtaaacagccaacccatgcattcctttttctaagtgagtcagatgccgctgtctggacagaccacactgcgttcagccattcatctgttgacggactcttgggtcgttttcgcccattgcgaacagtgctgctgtgcacattcttgtacgtgttgttttttacacccattttcagttcttcttgggtctgttctggggagtggagttgcagggtcatacggtaactttgcgtttgatcgtttgaggaacggtcagactggtttccacagtggctgttccacgttacacttctgccggcaatgcataaaggttccagttcccacacccttgccaacacttgctattttccatgaaaaaaaattctagccatcctggtgggtgagaagtggtggcccattgtgactttgatttgcatttccctgatgatgtcaagcaccttttcatgagcttgttggctatttgtgtattttctttggagaaaggtcttttcaagtcctttgcccatttgcagttaatcttttatttttaaaatttcacattatagtttcaaaagggttttagtgaagtgtagcacacgtatagaaaagcccacatataaagggaataacaccatacatttttcagtgaacatagtcccgggtaaccagcaaccagatcaggaaacagaattttcacccgcttatcccccaacctcccaggtgacccctgttctggtttctattgatatgttagtcttgcctgttttagaacgtcacataaatgggattatatgtgtatgcacatatctgccttttgatcaacatgattgcattatattttaaaggtagtaatagtattcatttttaaatttttttttacttaaaatattctggagattgttccatagcggtaaatatagcatgtcatgggtggtggtgttgctgttgtttttttcagacagggtcttgctttgtggcccagactggagtgcaggcacatgatcacggctcactgcagccttgaactcctgggctcaagtgatcctcccagctcagtctcctgagtagctgggaccacaggtgtgcgccaccatgcccggctaatattttttgtatttttagtagagacacggtttcaccatgttgcccaggctggtcttgaactcctggcttcaagaaattctcctggcttggcctcccaaagtccttggattacaggcgtgagccaccatgcctggcctaatttgatgagttgcatcagatgtatacacttcacctatatggcaaccaaaatcaagatagctgggccagttcacgttagtcccctccctccatcccggtccccggcagccactggtctggcttctctctctagagtattccctttccccgatgtcgcggaaatggtgttgtgtagtatgattcttcttttcttttttttgcttggggtagtgcttctgaggctcacctgtgttgtggtgttcatccatggttggttctttttgattgccaggtagcattccattgtgtggatatgtggcaattcatttatctgttgatggatatttgagttgtttccaactatcaaatatggatatatcattccatatttgtttttggtgaacattcaggcaagtcacgctcttaaaggcttcccagcctttgcacaggctgtgtcctctgccaggcactcctccaccatcttcttttcctagcaaagcccagcttattttaaaattcccagctcagatgtcccctcctccaggcagccttcctgggctcaaagggtctatttcgccagatgggagggagtggcgtccaacaagggctcaccttggcattctatcccaactctgtgttccagggccatggtctttgaccttgggggtggtggggacagaatcacagaatcagccatgttaggcaaaaggccacagtgtccccaccactgttatctaatcagctgcctggtctagtgtggtggaaaaaagtcatcctgctgatcaaaagcagggcaaagtccatcccttaacccgggtggaggtggggcagaggaggaagggtcacttaatgactgcagggctgaccctctggtgcccggggtcttcagaccttgttctaagcactttacctccatggactcattcaaacctcacagcagcccatgaggcgacactctccttacgcccattgtatggttgaggaaactgagactcggagaaggtcagtgacccatccctgatcacccagttggacagggctgcgctgggtctctgaagattccctttgggcagtgctgaatgaatgggctgaaacccagggcctgaaagcctcttctttggggagagagagagagagagagagattgagacatggacacgcggccggatcccatgacttcttggtttagccctgattcatcttcagaaccaggccaagcggccaggggaggaggaaagcatggtgagattccaaaggagaaaggtatctccagcccagcagcctctgctgagaaaccaggtgggagagggaggctgcaaagggaaattgaggctgcgtgtgtgtgtgtgcgcgtgtgtgtgcgtgtgtgtgtgtgtgtgtgtgtggagatggagtctcgttctgttgcccaggctggagtgcagtggtgtgatcacagattgctgcaacctctgcttcctgggctcaagtcatcctcccacctcagcctcccaagcggctgggactataggcacctgccaccatggatggctgatttttctattttttgtagagatggagtctccatgctcaggctggtcttgaactcctgtgctcaagtgatctgcctgcctcggcccctcaaagtgctgggattacaggtgtgagccaccgcactgggccttgttttgcttttttaaaaaagcagctttattaaggtgtgattgatataaaacaatggcacatatttaatatatgcagtttgatgggctggtgtgtgcacaccgggaaacccgcccctgagatccaggtgctgaacatacctgtcacctctacggttccctcctgccccccactgttttctgtggtgagaacatatagttcgtgctctactccccgaacacattttccagggttctgggttttgatgctgtgttttctatggggggagcaccagcagctggatgtgtcccccaggctggtgaaggggtctggcctgtggtgagcagggtccccagggctgcagggtctgtcccagacagagggacctgcagtgcatgggctttgaggctgggtgaaggccaggactgaaggaagggctgggcgatcggggcctgagagctgggaggggctggagctggtgcctgtgggctgtggtcgcatggggtggtgggagccgccatggggtggggagggcgttaccgagggggcaggactgctctttgatccagctcacataccacctcccccaggaagacctcccggactcctcagtgccctccaactattggttgaatctctctccagccttagttgtgcctcagtttcctaatctgtaacatgggggtaataatagtggaggtggctgcctcaaagagtaatggtgctgttcagaggatgagaacacagtgaacagcatcaccaggctcatggcgcaccccggaaatgctcgcttctgttacctcattaatattcagtttatgcgccttcgtttgcacctatgggctgctcagaccataaggtgatccttctggtgctggcagctgggtaggaagacacgtttatcaataaacaattatggcacttgaaggccagtctctgatctcctgatttttccaagagaactctgaaatccagattttacattacatcttccagtttcttgacaaagaattcagcttcttcattgacacgccacgtaggtcaaactagacacagttgtagctacagtgtcactagctccttcgtacagatgagaaacttgaggttcacaggggctgacttgcccaagtggccccgtggagtgcgacccagggtctggctgcctccaaatctgctccttccgggggacatggggctggccctgactggccagctcagctgtctgcctcctgtagagcctctgcctgttggttctggctgtccttgtcttagaaggccatgttcaaaagagggtggaaggtgacgcagctgcctggctttgcgacatcagctctagtctaatgggctgggtcactcctgccgggctctgacgtggtgtgggcactgaggggcccgagatatgtcccggctgggttgagggtgggggtcaggtggactaggggggacctccctgtgacactggggcagcgaattatagatctagaggaggaaagctggcagaggagtccaagtggaccccaggcgtgtttcctatagtccctttaagaaaaccatgtttttgcaacatttttaaatcaggagatttcatatacatttctttatttctggttttcatggaaaacttctgtgttctcatcttccgactggctcactcagccacacagggaggctctctcccagcgtctccctaccacagggcctttgcacaggctgtggttgctgtggaatgtcccctgcgcctcaccttctagatttgtgagctcccttcctcactgccttctgttttgattttgggtctaggttgtgtttgtgtgtgttctttttctttctttcttttctttttttttttttatgagacagggtgttgcttggacacccaggctggagtacaaatggcgccattacagctcactgcagcctcgacctccttggctcaagtgaccctcccatctcagcctcccaagtagctgggactacaggtgtgcagcaccatgcccagctactttttaaaaaattattttttataggccaggcacagtggctcatgcctgtaatcctggcactttgggaggccaaggcagacggatcacttgaggtcaggagaccagcctggccaacgtggtgaaaccccacttctactaaaacaaaaacaaaaactaaaacaaaaattaaccaggtatggtggtgggtgcctgtagtcccagctactcgggaggctgagggaggagaactgcttgaacccgggatatggggtttcggtgagccgagatcgcgccactgcagtccaacctgggccacagagcaagactccctctcaaaaaaataaaataaaataaaaatacaaaaattagccaggcgtgatggtgggggcctgtagtcccagctactcaggaggctaaggcaggagaatcgcttgaacacagaagcagaggttgcagttagccaagatcatgccactgcactccagcctgggcaacagagtgagactccatctcaaaaaataaataaataaataaaattattctttatagagacagggtcttgctatgttgcccaggctggtctcaaactcttgggctctggtgatcctcctacctcggcctcccaaagttctgggattacaggcatgagccatggtgcctggcctatatttcacttacgtgatgactgtctcaaatcccagtctctccccaatccctgctgtgttttctctgtgctctgtcacgtggcatgcgttttacctgagttgtttggtgcctgcctttcctccgctatggtaaagccccacatagctgggcttttggtctgtcctggtcattctcccatccccagctcttagaacccgcctggcaggtggtagtgctcagtgcttgcttgtggaatgaatgaatgatccccctggccacacggagcccatgttcctgcatgaggctatccctgccctgagcccatccgctaccctgagctccggcgctccctttaggtggtgcatgggcccctgtttaccacagtcccttgactggtgtcacctgttgctgttaggacatattttaagatgcattatgacagcatggataggttgcctgtttaattccataagctccaggtgcgacagcctcatgtgcgaagggctttcccaccacctcctatcccaagctcccgccgaggagccccttccctggccgggctcgggcagctgttccggagccttgtggtggggcgtggggccctcatcactctcctcacaagcgtacttgtcccttcccctgcagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacaggtgaggctgtgtccaggtgagggtggaggggccggctgaggctgggcaggggaggggtctcagagtggacgggatggggaggctgctgactgagccccagagattgttccggaagcaggcaagtcatagtcggggtaagtgctagtcccagagaagtttttgttttagggttttttttttttttttttttttttttagagatgggatcttgctatgttgcccaggctggttttgaagtcctgggctcaagcgatcctccgcctcagcctctcaaagtgctgggattacaggtgcgaatcaccagacgttgcctagagaggttctttatggagcagggagggaccaatggtgtgcgtctgggtggagggtgcatgtgtgagttacacacatacatacacacacatacacatacacatacacacatacatacatacacacgtacatacacatacacacacacatacatacacacacatgtacctacacatgcatacacacatacacacacacacacacacacacatgcatgaccaggagcagggaccgaccccccagaccctatctgggccagaggaccgggtgggtcagcacgggaaggggtcagctgtttgtggaacatgctggcccaaggaccacagagttgtgcctttgctttctgcttgtcctgtacctggctgtggcctaggggaagtgacttcattcctctgagcctcagtttgcccgtctgcagactggagagacacaagagccccttcatggggtcaccgggacactcaggatgcactcggagctctgagacggctggcggatgtgcctgttacaactcccttacctcctggcgttttcacagcacctcccctcctccacacccccacttcccagttcacagacaggggagctgacttgcccccggcacacggtgttccagggatggggcgggcagagggtgttcccgctgttggagacccacagtctggttctgggaaagccaagatgaaaacccagcaaatgtgcctgaggtttgggaatgggaaacatgaatcagctgctgcattccgttcactcattcactcattcgctcgttcatttaacaaatgtttactgagcacctgctaggtgttggctgccgttctaagtacaggggacccagcagtggacagaatgggcaaaaatgccaaagctctctatactccttcattctgtgagcactgactgagcacctcctgtgtgctgggggcgcaggcagaccaaggccctgcctcaccaagctgatgttctgatggggagagagtaaagaagtggacaaataaggggaaatcaggcagccatcagtattgtgcagacaaaacagtgtgaagccggagtgcaggagggagggtggccttggggctcggtctgactggagggtcgggagcacatctgcaaagggacactcactggacccgcatggtgggaagaggccctggggagacagagtcccgggcagagcatgtgcaaaggtctgaaggctgggacagaggcctgtgcggctggggttacgagggagggagacagtggagagacgaggcctgagccttgctgagggcctcagaggtcacgttaggagcctgattttaacctgcatgcaaagtggggttgtggtccagagcatggcacgatctgatttctacttttttttttgagacggagtctctctttcacccaggttggagtgcggtggcgcgatctcggctcactgcaacgtccgccccccaggttcaagcgattctcctgcctcagcctcccgagtagctgggattacaggcatctgccaccatgcccagctaatttttgtatttttagtagagacgtggtttcaccatgttgggcaggatggtcttgaactcctgacatcaggtgatctgcccacctcagcctcccaaagtgctgggtttacaggcatgagccactgctcccgacctgatttccacttttcaaagattcttctggatggtggagagtggcttggagagatgagagatcataaggacagcagcagcaacagtcacagcagctgatgtttacctcgtgctttctctgcacccggcggctgtgttgattgctttccgggtatctgattgcttaatccccacagctgccctgtgaagtagggcttgtgattacttccttttgtagatggagagacgatggccgtgttgggtgggggagagcagaacgaggccgggtgggcggcgacaccatgtcctgcagtgggcaggcagcgggagggacagacttggcgaaggggccgagctcagctttggctgtggggccggaggtgtgcacagacgtccagggcccctggttcccaggcaggcattgcaggcgagtagaagggaaacgtcccatgcagcggggcggggcgtctgacccactggcttcccccacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttggtgaggctgccctgtggcccacgccgcctcgcaccctgacctcgtcccctgtctctcctcccgcctgccccttgtgcagagagcagtccctgaggtggtcggagcgtggggactcacgcctggtgggtggctttcggccctgtgctgtctccaccacccccagtgggttctgagtttcccaggtgggtccacctgtcttggtttggaagtcctggccaaagtacttttttttcccttttcaatttacatttctgagatctccaaaaggggctgtcttgttgagggctgagccacaggcccgcctctgggactggggctggagttcacttagcctgagtccagtggggtgcaagggggagaaggggttctcgggagcacatgtggccttggcactggaggagcagagggtggttctggtgtcccagatgccccacgtggccactccaggggcctcctgcaccccagcatttcccttcatgggctctttgctgtgaggcccagctggggccaagggaggatgggccagccacgtccagcctctgacactagtgtcccttcgccttgcagggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgaggtacgtgtggcctggtgagaagccaaagattcaggcctgtgtcctgtcttcccctcacacagcctggacactggtcaccagcttgctttgtagctggctggggatctagtggctgtgggttgtaagtgactgagaacctgactcaaaccggcttgagtgaaatggggaatgttggggctcatagaactgaaaatgctagggttggattcaggtacagcttgatccaggctcaaatgatgtgactgggccttagcttagcaaattggaggctttgctggaggaagggggcatggctgctggggagtaatatcacaagctgactcttaatcttgactcttggcaacctggtagggtcactgactgggcttcggagccaacatctcgtccatggagggtctgaccctgaccttggctccctcaccgcaggtttcactgagtccttgggactgctccagcctcagccatctctttggtctctgctgatcagggtagagtgctgggggggatatcgtggtgctgcgtgtgatagatactcagtacgtttttgtcaagggtgacgggctcctgtcgtgtgggtaaatgagcaagtttgggctaagtggcatgatgctgtaaaggcatcttgtaaatcctgaagtgctttgcaaatgaaagttattacaaagtccctagtttagtataatctacgtttgactgcatataatgaaaacctcacaagaaaagtctagcggtaggctgttcagtgttggtgtggtggcttcatggtcttaagtgatctggaagccttctactactgtgctctgccatccttggcatgtggttttcatcctcaagataacctcattgtccaagttggctgctagagtgtcagcaatcacatcacattccaggcagcacagcaagaaggaaaaaatggtggggctttggggagcagatggaggaactgggggtaaaacagcgtgttccagtttcctccctcttagggaggaagaaaaccaatgtccacttcctttctattggccagaactgagtcacatggccacacctagctccaggggaagctggaaaggtagccttttagctgggtgtgctgatgctctgagtatggtttgggtcttgtatgaaagagtaaggagagattgggctttgggtagtaactggcagtttctgatgctctccgtccattataatgatcatttaaggatcctattgggtgagcatttattaataataacaataataatgaaaataaagactatcattttgagctcttactgtgtccggtgcactgtacctggccgtttttgcacatgagtccctttagtgctcccctttgtagtggctctggttattcttggctccacatgggcacgtgacagacacacccgggatgctgggctggggccttgtgctgggtcctgctctggaggtctgtgatgggtgcagtcactcagccgggcaaccttggagctcctcagtgtgctccaccctgcaaagcacttctagatatttccttcagtcactcataccactttgtgctttgcatgtctttgggattagaaaccagcttctgggaaatgctctcggagcaccaaagcctgggccccactatcaagaacctcgatgggttaggacaggccaggttttgctgctgtgacaagcagccccggaatctccatggcttagaacaaccaagacttattcctttgcttgcactccacgtccagtgtgggtgactggggcacccgcgcttgtggtggtcacttggggatccaggctgagggaggctctgtcttgacacatacctccttggctgctatagcagcggcagagagcccggtgaaaggcgtgtgcacagtccttaaagcatccccccaagtgacatgccacttctcctttttcattgctcagggagctgacctggccatgctttattttatgctggagtagggtgtggtgggggtgatctgccatttacctgggaggaaagccagactctcctggagttaggaagggagggtggaacactgcagccacagaacccgggaccattcctcctagaaagctcccaagcctcctctcggtccccagacactgggcatttggcagtgaaccagatgctgggggccctgtccttctggtggagggggaggagggctcagcccagaatgttcagaccaggccggctcaatggcaggcctaagccttacgatgctgttccctgctgtgtctgtagctcaacaactccgactctgggctcttcacggtgttcacgggggtccagaacatcagcaggatccacctcgtggacaagtggaacgggctgagcaaggtgaggggcgagaggcgagggcccctgtcgccagggagaggggagggtgggcccggccatggctgctcgggagtggcagggaccagagagctccttcttcctttgtcgtgaagagggtgctgggaggatgaacactcttgaagttggaggagggattttacctctggttaaagcttgaccacccagaggggcaggtggggttagtgattgcttactgagcttactgagcacctggcatctgctgggaactgagtgctttcttcctttcgattctttacttacaaaaatgttttgaaggccgggcgtggtagttcatgcctgtaatcccagcactttgggaggccgaggtgggggggatcacctgaggtcaggagttcgagaccagccaggccaacatggcaaaaccctgtctctactaaaatacaaaaaattagctgggtgtggtgttgcatgcctgtaatcccagctactcatgagctgaggcaggagaatcgcttgaacacaggaggtgaaggttgcagtgagctgagatcacgcaatttcacttcagcctgggtgagaagagtgaaactcggtctccaaaaaaaagagaagagattcacattacaaaataaaacaagagagggagataagtgcccttagtatcacctcccacccctaccccttgccccagaggaaacccacagttatcagtttgggatatattcttcccatccatttttacccatgtgcacacctgtgtgtacgcagagaaatacggaattgtttcttctttgaacatcatgaaatcatactacgtgcattgttttgcaactggcttttttcaccttcgtgaccttttctcaatatgtgtgaaaatgactgtgtgacttcccactccccactccccgtggtagttactgcaaagaccctgagggctagggacaaatcgtaccccaaccggtgcccagagtggcaaaaatcaccatctgcaactggcagtagccattcacgatagatggagttcacattcattgtggcttgtatattccaatatactgtacatgtgcacgtgattttaaacatcctcatcatacagaagattggaaagtgagcagttggttttgtcgagtctgggtctcgctccccagagtcagttaacctgacaggttctgttttggggttgcccggtggtggccaccattatgattttaagtagtttgcctgtgtgccgattgttttcaggaggtgcctgttgacttccgctctgagggctgagcacagccgcgccccacctctcacctcacctgctcaccacacttcttttccagattcaggctggaaatgtgggtgataggcctattttgcagatgaaagaactgagtccctagcgaagttacacattcaggggtctgggagggggaagctgtggtaggcattctctctgtgtgtctacatagcctgccctcttcccaccgtgccagtattgggaattgagtggccgtgcgtgcaccagggtgagttaggtgtgcagcacctgagagggcttattaaggggccttggccctactgaggggtctagtctggatgcttccccccaggttgacttctggcattccgatcagtgcaacatgatcaatggaacttctgggcaaatgtggccgcccttcatgactcctgagtcctcgctggagttctacagcccggaggcctgccggtaatcactgggactcggggcctcctgggtttcctgggtagctcatggccaaattctgtggtgttggctgtgcacttggaaagcattttgactcatcgtggatttgactcagtagcccttggcaccagcttgaattctctttggtcacaccaccaaaagccaaactccagctgccaatgcctctacacagcccaaagagaggctgctggtggtggtttgcagccaggtggtgctgggctgggaggagggggcaggacatgtcaagtcacagggggccataaaatggaggcgagaggtgggctccctctggcgtctggctggtggcccccatgaccatctgggtgctgagacatcagctggctctgcttggccccttcaggctcagctctgtgtcccatggtcccagttgtggggtaagagtagacagtgggtggctcctacagcccttttctggaggccttgctgtgtcgtgttccattctggtcactctggaaaagtcctttacttaggaattcactcatgtggaccttgacttatctgccctcccagcaaaccctgtgaagccctactgtgtgccaggtgcccggtagtgagagggtgggccaagtctccgttccccaggaggctgtgtcctatcagggcaactcaggcaaatgcacaaacactagagtgtcagagagtgacagtgcttttgctctgtgtggccactttttactattttaagtttttacttatttatttatttaattttttagagatggggatctcgctatgttgcccaggctagtcttgaactcctagcctcaagggatcttcctgcttcagcctcccaaagtgctgggattgcaggtgtgagctactgtacccagctgactttaaaagctgaattttaaacttaaagaaaagttgcatgagaaatacaagtggcccccgtctccccttcacccaggttcactagccgtgttaagccccccaccccctcttctcgccgagtgtctttttccagaaccatcggagagtaggttggaggctgtatgcccccttacctccaaatactcagtgggtgtttttcagaaacgaggacattttcttacataaccataatgctgttatcaaaatgagaaaatttggcattgacataatactgttatctaagctggcactttcctataaatcaaaatatgcaaggcacacatgcaatttaaaattttttagtggctgcattaatacaagtaacaagaaattggtgaaattatttttaataatgtattttatttgacctcatatatcaaaaatgggatcatttcaagtgttattgatgaggttttttttttgttttttttgctagcaagtattagaaatctggaatgtattttatacttgcatcccaatttggactcaccccatgtcaagggcgggatggacagccatgcgtgctgagtggctgccgtggacagagtgggtagcacagtgcatgttcaagttcagaagtgcttttgagaaagtacaggagcatgaatggatggagggtggatggggtgggtgtgggggacggtgctgccacccgaggaagtgacagctgaactgagatctgactgaagggctgaagtctggtggatgaagatgccagaggagactgttcttaggcagagggagcagtgatgcaaagggcctggggcaggagtgagtgtgcttaggaactgcagggaggccctgggcacaggaagttggggcagggctgagcagagcttatgcaggggctagataaggtcaatgaatcctaatggtaggttagactagaaagggtcacagattttcagcaggggcatgatatattctgttctttttttaatttcataactttcaaaaacaattttatttttagagactgggtctcactatgttccccaggctggtctcacactcctgggctcaagtgatcctcccacctcggcctcccaaagtgctgggattacaggtgtgagccataatgcctggcctctgttcttttgtaaaactccatctggccacggctaatacattggtgtgggtggggaggcagagtcggagcggagaggcctgttaggaggtcgctgcagctccgcgggtgagagatgggggcggtttggacccgggaggtggtagcgcccgtggggagaagtggctggatctgggcagcctttggcagggcctggctctggccgccgggtctgggtgtcccctctcatcctgtctgtcccctgcagatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtacgtgccgtcccctgtgctgggatggcgggagggtgtgagggtggggccagctgagggtttatctgcccagtgctgtctgcttaatctctggcctctgtactcttgataatcccattaggcgaagataatgaggccgcaggaagataatctgaaaaggaagaaatgccaggtctattagttgctgtcacaatatattgccatgaacttcagggcttagaacaacacacactggttatcttgcagttctgtagtcagaagtctgcgtgggtctcaccgcgctcagaacaaggcggctgtgttccttctggaggctctaggagaagctgcgtctgccttttctggcttccagaggcccctctgtgtttcttggctcccgggcccttcctccacctttgaggccagcaacatggcatccttctgatccactctgtcctcatatctcttcctctcctccctcttctgccccctcttccagttctaaggacccttaagaccacatcgtgctctcctggataccccaggacaatctccccatcttgtttattattattttttttgagacagactctcactctgttacccaggttggagtgcagtggcgccatttcagctcactgcaacctccgcctcccaggttcaagtgatcctcccacctcagcctcccgagtagttgggaccacaggcgtgcaccaccacacctggctaattttttgtatttttggtagagatgggggtttcaccatgttgcccaggctggtcttgaactcctgacctcaagtgatctgcctgcctcggcctcccaaagtgctgggattataggtgtgagccaccgcgcccagcctatttttatattttgagacaaggtatcactctgtagcctggagctggagtatagtggtgcgattatagctcactgcagcctcgacctcatgggctcaagcgatcttcctgcctcagcctcctgagtagctgggaccgcaggtgtgggccatgatacctagctaattttatttttgtaaagtttttatagagatgttgtttcaccatgttgcccaggctggtctcaaacacctggcctcaagtgatccacctgcctctgcgtgttaaagcaatgggattacaggtgtgagccactgtgcccggcccaatttctggaccttcaaggcagctgctgagcaggcccagcgcccgtttaccctgtgacctgacatagtcatgggttctggggcttagggcatgtacgtgtcctaaatgacatgaaatgaggctggcgagggtctgtgtgttacgtaacatcttctcgttccgcagtgtgggtggctaggcagatgtgatgactgctgttggcgtcggtcccctgacattgttggtgtgtctcaattgtgtgccagtccctgagacacccccacctcaagttgctcagtttggaccctcgggcgtcagtttgattccctgtcctcacccagctcttccagtgcgtcaacaagcccagatggctttacctccaggttgagtcctcactccttcctctctcttgctccccaccccaacccccgcctcattgtccaggccacggacacgtccttcctggtgatccagccctttcagtagcccatccctcaatgcagtgttgccgccttaccatccatcccctagaccatccagtgcggtcactgctggcctcttgcggctgtttaaattgaaattgatttaaacgaaatcaaattaaaaggcagttccttggttgcaccggccggaagttaaatgctcataagccatgtgtgtctagcagctactgtcttggatagcacagatagagaacatttccatcatcataggaagttctgtagcactcccgacagcagcggagggatcttttaacaatgcaggccgagtgtggtggttcacgcctgtaatcacaaccctgtaggaggccgaggtgggaggatcacttcaggccaagagttcgagaccagcctgggcaatatagcaagacctctctctggcaaaaaaaaaaaaaaaaaaaaaattagctaggcatggtggtgcatgcctgtagtcctagctacgtggaaagctggggtggaaggatggcctaagcccagaggtcaaggctgcagtgagctgtgatcaccccactgcactccagcctgggcaacagaggaagacccatctcgaaaaatatgcagatggccgccgtcctcttaaaatgtctggcagctctgtctgcattcatagtgaagtccaaactcccaccatggccctgggccctgcaggatccagcccctaccggcctctctgaaggatccagccccgccagcctctctgactccatttctccctacacgtcccctgttcattattctccagccctgatgccttcgccctttttctaaagtataccaaggtcagtgccttgcactgtggtttgcatgggttgcttcccctgcttggagagctctttgtctggatttctgagtggatcatccctcaccttcttttggcctgcatgcaaatgccacctcctccgggaggcctcctctgatttcctgttctaaagttgccccctctcccacctgctgctccctatggcttcctcttcttgtcttcttgtcttggtcttcttgtcttcctcttcttgtcttggtgctcattgctccctgaactcatggactgtggattttattcattgccccttccattcactgtcatccctgtaggcagggccccaagctcctcttgttggttttattcttagcttctagaactgtgccccgcatgtaatgggtactcatacagtatttgaatatagggatggtgagtgcgttctgtacttaggaaattgaggcctgatgctggatgcgaccaaggtcacagggttggtaggaccggaagcggccctctatttgactgtgtcttgccttctgggagcctttttggttgaagccccgtcctccagctggcaatggcgactctaaaggactggtctgcaacaggggtcaggaggaggggctgtcaacagattggatgctttcccctatttcaggcagaatggaacaacctgtgaatgaatggtttggagctggggcctgggacgcccgctgctgtctcctggtcctgtctggcccgtctgggcattggcctctgcttgcttcattctttgctggtatcggcggggatttctgctcctaaggttgaggatgttacacacccaataggtgtgctacagcaactgtcgcaagtggcagatgctggactccacctgatttaggccaaaagggcacttcttggtttgcgtaatgaaaaattccagggcagatctctgcattaggcacaaatccagaacttagatgttgtctggaagctgcctctgccaagtcccagctcagttttctgctggactggctttgctgccaagcaggctctccctcctggctgcctgtggaggctccaggctcacctccgcccagctccgagtcctgcagaaagggggccacctgtgtttccttcactccagcagaagttccagggtttgctctaattggtctgcctggctcccatgcccagctgtaaaccaatcacagtagccgaggtggactatgctgattggccaggcttgtgtcacatgctcagatggctcctgggtgggccggccccactccaagcacaaggctgaaagtagggaaggcttaaagtaggggtgtaggtaccaggagaagggggagaaacgacatgcccatcccctccaagggcgtgggacgaggtgtgtcccgccttctcttagcacatctgccaaaagaatttcaaaagcgcaaaggaattttaaaatctttatttaaatagagttttttcttatatttatttatatttttgagacagggtttctctgttgcccaggctcaagtgcagtggtgcaatcacagctcacagcagccttgacctcctgggcacaaatgattctcccacctcagcctcccaggtagctgggagcacaggtacacaccaccatacctggctaatttattttatcttatttcaatttttttttttttttttttttttgtagaggtggggttgtgccgtcttgcccgggcttagtttttgcttctaaataaaatatacatagatacaaagaagttcccagatgactcatgcagtttttggggttttttgctttgttttttgagacggggtatcactgtcgcccaggctggagtgcagtggtgccatcatggctcacagcagtctgacctccatcactcaattgatcctcttaccccagcctcctgagtagctgggactacaagcggttgctaccatgcccagctaattcttaaattttttttaagagacggggtctcaccatattgcccaggctagtcttgaagtcctgggctcaagtgatcctcccgcccaaagtgctgggattacaggcatgaaccgctgcgcctggctgacacctgcagtttgaaacttcacaaagtcaacgcaccccgtggccagcaccctgactgagaaacagacaggacaggccctggatgccactcgcggtcctcccaccgccctgacatccagccccggagctcagctggtttgcatcttcatgtgaatggacccataatgctagactccttttcctccttttctggcccgtgcaccccttagcaccctggtgcaattcgtccgtgacgttgtgggtggtagcagcccctcctctccgttgctgtgtggtgttccatcgtgggtgccacctccatcttctccttccattgctcctaggcatccaagttcctgtttttcgaccgtgaccgtggtgcacacgtgtcgtttggtgcacctatgtctgtgtttctgtggcatgttatctaaagagtaaaggtaccatgcctttgcctttctgggccttgaaatctgttggactcagacaactccctcatctcaaacctccctgttgcgtgagggcatccgacttgcctcacagagccaactaattatcatcggtggcaatcctgggcaattatgtctggctagatatgccataaagctacaaattaattaccacttacagctgggaagatctctctcggcgtgcttggtaataacattggaagaaacacgtgcgtgggtccatgcaggctcggcctctgaagcaagggcgggggctggcaagttgttccatcccaccttggtctccacctggggctgtgggcaggccagggcttgtttgagattcctccagagttcggctccgtggctgcctcctccacggaggaggcacgagaggcagcgttttccagattgtggaggacactgtccctgcgggtgcttgggatggcttcagaaggtccaaggaggtgagagtgagcttctgggtccatgctcttttcctccttgccatcacctgcaggagaaggtctcttggtgttgagaggacttgaagagccttccacactcatcagccttttttgttttgttttttcttttaacagaaaaagagcagggctcccagttaaagcctcatgcagtaacaggttctagttagaacttacaacatcattattttccacggtattttttaactatgtcttttttttttttttttgagacacagtcttgctctgttgccaaggctggagtgcaatggtgcaatcttggctcaccacaacttctgcctcttgggttcaagcgattctcctgcctcagcctcctgagtagctgggattacaggtgtgcaccaccaggcccggctaattttgtatttttagtagagacggggtttctccatatcggtcaggctggtcgtgaactcccaacctcaactggtccacccgcctcggcctcctaaagtgctgggattacaggcgtgagccaccgcgcccggccctttattttattttattttttttgagacacagtcttgctcttttgccgaggctggagtgcattggtgcaatcttggcttactgcaacctccgaaaactattgtccaggctggagtgcagtgatgcgatttcagctccctgcagcctccgcaacctctgccgcccaggttcaagcaattctcctgcctcagcctcccgagtagctgggattacaggcacataccatgctcagctaatttttgtatttttagtagagacggggtctcaccatgttgcccaggctggtcttgaacttctgacctcaagtgatccacccgccttggcctcccaaagagttgggattacaggcatgagccaccgtgcctggcctctgattcaggtttttgttttgttttgttttgttttccttactgaggcaaaattcttgtaacataaaattaaccattttaaagtgaatgattcggtggcatttagcagggtcacaaggttgtgcagccatcacttgtatctcgttccagaacatttctgtcaccccaaaaggagacccagactcatcagaagtcactccccgccccctcccccagcccctggtcaccacccgttggctctgtctgtggattagcactgtctggatccttgtgagctttttaaaaaaaaattgtttttcttttgagacaggatcttgctctgttacccaggctggagtgcagtggcacggtcacggctcactgtagcctcaacctctgaggctcaagcgattttcctgcctcagcctcctgagtagctggaactacatgcaggtgccaccatgcccggctaatttttgtagagataggatcttgccatattgtccagcctggtctccaattcctgggtgcaagtcatctgcctgctgaggcctcccaaagtgttgggattacaggtgtaagccatggcgcctggccctcgtgagcttttgagagaggcccgctcgctgttccttgttaacttgtccttcaggcctgttgtccattgtcccgagggtgagctggtgtttgcctggtttggttggtcagtggcgaggttgagctcacatttgtagcaggtgtgtctacagggacacactcctgtggatgcagggagatctggccacaggtgcacacacctgagctccgatcattgctgcgtgtcctgcaggggacagtgtgggctgcttggcttgcgcttgagactcccctccccacacccaagttcaaatctggcgttgccttttccatccgtgcctccctagcacccttgtgcaccatgcatttccccctccccacgcttgcttctgccttcccttccacctggaatgcgcttcccgggcatccttcacctggctcctgtgaagaggcctcttccttcttttggtctctcctgtcagaatcagcggctcctgcctcaccccttctctggcgcagagcttgtccctcatcacagggcctggggctttttacagaatggaggaagggatcctctctgtctggttatcttgtcatcgccacgggggtgccctgcagaccacagctctgtgcagacctccggcctggcaggacctgccaatatactgtccttgtctgatgtcccctccctgcccctcttctaggtgcccccttgtttctctcccatcctcacttcctcaacgccgacccggttctggcagaagcggtgactggcctgcaccctaaccaggaggcacactccttgttcctggacatccacccggtgagcccctgccatcctctgtggggggtgggtgattcctggttggagcacacctggctgcctcctctctccccaggcagagagctgctgtgggctggggtggtgggaagcctggcttctagaatctcgagccaccaaagttccttacttcaccccgactccatagttcaaggtagttcaagggttttatgatccctgtactggtttctataaatgggctctaagacagtaaattaattagaacttatcagctgggatgtctcctacatgtgagctggaggcagccctctggatgtgtcaagataccataaagatctttaggtaccaagaagagcctggggtattttgcagataaatcacacagggaatttgtcccgtgtgaagttctgtctacaagcagggagctggacatgtggccctcccaaggacactccttcagcttgtggcctcttctcttggcacctccgttctctgtaaaatatgcccagttggtcttggtggctgctaccattgattcagaaatctgtggttttctgtttcctgggtgggcacttgtggtctatcccatgggcctttaacaaaattattattatttttgagacagggtctcactcggttgcccaggctggggtgcagtggcatgatcatggctcactgcagcttcgacctccctgggttcaggtgatcctcccacctcagcctccctaagtagccaggactacagacatgtaccaccatgcctggctaatttttatattttttgtagagacgcggttttgccatgttgcccagtctggtctcgaactcttgggctcaagcgatcctcctgtcttggcctcccaaagtaccgggattacaggcatgaaccgccgtgcccagccaaaattaattctctaaattgaaaaagaaaagctgtctatttttgagtgtacaacatgatgttatgatgtatgtatataacttgtggaatacctaaatcaagccaattaacatatgcattacctcacatactgatgatgtattggtgctgagaacatttaaaatctactgtcagcaactttcaagcttacaatacattgctattcactctagtcactgtgttgtattgtatagtacaatacagtgactgttgctctatttcccagtaggtctcctaaacttactccccctgtctaactgaaattttgtatcctttgacggacttccccatccctgcccctggtagccagtattctaccctctgcttccatgaattcaacttttttttttttttttttctgagatggagtttcactctggttacccaggctggagtgcagtggcacgatctcggctcactgcaacctccgcctcccgggttcaagcaattctccctgcctcagcctctcaagtagctgggattacaggcacacaccaccacacccggctaatttttgtatttttagtagacacagggttttgccacgttggccacgctggtctcgaactcgtgacctcaggtgatccacccgcctcggactcccaggttgctgggattataggcgtgagccactacgcctggcctgaattcaactcttttagattccacatacaggtgaggtcatgcagggtttgctttcctgtgcctggcctattttacttcgcatagtgtccccaggtccgtcatgttgtcacaaataacaggatttccctgtttttatttatttattttttgagacagagtcttgctgcgtcacccaggctggagtgcagtggcatgatcgtggctccctgcaacctctgcctcccgggttcaagcaattctcctgcctcggcctccagagtagctgggattaaaggcacacaccaccacacctggctaatttttgtatttttagtggagacgggatttcaccatcctgaccaagctggtctggaactcctggcctcaagtgatccgtccacctcggcctcccaaagtgctgggattccaggcgtgagccgccgcgcccagctggatttccctctttttaaacgctgaacagtatcccactgtgtgtgcaccacgtttctgctgcccattcattcactgacggacacttcgcttgattccgtatcttggccacagcgtacatgggagtgcccctgtccctttgacacactgatttcatttcctctggggggatgcccggcagtgggatcactgatccgatggtagttctggttttcgttgtctgaggaagctccacacgtttgccacaatgctgtgcaccttaggcccttcccgaagctccatggcggatgctgttctgcaccatttttctttgtcctcccaggcctccttagccgctgactaggccctctcggccccggccccagccctggtctctgccttccctcttttagttaattcctcctccagcctctcttgctctgctggcttccggagaattccaccatgaacacagtctcctgtgcgctctcagtgatcgctttcctttcagggcacggattttctttcttcccctcacatcaagaaagaaggggttaagtttgggagcccagagagaggcaaacagctgttttgccgcagccactttagctgctgcgtccaattctacctccagatgagcttgaggccgacggggagaggaagtggcctttatttctttgttttttgagctgggcacgttggggagggggatcaggagatcagcttgctgcctgttggcctttagccttgaaaaacgaacgtgtgttggaagctgcttccgtgtggccacttttctgctcctgaaactgggggagggcatggggacgggggactcaacaggacgctgcttatggtggtatcacagctaagacttattgtaatgacagaattcaaagcaaaattagcaaagggaaaaagcaccttgggtgaagtcgggggaggccaggctggagcttccagagtcctcttccagggggttcctacaggatgcacttaatgtctttagcaatgagttgtgacaacatgtaggagatgttgtctagcagggaagctcattagaaattcagtgcccatggtgttttgctaggggccagtcatgtgggcacctctgcctggcaggtaccaaaattctaggctctgggaaggaaagcaggtgctgagcaagaaccatattgtttgtacaaataatttcggcccagtgaactactctcatcagttaggggatggtggggaccctcctgaaatctgggttcccagatgccagcagaattcctaaggagagcagcttcaggcctgtggcgtgaactctgttctactcacgggtgatctcatgcccatcccaccaggctctcgagggcaagcactccccagtcgtgggcgtaagtgaggcctttaatgagctcttctttgccacaggggcctggaaggtcctcagcatgctgggccataatgaagaaaacatcctttccctatagtgtacgtgataataacctaggcatttatggccctgcgtgtggctatcttgcataccttacttttgctcttgcaaaaattctgtcaggtcgggagagttctctctgttttacagatgaggacgcgactctcagttaagaagaaccaactgcagttctctgacctcaaatctagttttatttccactatcatttcctgacttcattctggaaccaccttcctgttgtttttgatgacacatgtgtgtcacttcggttatttacttaaaaaaaaaagtctcgttaaaaagagctgggtatagtggctcatggctgtaattccactgctttgggaggctgaggcaggaagatcacttgaggctaggagtttgacgccagcctgggcaacatagtgaaactctgtctctacaaaaataataatgataaataggctgggtgtggtggctcacgcctgtaatcccactttgggaggccaaggtgggcagttcgcttgctgccaggagtttgagaccagcctggtcaacatggtgaaaccctgtctttactaaaaatacaaaaattagccgagtgtgctggcgcacacctgtagtcccagctactggggaggctgaggcaggacaatcgcttgaactcaggaggcagaggttgcctgcactccagcctagatgactgagtaagactctgtctcaaaaagaaataaaaataaatttctgcacaaaggaagctttttcttactacctcaaataggaaattacaaaattctccaaaaaaagaagacaaccataaaaatgaacaaggaaaaaaatattaggctctatgtaaaatattgttgtctgtcagcaggagtgaacctggggccagctgtcagcaccattgttagaagtggagattttgtgtaggtgtattagaggggtattaaagaccatgcaaacacctggctgagacctactcttcaaaatgatcaggaggagttgggagtgaattgagaagggacttttgtctgttttattgaatgtggaggttgagagggagcatggacaaattgccattctgcactttgggaaacgctgtcttaggaggacaggtgaaagtgattaggtattttccaccctgagacagccttgctttatagaaggaacctctttgaggctgtgaacataactgtgtgggaagcacttgtttccctataaggggttagaatcaggagaggagatcccagtgcacctgcccagcatttctagaactgttgaccccccccagcctgtggcttgttttaggtaagatacaagcaagctccactgggcagttagctgggacgcccaccctcttgactgggaccagggagaggagggttgacggtgtccctggagcttgggggtggccagtctcctcactgtgtttgttgccgcaggtcacgggaatccccatgaactgctctgtgaaactgcagctgagcctctacatgaaatctgtcgcaggcattgggtgagtggggactgggagctggggctgcattgctcattgagagattaggtgctcagtgctccagtggtcccagactccagtgacataccccaggaaccagggcatggggaggggagagggtcctattgggggtggaatccagtccctgctgatcttctccctgaggggtcttggttttgagccaggtcctgacctgcatcctgatattccttccccagaacaccacttttctttctcttttttgttttgttttgttttgtttttgagatggagtctcgctcttgttgcccaggctggagtgcaagggcgggatattggctcaccacaacctccgcctcccaggttcaagcgattctcctgactcagcctcctgagtagctgggattacaggcatgtgccaccacgcccggctaatttggtatttttagtagagatggggtttcaccatgttggtcaggctggtctcaaactcctggcctcaagtgatccacccacctgggcctcccagcatgctgggattgcaggcgtgagccaccgtgcccggccttcacttttcttttttaacattcaccccctccctgccaattagccagagcttcaatccaagctgtttcctacacgacagagtggcagaaatgaaagcctggcaaaaccaaatgtttgaaaatggaaacgctgaggcaggagaatggcgtgaacccgggaggcggagcttgcagtgagccgagatcgcgccactgcactccagcctgggcgacagagcaagactccgtctcaaaaaaaaaaaaaaaaaagaatttttcaagcactgatttcctctttttgatttttaaaataaaacagctttatgcaaatataatgcatgtaccataaaactcacccctttaaaatgcacaattcaaaataaaaaaaataacccccctaataaaatgcacaattcagtgatttgcagtatattcacagaattgtgtatctatcaccacaatcaattttggaacattttcatcatccccaaaagaaaccccacactcattaacactcacttccctgtcccctcagccccaggcaaccgttcatccacttcctgtctctgcggacttacctattctgggcatttcatataaatggaatcatacactatgtggtcttttgcgactggcttctttcatttaggatcacgttttcaaggttcatccatgtcgtagcatggatcagtatattttatggctggataatattccattgtctggatagaccacatttatttatcggttgatggacgtttgagttgtttccacgcctgggccgttatgcataatgcagctgtaaatgttcttgtgtcagtcccagtgtggacatctgttctcgttttccttaggtatgtaccgaggggtggaatcgctgggtcctatgttaactctttgtttaaccgtttgaggaacagtcagacttgcacagcctctgccccccatccccattctttttttttttttttttttttttgagacggagtctcgctctgtcgcccaggctggagtgcagtggcgcgatctcggctcactgcaagctccgcctcctgggttcacgccattctcctgcctcagcctcccaagtagctgggactacaggcgcccgccaccgtgcccggctaattttttgtatttttagtagatacagggtttcaccatgttagccaggttggtctcgatctcctgacctcgtgatccgcccgcctcgggctcccaaagtgctgggattacaggcgtgagccaccgcgcccggccccatccccattcttagcagcagtgcagcagggttccagttcctccccacgcgcaccagcacttgctataacattacacgttgctagaacttggtgagggattatactgatttgttgctatgtcagtgtctgtacttcttagcatatctgaaatagtttcgttaaaaaaaattctcttagaaaaatccctgggttgcaggaatgtgagcatctattcagctttgtcaaatgcctctcggctggaaagaataacactttgtcagagcacggcagcgagtaataactgtgagctctcttccttcatcccgcccttgcattttatttttatattttgaggccacttagggaatttgttcttgatggatttgtgggtggggaaacagccccaggcatggaagaggcgtttgcagcccaagtcctccctctggttccaccgcgtggcacctgggctgctaactgggatgcaactggggccaagtgggtgacccagatagaagaggcgacctggggccgaggatacagccccttcccagcaccagctgactgtagccccatggaaatgcgggctcagtgtggccacatcctctgcatttttcaaaaggacttccaaatctgaattttaacaggagctctgtcaatttttacttattgggaggtaattcacattctttttttttttttttttttttttttgagacgaagtcttgccgtgtcacccaggccagagtgcagtggcatgatctcagctcactgcaacctctgcctcccgggttccagcgattctcctgcctcagcctctcaagtagctgggattacaggcgctcgccagtacacccagctaatttttgtatttttagtggagacaggatttcaccatgttggccaggctgttctcgaacttgtgacctcaggtgatccgcctcccagagtgctgggattataggcatgagccctgcgctgggcctaattcacattcttaacaaacagttcacgcgggcagctggattgtgcctgccagtgacctgtggaccggtcacccaacctctctgggccgcacagctgctgacctccctgtggactgggaacaaggcactccaggaaagtggtctcaacagcagatgtggagggccacgagggatggccgtgggaaaagtctagagacacagctgccgggaagcagagctgtctcgtgacctgtcggggaagcttctgtgctccttgctcgctaggtaaaggcagtggggttgcatgttacttgaatacaattcccattggttcttacaaagtctttcagagaaaagcagccaaagtaaatggtaccgtctgttgtctccccatcgtgtttcgtcctctgtagggtgatagtgtgagcccatttcactgtgcaataccctacttaacaaggggcctgagagacctccaataattgtgattgggggatttcagcctttttttttttttaagatggatcttgctcttgtcgcccaggctggagtacaatggcgcgatttcggctcactgcaacctccgcctcgggttcaagcgattctcctgcctcagcctcccgcgtagctgggattacaggtgcccgccaccacgcccagcaaatttttgtatttttagtagagacggggtttcactgtgttggccaggctggtctcaaactcctgacctcaggtgatcacctgcctcagcctcccaaagtgctgggattacaggcgtgagccaccgcgcccggtctctgattgtggtatttgagccttttgtgctgactttcgtcaccgcccctcagtgacttccatctcccctccctactgctgtgcatggcaaagtgacagaatatttgtgtgtccatttctttgctgggatttaacaattataacaacaacaataataaatgtgccaagcacttttatatgccgggtaattttcgaagcactttacatgtattactgcattgaatcctccctagagtcctaggaagagttacgttataatatctcgcttatacagaagggacacaggctcagtagcacgcccaaggtcacagagctcgtaagtggctgtgtcaggggtcccaaggccaccgcaggctcgacgatttgctgggaagcctcaggacgaagcatatggttgtacacgtggctatgatttattacggtaaaaggattcaaagcaaatcagcaaagggaaaagccacacggggccaagtccagaggaaagcaggtgccagtttccagagccctctcccaggggagtcacccaattcttgctgcaaggagttgtgacaacccacgtgacatgtcatctggcagggaagcccgctagagagactgagtgcccagggtttttactaggggctggtcatgtggccaccctctgcctggcaggtactgaaattccagacccttagaaggcaagctggtggtcagtataaaccacattacttgtacagattgctcaggcacagtgagccatccttgtcagttagggagcaatgggaggcctcccgaatccaggctcccagacgccagctccgggccagcattgccagcagcctgtgtggggtggaagggctcgggcctgccacgtgagcacgtgcctgcacagcggcccaggtgggattcaaatccaggcagcgacgcttgagtgtgcactattaaccacctcgccacactgccttttctgctagacacctgttgtgggggggtctgtgtggggcaagtggtgagccagcccaccctgctgctccatactgagtgtgagttgctgtattcatttccttttgctgctgtcacaattttgccacaaatgtcatggctcacttttaaaaactatcttgcagtgttgggagtctgaagtctgaaaggaacacaacaaggctaagatcaaggtatctgcaggccttgttccttccagaggctccaggggagaacctgtgccttgccgtttacagcttctagaagctgcctactttccttagctcatgaccttaatcctagccctccctgttttgttgttgttgttgttgttgttgagacacagtctcgctctgctatctagactggagtacagtggcatgatctatagttcactgcagccttggcctcctgggcttaggcgatcctcccacctgagcctcctgagtagctgggactacaggcatgtgccaccataccctgctaatttttgtgttttttttgtagagacaggggtctcactatgttgcccaggctggtcttgaactccagggtgcaagtgatcctcccacctcagcctcccaaagtgctgggattacaggcgtgaaccactgcacttggcctctccctctttaaagccagcagtgtagcactgtccaatttctctctgcctctaacctcctgcttccctctttttttttttttttttttttttgagacggagtctcactctgtcgccaggctggagtgcaatggcatgatctccgctcactgcaacctctgactccctggttcaagtgattctcctgcctcagcctcccgagtagctgggattacaggcatgtgccaccacgtccggccaatttttatatttttagtagagatggggtttcaccatgttgcccaggatggtctcaatctcctgaccttgtgatccacctgcctcggcctcccaaagtgctgggattacaggcgtgagccaccacgccccagcccctctttttaaaaattaatttttctttttttagggttttaaaatttgtttttgttttttcgtttttctttctcttgcctgattgctctggctaggacttcccgcttctctctttaaggacttttgtgattctctggggcctacctaggtattccaggatactcttcccatctcagaaccttgatgtaaccatatctgcatggacccacctagatattccaggacgctctccccatctgagagccttgatgcagtcatgtctgcacggtccccttcgtcgtggcaggtcacagtttcccaggtgtcgcattggtcttccggtctccttaggcaccttttggctgtgacagtctctcatctctccttcattttgatgacagtgacacttttgagaagcactggtcaggtattttgtaggatgaccctctactgggattggtctggtgcttttctcatgattagactggggtgatgggttttgggaggaggaccgcagagagaaagttccagtttcagagcatcttgggtacattccgtcaacatactgtatcactgttgatgtcgaccttgatagcctggatgaggtcatgcctgtgacgtttctgcagtatcaagtttacttttattctccctttggattttattatctttttaacttgacgtgtaagttttaacttcacaggtaataagaacatatcttcctgaggggaagaatatggtttcctgtgactccccgccatccccagccgtacccaccatcatcaatttgctgtgcttccttccaggccttttcctacttatttacattcatatatatgtggccatagagaagatacatattgtcgtttgtctgtttgtctttgctagtccaagcaacactgaacatctttgtgcctctgtgtgcatgtgtgagcatctctagggcagtttctgaagagcgtaattgctgggtcgtgaggtatattggtggaattaggtttggcagtatagatcagtaaactcaacagttgtggctcaaatgggacaaaggtatattgttattttaaaaatcttcttttagaggatgtctggaggcagacagtccaagtatggcaagagacattcatagtccaagttccactcatctttctgttccattttcccaacacatggcttccatcctcaaggtcacctctggtcccagtgtctgcagagctccagcccttgcatctgcgtttcaggcatctgaaagggaggagggaaaaaaggttcacctcccagctgtgaaagcttctttttaagcagccctcccggccatcccacgtaacgcttctgcgaacatctcattaaccagaacttggtcacagagcctcacttgccacaagagaggctgaagtggagtctttaactgggtgcattgccatcctgagtaaaatttgggtcctgtttctaaaagggaccaatggattttggctgggtcactggtggtctctgccctgtaggagatgtgagtttttagtttaaaaagattattatcaagttgtcaagctctttgccaggggagattccttctggcagcacatcgaaacactggttccctcagcccatgccaatcaagtaccatggaccccttatccctgggggtatattccaagacccccagtggatgcctgaagctggggatagtactgaaccctgtatagcatatactatgcttcttcctatacacacacatctatgataaagttaatttataaattaggcatagccacaattaacaataactaagaatagggtaattataacaaatactataataaaagttatgtgaacatggtctctccctcaaaatatcttattgtactgtactgagggtaagaaatggcagaaatcaaaaccatggataaggagggatgactgagattgcagaatcaaatccctcctggcctcagagcttatgatcacaggttcaaagctgtgtgatgtcaaacagccctgtgggaaaacatctcaccttgtcaactaaagaaaaaaaaaaacaaaacgccttttaaagatttaaagttagtcttatttacaagtattattgagggctgtagactgagaccttcagcctggggacagttttgtcatatggctcctaaagtgtttcagctcattgtttatatttggtggtgagggtttagtgtgtgcaaaattatactaaacctgtttagatgttgtattcaagcagaattagatcaagtttgggtgtaagactttgtttcacacagctatgtcttgcttatttccagacaaactgggaagattgagcctgtggtcctgccgctgctctggtttgcagaggtaagggtgcgttgggcacagcgtcgggggcttttgttaagagccaatgtgggcatttgaggcaggaggcggggggagcagcttgtagaaagggagagggctgagccagggtaaccggactgtgacatggaccagcgtatcagaaacttcaccctgtccaagcaccctatgtcagttatcccaccaaggtgaaagggatccctagagatggggaagacagaagctgcatgaagaggtaaagtccctggccctgggtgtaaaataattttgttggggcatatgacctcttctcctgaaagtggggaagttggtttccaaggtgtcagcttttctcttaaacttacttctctcgcagcttttcagaattccttctggcctagcttgttttattttattattttattttattttatttactgtatttattgtttcttgcccacctcgttttaaatcagggctagctaatggccaggacaaacaagcctccgaatgtcaagtttacttcctactcacagccgaatctgaagtgggttgatggggaggcagagctctgctccctgcagtcatttagggttccagggccccggtggccccgccatcctggagagcctccattcagtggcagggaacgagatggagagtcacgtgaggccaggtccacctcccattggtcaggacacgatcatatggccctgcccaactgcaagggagtcggggaattgtagtctcaccttgtgtcctggagggaggaggtccctggcaggctccaacacatgctttagccgggaagcttgaggtggggaaaagctgaggcgggcacagaggaaggtgttgggtggcatctgcgctgtagcccgcagcgtgcggccccagctcatgtgtttgtcattctgtctcctcagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttgcctgctgggggaaaggggcctcagatcggaccctctggccaaccgcagcctggagcccacctccagcagcagtcctgcgtctctgccggagtgggagcggtcactgctgggggctgcgcagcacgcttgcgtcttttgcatgccgcgttgccactactctgcctgttctggaaggcctgggaccctcccttggagggggcacaggtgggctttgagtaatgagacctggtacttgcatcatccattcatcaagtcagcacccggggatgccaggttctgttaggggcgaggggacgtacagcagtagaggagacagctgagatccctgctcagggggattgaggggggctggcatcccagccggggagacagatgaaaaccaagtaaatcagcagaaaagataatttcactcatgataggagctgtgaggggttagagccaaatagaaatacagcgtgagccacgtgtgaggttttcagtttaaattttctaatagccacttaacagtcaaaggaaacaggtggaattaattttaatcttatttaacccaaatatatgcaaagtattatcacttcaacatgtaatcagtataaacggcatcaatatttttgcagtgtttttgcatgaagtctttgaaatcctgtgtgtacgatacatgtgcagcaggtctcattttggactggccccgtttcaagggctcaccaactgaatgcagcttccagactggagagtgcatgtctggagcaagtggggacaaggacagatggagcttcaggaaggcctctctgaagaggtagatagtgagctttgacatggaggccagggaggcactcagcacacagccacatgaggaatgctgcctggagcggccactgcaaaggccctgtggcagggacaggcaaggcacattggacggtcaggtagggccagggtggctggaggggagtgagggcagggacagaggtaggaggtggtgtctgagagtggacagggcgggccacccagggcctcgtggtgcacagtgagcagtttggaactgattctgggagtgacagagccattggaggcttttaaagaggggaatcactaggtcagctgctggctggggaatgggccccgggctgggaggggtggaagcctgggcccagcggggaggccccagtgcgtgaggaagtcgatggcttgaacaggatggggcagctgctatcaggagggaacggaagtggggaagagctccagccctgggcttcagacctccagaagcagcaggaagaggggtgataacagtgtccctccttgcttcggggtcatttatttattcattcatgcattcactgcaaggccctttgcacaggtcaggagatgcagaaatgaccagaacatgagatctgcagcaaagatgggcaaggcaggcctttaggcaagttactacagtcacacgaaggacaggagagctgtgatcacagagctcaaggggcagtggagatgggcgagtggctgccatggcaggggaagggatgctgcccactggcaggtcatcaggaaaggctgtttttggatgcatggaccagaaagccactctctgaggtggcccccacctgcatcatcctagggccacaggccgaggccttctgaggggccttggggctgccccgctgctctgctggtcttggctcctctgcagcacctgcttcctttagcactggtgaatgattcttcctcttcccctgtctcagggaaggcttgcctgcttccatgcttgcatgctgggtgacaataaagcattcctggttcttcaccttggctttcagacctgaaacccgacttcctttcaaaattcctgtcctcggggggaaaaggtttccacaatgtgagatggtagcctggacaccagctgtcatcatgttgctgctctagcgtttgagctcccgatgaacaatgaccattgggtccaaccagcccttttgggagcccccttctctgttactgccccagggggagccagaacccagcagggctgtgactccagcgagcaaaatggaactccctccagtttctagactgaattatgtagggaggacagaaggactcagaacccacactcccagaccatgaataccttcccgtggcagagcatcaccataggtgtccacaagtgacgacgcacagccacatgagggggtccctggggactggctgagggactgggccagaggaggccatgacagcctcatccctctgtctccttctgtctgtctccaaattgtccaccagaatggggacagggaaggagggtcaggaagcacagaaggtctaggctgtggctagggtccctttccctgccgcagcccccaaatcagcatcccaccctcaaatccagtaagaatgctacgatcggcagtgtggctccctccctgcaggtttcattggaggccacgtaagtgaaatttatcccattatgtgtgttttgatgtagcaggaccttaccagttttttttgtttttttatttttattttttttggtttcttttttgagatggagtcttgctgtgttgcccaggctggagtgcagtggcacaatcttggctcactgcaacctccacctcccgggttcaagcgggagcctcagcctcagcctcagcctcagcctcccgagcagctgggattacaggcacctgccaccatgcctggctaatttttgtatattgagtagaggcggggtttcaccatgttggccaggctggtcttgaactcctgacctcatgatctgccgccttggcctcccaaagttctgggattacaggtgtgagccactgtgcctggccggccttatcagtttttatgtaatttgtcctgatttaaaaaaaaaaaatcacatgcgggtaaactcaacatattttaatttctctttagagaaattttccacttgagccaggtatggtggctcttgcctgtaatctgagctactcgggaggttgaggtgggaggatcacttgagcccaggagttggaggctgcagtgagccatgatcgcaccattgcactccagcctggacaacagagtgagatcctgtctcaaaaattaaaaaaagcagtaattttttcttctcaagtcattcttttaaaataaatcaaaagtattttaacagaacaatctgttcctcgttgattttaaacagccccccagctaagtccactggttgtcggtctccatggcccatctccccaccttgcttcctcgctggcttaaattttcaagtggacgagcccttttcagcttggcttgtccacctcccaggtgtgtttcctgaagatgcttgtacttatgtctaagagcggcagctccccacatctcagccacctgcaatcgttgagggttgttggactctaaacttatgtgcctttcctgtttcctctttgccttttgcaaattgaagaaccgtgtaaaaccatttttatgtggcttcaacgtcaactataaattagcttggttatcttctaggagaaatgctatttattttggagtagtagtaaaaagggctcaaaggataaggaggccattcaggcctattctgaatccctgatgacatcagctcccaagggctctgtgctgcaggaagcaaaactgtaggtgggtaccaggtaatgccgtgcgcctccccgccccctcccatatcaagtagaatgctggcggcttaaaacatttggggtcctgctcattccttcagcctcaacttcacctggagtgtctacagactgaagatgcatatttgtgtattttgcttttggagaaactgcccttcctatgttctgagtgaatagcagtttttttgatcccagagggcaacttgtattctgtgggctggtgcctatttgcaaggtcacattagaaagacaggagcaaggcttaggcctgctgcttctggaatctcttgtgcaatagactcccctggggaagtctgctagaaatgcagatccctgggcagccttctagccttctggaataggatcatggtgggaccctggaatctgtattttaatggaccctaatgagattctgatgtagaaacatgtttgagaggcattgatctaaatctgggatgactggccaggtgcggtggctcacacctgtaatccagcactttgggaggccgaagcaggtggatcatttgaggtcaggagttcaagaccagcctggccaacatggtgaaaacctgtctctactaaaaatacaaaaaaaatgagctgggtgtggtggcacacgcttgtaatcccagctactcaggaggctgaggcaggagaatcgcttgaacccgggagatggaggttgcagtgagccaagatcgtgccactgcactccagcctgggtgacagagtgagactccgtctcaaaaaaataaaactaaaataaataaataaataaatacatctgggatgactgaccaagaacaaagaatgtaggcatcaactgaacaccaactgtatacctgggactggatctgagggtaggattgccagattgagcacaaacaaacaaacgaaacacaagaaacaacagaagggtgcctgttaaatatgaatttctggtaagcaataagtaatttttattgtgttcctgtgcaatgataggacgcacgtatcctgaaaacctgtctgtagttcacctgaaattcacatttaactaggcgttctgattttatgtggccgccctatctgctgggaacataggctgatgcccctgggggttctgcgtttccttggccaggttcctgtagggctgaggtcatgggggagccgtggccagggatggtgtccttgccaggggaggtgacgggcagagctgcaggccctacaacttggggttgggcagggatgagtcgctctacggtggtgcctctgataatagctgttattttagtttctgaaaaatgtgctgccctcaagagcttctgaggctaggcctacttgggtgaaaatagctttccagggagccacattgtggggacgtgaggcagcagccccactctttggggccacttggctgtctctaactcatctcacttgccagggctggacaaggagatgaaaaagaaaatgccaaggggtgggcaggcaggagcctgttggcgttggcaggcgctgccagccctgtgtcccagtcaagctctggggcgcccttcctgtccatctgggagtagggggtggagtctgaccatgttggggcggagtgttaatattaggagaggatcctccctgggacagggtccccaggcttgggggcaaggccttctgcctggacccccttcctttcctctctcccaggattcctccaggacaccgtagtgctgtgcacggtttggccccatcggtgtgcctgctccttccagccactgctcccttctgcagaaacttgcctgggattcccagggtgcaggggtgggggctggtcaggggctggtcagggcctggtcagtgtagagcagggagcttttcacttttagcatagatagagtggccagggccccatggctgcacctccctggacataaccaggatgtcctgtcatctgccccccaaacaaaactggggtctcccctttattttgccaacagaatccaatttttaggtgatgagacaagtgtttgacttgaaaagaccctcctgccctgcctcctggaaggtctggagcccagcccagcgccccggatcccctaggcatgtgaaacggggaatgcagtgtcctccagtggctggctgcagcttggggtgggcacctgggtggtggctggtggtccccctgcaggccactgctgccccctcttgggtcctgttctgagtctcaggcctgagtccctggggaaggccccacacctttgccctgtacctgggtatggggatggccctgaggggctgccttgcttgggagaaggggggaaaacagatatttttatataaataagaaaaagacagcccctctgggcagatgaggcctgctgtagggcagggggcttggtaaactgtgtgtccactggtctgtaacccttcagctgggtccttttgtgcagtgaacagcctggacaactgtccaggtggcccttcagggatatgttcctggacctttcttagcttctcaccgatctttcttccacgccaagtccatgttcctcagtcaaacaagtggcaaagaggaggaggaggaggggaaggaggaggaacctgcttcaccctctggcacctgcgggttttgttccacgtgtcttccttgggaaagacaaggggttcttttacagcctaggggtggtttcccctttctacttctgagtgagaccttctcaagtcacggctctttgggcccacatggctaaggtctagccacctgtgggtgtcctgtgctgcctcagtgggtggtgtgggggcggggctgacctcccccgcgcctggctcagtgcagcagaccctggcccctgtgcccgctctctgccctgagcaggagtttgattttcctaccccgtggtgaagcaagcacaggtgggcggaggtgggcagcggtttccagccccagccaccggggcagggaggcctctgttgctcagggcaagggaggcagggggcttagtgggacgaaggctcaccccacactcttatcattagcattatctgtatttttaatttttaagttgagaaattttctacaactgtcaaactagacaaatgacagtatccagttcccctcacccagacgcagccattgctgacagctgtcagtgttgaagatggccagcatctcatgcccttggtttcactcgttccctgggtggccctcgtccccctccccacgtcccgcgccccgcataccctgagcagccatggccaggaacttggcacgtgggtttgttttttctgaatctgcatgtgcgcagccatgagcatgaggtcactttttgaatgtgaccgaagctgcatcctgctgcgtgtattgctgtgtggctggctttcctccctgtcttctgttcaggaatactgttcaggctgaataccgtcctgtgacatgggtttaaaaacacaggccaggcatggtgtctcacgcctggaatcccagcgctttgggaggctgaggtgagaggatcgcctgagcccaggagttcgagaccagcctgggcaacatagacctgatctctacaaaaaattaaaaaatgagccgggcgtggtggtggcacgtgtcattgtcccggccacttgggaggccgaggtgggaggatcacttgagcccaggagttcaaggccgtggtgagccatgatggcaccaccgtactccagcctgggcgacagagagagaccgtctctaaaaaataaaaaataaatcaacacataaacatacgttctcctcctgagggacagagcttgccccggttgttccatgttgactgtgctgcacacaggccgccccccttgctctgcccctcactgtattaagtctctttgggcctcagtttctccatctctaaaggaggtcggggaggccaggcgggtgttgagtgagatgaagaggcccttggagtcattccaggagtctataggtgactccagtctcttctcacttctgacagcctggtggcgggggtggagtctctgctggggatgtgggtacagggctggggtgggcggggatgagggtggggtttggtgacagggcgtgggtggtcacccagctttgcctttctccacagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggatgcctgcctctgtgacagccttgtttgctgaggtcgtgggggtgggggcctctgggaagttccgggctcctcttctcttggtcaatagctcctttctggtggctgccaagagcgtctctcccagggccgggctgctggcttaccttcctgttgttttcaaatttcaaccttgtgcaatgttgagtttcatagaaatactgcatgagtacgcccttgtttagaagcagcagggtctgagtcccatcccacagcccccagtgcagacgcttttgccacttttgcatggggccccctggatgtgtttctgtgcatttatctacaaatcctggtgcccgtaggacatgccccgtgttgttctagacctttgctttctgcttgttacataaatggtgaagaagagaagcgggtaagagaacagattggagccatctaaaagttctcatcttaagtgtagatcattgcaaaggatggaattttctccgattgtcatcatcgttgatgtttgaatatgagaccatttcatcagtatttaagtgtgcccgctgggatctaactaggagaggagagggtattcactgccaaacatttcaaagaatatacgaacaagctcttttatggtcagaaatgttagcccttttccccccttaaacttgtatttcctttcttcttccctcctaaaattttatctaaatgatatttatatttgatgcttttaagccttttattaatcactcttatacttgcctgcaacataaatatataagttgaagcaaactttttttttttatttcttgtgaccatcaagggtaaatttttttaggtctggggctgccataacaaaataccatcaaggccgggcgtggtggcacacgcctgtaatcccagccctgtgggaggccaagaccggaggattgcttgatgccaggagttcaagactagtctgggtaatatggtgagaccctcatctctacaaaaaaaatacaaaaattagccaggcgtggtggtgggcgcctgtggtcccaactactcaggaggctgaggtaggattgctggaagccaagaggttgaggctgcagtgagctgtgatcatgccactgcactccagcctgcgagacagagtgagacactgtctcaaaaagaaaaaataccatcaataggtggcttaaaccatttatttctcacagctctggaggctggaagtctgagaccagggttccagcagggttgggttctggtgaggcgtctcttcctggcttcagacggccgccttctctgtgtcctcacatggcctttcctcggtgtgaaagggggaagagagagggagagcgagagctctgtggtgtctcttataaggacactgatgctatcagatcagggcctcatttaattattttcttagaggccccatctccagacacagccacactggaggttagggcttcaacaggaattttgggtcaacacaaacatttagcctataccatctggattgcctttcaagtctcaggacacaattggtcaaaactatatcactatgttttatgtgacatatcaaagtagcaaaattttattggaatgcatgtccttttggtatgcattttatatatctttttcatttacagattagagttgtgtgtgagtgtgtgtacaattccatgaattttgacatgtttatagagttgagtcattacccctacaatcaagacaaaacaatttcatcatcccccaagatttcctcatgtcttccctttgtttttgtttgttttacagtgggctcccataatttttttttttttttttttgagacagagtctcgctctgttgcccaggctagagtgcagtggttcaatcttgactcactgcagccttcacctcccaggctcaggagagcctcctgacttagccttctgagtagctgggaccacagatgtgtgccaccacacctggctaattttttttttgtagagatgggggtctggctctgttgcc

SEQ ID NO: 14039 - DNA, 25321 bp, Human; identical to SEQ ID NO: 12355

SEQ ID NO: 14040 - DNA, 6374 bp, Human
ctttgtgctcattgcagtgtttctggaactctgctcagcatttcaccttttggtcataacatcgttcatgaagtgcttctgcaatcacctgttaccctgcctttctttttatatcaatatccactacttcacaggtcattgcaagcttctttccttcagcctgaccttaaatcctactattcctgagcgatccaacctggtctttctctgctcattcctcaccatcccatgaggcatcatcatcagcttttatggcttcaatcagcaccactgtgcagaggactccagttcagctccaactcaggcatctcagcccagaggatgctgcctactcgtctgcagttgagaaatcccttcttcaatgctcctttactggcacctggaaatctacattttgcaagcagagcttttcatatttatttcctttatctaaatctatttgttctgatgtttttcttctttgagtggttagaaccatgacacacacatacacctaagccagaaacatcaacattctttttcatttttgcctctttcattctgggagaatccatgcaagcattaagtccagcagagtctaagtggttttaaatctcttggagctgtcaacttttgtccttccctaaagagacaacagagttgactagtaaagaacacaggctccgggtagagttgcctaaatgttcacagggattgcttcagctgacgccaccttctgaaccatggtacggttttcatgtcctcatgtgcaaagtatgggtgataatagtagtacctataacctagggtcatggtgaagatttaatgggctgatttatgcagagcatagcggggtgtgtagcatgaaacgagccagtcttccataagtactgcttattatcagccctaaggccatgctttctgccaacagacaacattgcttggtacaagagcttttaactagtctccctgactcaagcctgttcctttttaacctttccttgtaattcagccagatggaatctcccaggaacaaaactgaaaatattcctctcttatcagaatccctcagaatcacctcatgaccttccgatttgcccttttacggacgataaacccttccattttctgagccagaggcttcttcctttgtggagtcagcctcatcgctcgactaggaacataaccagctatctacctttctcagaaagcacttgggtttgctcttataacaggcactttttctaggttcttcccaccattgcacatggacacacaaaaattacactgacccctggcaccccaaagacaaacagcagaaagcactcccaggcaaaatgagctcaggacctttctgttgcctgggcccacaactaaggttcagggccttctctaaaaagaagccgcagccgaagacagaggaactgcccagagtggggctgggggtgtggagtctacgctgatactttcaggctgtttccactcttgctggttctgatgctcctttcttttgccacaagcaaccctagtggaaaactgggaaatgtccaacaatgaagttaggacagtggcccataaaacatcggattccaacctgtgtcctaaggtgtaaagacacagagtaaaggcaaagatacagtgagcctttaacacgttctcctttgttcttcctatttctctattccttctccatttccgatggtgttctctaccctctctccaacccacgtgccaacagcccctcttttctcttttattctcgcccacgtttccctcctttcttccacctgcgcccaacggtacggcccggaaaacgaactggatgcgttggacaggtcacgcgcgcattgcggacgccagctagaccgagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaaccagtgcattctacttctcgagtgttcacttgcccctcagtttgtgaccaagttgtgggtattctgagaatcatgctctaatggcttttccatacactaaagctctgaaagtagtgagtttcctagaattaccatgctattcaaggtatagtcttgtttctcagaatcccagggaacaaagcaattgtctgcctctccctctgcctccctcaacttgatccatgtgaacatccgcacctgcacccatgctgatcaataaatgccgacaacacattttatgaatagaaaatgattctataagcattttcagtatttggggtgatctcaggtgggttaatgacgctgagctgtcctaactcttgcattgcaccacagtgcaatgatgacaagatgatgccaggccctggcagtgtcctggggcaaggctgttaagaaaattttgtgtttgcagtgtctgcttgcagaggcagagcttttgtgagtgcgtgtgtgctgaatgacacctggccctatgtttgccactctcctaagtagcacagaggaggagtgaggaacgcctttcaaggacccccgtgtctctgcctccacatcttccttcccgtttgcacagtgattttggtgggaggagaggactgaggggtgccttggcaggagtcagtatccacttcttatatccaaggggggattgtccctctcagatttgtgtcaggctaagttttttggtcttgctctaggctgggtcttcctgcttttctctcatcttacctcagtgctcctctccctcctcaggcaacaccgcaggcctgcagtgccccatcccaatctcctgtttcttttttttttttttttttttttttttgagactgagtcttgctctctcgcccaggctggagtgccgtggtgcgatctcagctcactacaaactctgcctccagggttcacgtcattctcctgcctcagcctcctgagtagctgggactacaggtgcccgccaccacgcgcagctaagtttttgtatttttagtatagacggggtttcaccgtgttagccaggatggtctcgatctcccaacctcatgatccacctgccttggcctcccaaagtgctgggattacaggcgtgagccaccacgctcggcctcctgtttcttagtcacacttctaatgaaagatgaacttgcggcagtctcacagggaaggttggtccccagactgttttttctcagcatatgtgccagcagccttctaagagctacatgtgtattattaacatgcatactgctgacaacagctccatgagataggtgtcattattttctcattttagaaaagagaaactgaggcactgcaaggttaaataacctgcccgaagttacacagctaagtaatgacattattgaaggaaactttatatgaaaattaaaaaactgaattgagagcatttatttaaaaatcataaggatatttacacattaggattttttaaaaatttcgattgtggtaaaatacacatactataatattgaccgtcttaaccatttttatgtgtgtggttcagcagtgttaagtattttacattgttgtgcaaataatctccagaactcttttcgtcttgcaaaactgaaaccccatacccattaaacaacaattctccattcttccatccctttacccctcccaaccaatatcctgctttctatctgtgtgaatttggctaatctaggtacttcatgtaaatagaatctcatagtatttgcccttttgtgattggcttatttcacttagcacaatgtctttagggttcatcaatgttgtagtattttgtgttggaatttccttattt

SEQ ID NO: 14041 - DNA, 6374 bp, Human; identical to SEQ ID NO: 14040

SEQ ID NO: 14042 - DNA, 8693 bp, Human
  misc_feature (1)...(8693): n = A,T,C or G
cccaaaacaaagcctggcccacgtgggtgctccgcgtatgtgtgtggctctaggcggagatgccgggggtggaaagagccggtaacagaaacagaacgtgctagaggaagagcagcctgcagggaaggctggcacagataaccacaaaaagaaagaaggcccccgcatcacgtcttcaccaagaccccactggcaaggcgaggacagcgcctttgggtggatgcatctgtgacccagaggcaatgctggctgtcctggtgtctgatttgattgcatctgatttcaaaatttgatctctgcttccttctgaaaacctcattcccttatgtcagttgtcaacaagcccttgtctagtgcgggcagactgttttccatcaagcagtcccagccaggctaacaataaaatggttggcagtgagcttgggggcagaaacctgtttccatccatgtgtccccgcagctagcaaagccctggcacacggctgaccctcaataaatgcttgctgaatgggtgaattgtgtctgcttccccaggaataggggtgggaggcctgaagcccctggggaccggtgggggcagacagcctgagattaaacttgatccatagataatcccccaaatccagaagccacctggacaacagttggctgaactgagctccatcgtgggatacatgctgatggtactgctgagttcaccaagggtctccccgggaccagaaaacagctcctcaaaatacaacttattattctaatcattattggagagtgacagagaaaagagcgtcaatcctttgagggcagaatccatttaggaagattaaatggctattctcaccgccgaccccaacccccgtttttacttttacaaactttattatgaaaaatatcaaacatacagaaaagtggagaaaacagtataacgaatccggccacccatcacccagcctcagcgatgaccaacccgcgcctgacctctccagtcatctataccccacccctcgaggcaaatctccgacgtcctctccttacacgcgcagacctcggtagcgacgggaatccgttccggactcctctggggccctggccggctccctcggccctgctcagcgcggcgcgggcgggttctcagcccacgtccgtgaagctgaaggccggatcgtgcggcgccgccccgccccccacggcgcttcctcctcggtccgcaccgcgagggtcaccgcggccccggagcgcctgggacactcgaccggcagccgcgggtgatgcgcgagtgagtccctcagcgaagcgcggaagagagaacgaagaggcgccttccacttcctctcgctctaacgccggcacccgccccgcgcgtccctcgcccccgctgccccgccccctgcagggcgtggccacggcccgaggggcggggaaacacccatatttggccttatatgggcagccgcgtcacggacggcactcattcacataaaacgctgcgcggccggcggaatccccggcttctagggcggcgagcggccgggctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcgcgctgcgtggtgctcgcctgccggccctatatggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaaggtgagcgctcggggtccctgccacgctcgcccctccggcgcccccgggtcccctccctgcgccggggcgccctcctacaccctgggaccgggagagtcaccacctgcaggagtctgcaccctgtggcttgttgtgcgcttgggagggcactgcaaatgtcagcactcagagctccccctcttccccacccgcgttcctcgaaagcgcccggcagcgggtctgcccggtggtctgggtggagttggttatgctgcgggggctgctgctgtttagcagtttgggggccgtcggctcgtgccgggcacgagccccctttccagacgcgagcttcgccgctgtcgctggggtcagggctcggggccttcctgatagactgatctggcgggatcagcaggtcgcgatccactctcccttggtgtggcgccgtggtgccccccttcctcccgcctagccagctgtggtcttcaccgacccccttgcctttttgacctggcgagtcccttccctttccatttcattttattgctttttattgtttccctccggcctcttctcccctcctaggtcttttctctagctcagtttggagctcacatcctttccacccttttcacctcctccttcctccgccccaggattatccctgggacccatcctgagctgagcctacagccagccagccacgaaatagaggtgcgcgggggcagggtggtatggagattctgcggcctttgatttgacacctcccggagctaccgccacaggcctgcccatttcacctgccgggaagataactttggcttctggtggtgggtgggtgattgactctcaaaatccaaagcattggttttttctgggttacttcctatgactgctcctgctttgtgtttgagtcctttgtaacctcaaatgacacccggggagacctgacccacatgtagagatgagggtttagccccagcagggccccaaggccgtgccagccctggcgcggacaccttgggatgtaacagtgttggggatcagagctcggtgcagagagccggcgccgagttaggagcctgttttaaagccatgcaacttgagtttcacacagtccgggccaggaagattctggagacagttcccctctctgctagcacctcctgctgactggtcccctgttgatttcctgttggagagttaacagaggtagatggtaatcgtccttcttctaacagcctatcccccaggggatagagggttggccctctggctctgcagaggtttcagcgtgcctcctgatttctttctcttcctaatatggtttttatctcctgtggtttggagaagtttctgcctcagtagtatgaaagaggttccaggagaccctccctggtcccacctctcctccccatgcttctctaagctggccctgctgacagtttagaagttgtcgccacaaagtaggcagctctatagactcacatctcaggaaaactgggttaaaatgttttttaaaagaaggtaacatatacacaggtaaaaatttgaacagcatgaaggccctgtgatgagaagcgggtcttctgcatatcttagaacccagttccactccccagagacagtcgtcaactattttttgtttacctttagatagtttttcataagtatcttagaaatagattgattttgtatagtccctgtcctgcctcttgtatctatctagatcttggagacttgtccatatctgatcatacatgtctgtttcacattgaaccggtctcctgtaatgaccattaggttgcgtcccgcctcactgctccaagcaatgcggtagatgtccttctccatgtgctcttgcgtgtgcagtgcctttcagtaaatcatgagaattgccaggtcaagaattacatgcattttaagtttcagtagaaattgcttcatgcctacccttataacactactaaactttaaattgttgccagagaaaatttttatttctttacgtaattcatgtgcagataggagttcaggttttaatctggtggcatctcagatcttggcgggggcaatgccttttgacactttccataatcccctgtctcccaaacaaccactaaaatgaaatggtgatgactgaattgcgtggtcagtgcttatttatatatagtatctgtgctctctctgttccctggtgatgtggtggtgattgaaagcagactcactccaaaagaagtagctctaagaattgccatggcttttgccactcgagtgaggcaccagcgaggaatgttctgtctctccacacctctgatgggagtgggtgaaagactgagaccatttaatctggaggattcctctgaatcccagcttgaagaggcaggaccctgtttatctgtccctcaactaaattttgtcaacagcatgcaggatccagcccacacccgaacctcttatctgtcctcctgatagccaactctgaagtaatatatttaaagccaaaagatggggtagcctgaagattcctatttccccaaccttcgtcctgaagtttgggagggcccaggtcattctgaactccaaattcccatccaaatccttgtttgtctcctggaacccataatgtcgaggtccaggcacgggaagtgatcaggtggtttactgactagggatgcctcttccaaggaagctgtgggtcattgtgagcctgcctcattctctcttgactgctggaagggaaggggcccaggggctatggcagagcatgggaagctaagctgcctatagcaccatcttgcacctctgccgtggcctcccgttgtcgtggggagcatggtcattgaggaggaccaggagctcatgggcaggcgcaatgggctgcttgtgaggtgaccacaggggagatctgggtgtactaagtgggggcggggcagttccagtgagctgagaggaagcggtaatggcaagatgactcattctaggaattggctgcagcttctgggagggagttggagactgccttgtaatccattaaccatttgtctactgcagggctttaaaaaagccagcatcacaacacccaaagtcagaaaagaaaaagggggttctttggaaaattcatggtctcagaatgcatgtttaatggatttgactccaagtgaattctctgggccagaaaaagacaagtgggctttctggaggccctaggaaatgtctcaggttgctctctgggttaccagcaaaggagtttcccaagcaaggctggcctgttgcacctggcagcccttggcattctgagggttccaaggccaccttttcattcggttcttccccactgaaatgggcccaagaaggcttacttatatttgcaagtttccgtgacttgctcagagggtcgtttttaccttatatccatttggagaggtgtaaatgtaatattaaggattctgagagtcacacatgccgtaagttgacttattgattggggggggggtgcaggaggagtaggagagaagtaagaaaagtggggataagaagatagggtggtcatgaaggggacagagacagtttttgctcatgagggctgagaattaaattcagaagtctttattctttcagttgatttagaaggtaattaactggattgatgactccaaattggacctagaaaggattgtcagcagtgttcttcttagcaccttgggagtgagaagcagtgaggctgttttactgccctgagtcgaaatgaaacctcgtatcagcccccatttccttataaatggaggaggttccagctagaatcctgcttagagcagatgggctggggaagaagccacttcaggagcctgtcttctcgccaattaatgaaattttgggtaatcacatcttccttttagataaacaagagagaaaatagcctttgttttctggagggatttggttagtatttgccagatgctagacactttctttcacagtttaatctgcttctgatagacacaaaaagttaatcattgcctctgaaagagttctttttagaggtttgtatgtgtgtacagcccctttctattctaaatctgtttgctggttttgctcaatttttaatgaccagaatctgtactggcttattttttttcttaactgtgtaacactcagagtattgattaactatgggtatttttgacagcgtgagaaattgatgcttaccatctgtctcacctttttgtttgtttttgtagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccaggtacgtgatgtgatggggaagaggtatcctgagtggtattctgggctcctgtctcccttccttcctcagcacctgactgttctctccccactcagcaatgatggttagttcttttgtggatcagggtgttggcaaaatcccctggctttagggagcttctgttgcttgccagcttgagcttccatccaagagtaaatgggcttccttccagcaaacgagctgacaagagcaaaccagccacaggatgcttggcagcttctggggaaaaggggaagtgaaagatacattattgtcatctggcttcggaggttcagagaagctttgaaatactggtctaggtttccctgaagacatttcagagttgactttcaggcttcctgtgttgcttttctttgtaattgtccatgctctgcagtttctgcaaaccatcccggtacctgtcaaggtgtgtcttattggtatgtttaactgaaactggtgttggtgggggtgctacagagaaagtcctgtttgggtggctaagtaggctcctctaaggggttcttatgcttacaattccacagataactgaaaccagaggaaatcaaaagatactagagggcttcatgtttctgtaaactagtgagtttttgtttttcttctaaaaatgagtgctttgtgataactcattaaagggaaaaataaagtggaagggggttacgtagcaccatccaggaagatgaaaaagcaggtgagaatccaaatctggcagaagccagagatcaaaacctaaccattttacggaagggaaaagaagtgttctgtgacaagtgagatgattgattttgcagagtcctacagctggttcaaggcagcatcaggctcagaacccctttctctcagctccctgttgtgattatttcaggaccttgttctgttttccacatggcctctaatctagacacctgacctggtgggagtaacctttcaaacttttcacataaaccaagaacatacccaaatcataagaagaaagattgctagatgctaaaatgccagctccctgccatgaacaaaaccctgtccctggggataaacttcaaagtaaagccagatgaccttttcttgaacgggctccttggtcaggaatcctattagcttgtccagatgccagggttaggattttgtttgttttcctttaataaacatccttacagtatatgacgagcctgtggctttcaagctgtggacatctggcctagctagatttctacttttgtttgtttgtttgggttgtgttttccccccatttctcagaaagtgaaagagaaataagaattggcagaatgttgcgaaagcacggcacatctttggccaagtgaggggtgagaaagccctgatgtgtcttcaagattcatctggggaaccccctaatgctacttcttagaaatgcttctgcatttagagcagccagatgaggttgtgttaacttttggggtttctgaaggcctttggcttcttcctcttggtctaaacagaagttcaaaaagggaaagaaatgtagtttcaggggtgtgttgggctgagctccaaaagaaactggataggatcccaggtctggtgtatcagcaatttccaggcactcaggagaggaagagatcttgagtcaaccatccagcctgctccttaaagggcgagcctgttagtgtccattggtggggacccataagtcatcagtggccacgtgaatctggacttggaactctgactcctttccaaagaactttgtaccacctctgctgttttcctggtttctagctggtggggatgctgtgcccagggagtgggtccaactcaggtcaggactagacctgcttggattgcctaaaaacctgtgtcttccccatggagagaagccatgttctgttcattcttcaatctctatgacagtggcagctatgtgacgtgccaggttttaatgcattcattatcccatttacaccttaccaattatccagagag

SEQ ID NO: 14043 - DNA, 312470 bp, Human
  misc_feature (1)...(312470): n = A,T,C or G
gtcactttacagacctgggcatgcagggccagctctcaatgtgcccatttccccacctctccacatgcctgttttttggtttccttcactcaggtttagaggacagccttgcttctatccacttgcctccacagggggctttactccttgcaaggagcaattgcagtatattttccatgcacacataattggcttttagctctgttaatgaagaattctagtctatatatttaaagtccaccactgtaaataattagcataatattcaaagatactggtatgatttggttaccttgatcaccactcctaaatagtcaaggatcttaattcattttcactttaggaagtttaatttcttttctctattttttttaattctaggcaaacagaatataagtttaaatttattcctggaaatatcctccgttcttgagaccaggatctggagagctcccagctgtgggcagcttcttccttaactccttttctccaagcacaaggaagaaagaatgacccagcaactcttctttgacccctgccctagagagctcagttaagggaaccatgcctataaagacccctcctgactcccctccaaccctcattgcctgttattgaaataatcttctagaagttcttaggtgattttctttgaccattcaaagtatttcttactagcttctctcataatctcttttagccatataagcatgggtgagttgcatgatgtcttttcatctgtaaattggggataataatacctggttctgaaagttgctgggaatagtgaaagacatcacttaatacatgtgttgttcttctcttttattccaatctacaggactgctataaatgggagctcacttttctaatgtgaatcatgattgtctttcccttaagaaagtttcattattcactaaagtaacaccctccagcattttcctccatcatagccttgcttgaaatttgcacacaatagagcttcatttgcttcattaagggttcttcttagcagcctccacttttaccagttttatagtctaggtctttgcattagtccactcttgcattgctataaagaaacaactgagctgagtaatttataaagaaaagaggtttaacttgttcatagttctgcaggctgaacatgaagcatagtgccagcatctacttctgctgagggcctcaggaagcttccactcatggcaggccaggggagccagcatgtcacatggtgagagatggagcaagagagagagaagggggagctcccagattcttttaaacagtcaaatctcactcatcaccaaagggatggtgctaaaccgttcatgaaggatctgcccccataatcaaatcacctcccaccaggccccacctccaacattgggaatcacatttcaacatgagattcggaaaggaaaaacatccaaaccatatcagtctttcaaagagattgatgttattgaaaaaaagtttatgagaatctaagttggttgagaaaccctgaaaagctttaaattcatgtgcttttcagagacataaaggaatttcaccacaataaagaaattaggttcaaagatggggatttccaaggtgtggatgtcaagtaattggacccccaatccacagattggcttttagagcaggtactgtggaagtgaggaagaaagtccctgccatcacatgggctgaaagctgcatgttgtccccatggatgtaataagctagtcacagaatgagcattatgggttaggcgagggacagctttcttgaatgaagtgtgttatattttgggatgggctgcaaaaaaatctgaagttttcttataagatctttaaaatcaagttgcgcttagatgtgttcatttctcaagtcaatctgctggactggtgagctcttaaggccccttagccccaggattctcctctgctatgcctatttttgtattctcactctctattttgtgtttttgcatgtgtgtgcctgtggcctgctatgtacagtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaagggtaagctttggagcctctgcttcctgcccatctatggcagggccagatctgcaaggtttccccaccaataattctgggtcatacaggaacagaaaatagtctaatggcttattataaagctctgaggactcccattcctagtgctaggcctgatgattttccaatcatgtccaaccaggttgtccatatttattattcatggtgagagaaagagatggggagagtttcaaacagtggaaaataacttaataaccagtccataatatttagtgttgaagtgttgaatttatctctctctcttctctctctctctctctctcacacacacacacacacactcacacacacacacacccctatatcctgcatccagccctaagctctggggctggagactttggaatttgggttgccatggacaattcactgaagggtaattgagaagggactgaatttggaaaatattttagttcatttcagtccagctcccacagcactcaacttggtactgaacccgtgtagctcattaactcaaagccctctggcttggctgtctttctctaggggctcattgccaggccctggaaggagatgaaactattggaatgggagtgggactgtatcatgtgttgtattaacttttgcttctaaatgacacagagtagtgcaaactttgcagtttgaaaatgtcaggatactgtgtgctcatattagccatcactagcactagccctagaaagcccatattcaacatgtggcaataaatgtgctgaactggctgcaggctcagtctgctctgggagtgaatagaaggatctggaggcccctcagcttatgcattgtctaagtgcatggaagctgaacatgggggaatccagggttggggaagagaagactgctttcccttattaaattttgcttggagccttcaaaggtcctgattcttttacaaggaagccttcctatatggacctcagaaatgaccaccttaaccttaatgtacccctagggttacccttagtcctttgggtcttgggggctgtatcagcaacttattctccattgtgagcctcctgccagcttccctctctgatgtcacccccaccctgcctgagcaccagaccagcctatgccagtttacttccccacttaccttgctccccagacacctgcagctgaagtgccaagcaggcttgttagtgccatcagctctgcaatcctttggactcagctaattgcctgggccagagcactcactcagccttcctgaggcctgctgagaacagggagctgcgcctttgtgtctttattggatttcttggtcctggtacccatgacggattgtgtggaaacaaaggagagagagtgccagatcttagatccactgatgaatcaacgtcaacagttttaaaaccatcccagcctggtcccacagtcctcctctttgtcccattggttgggatgggtcactatctttgccatttggcagggtctaagtggggaccaaggcaccaggctgagttcttaaaggcacaggtgcagcagcttcccggcatgcttgcagcagcgcatggtgggtgatttctttggttttcagagggctgccacaccacacttgctggctggggcactctcatttttctcattatatcctgagcagaatggcaggaaccagagcaagcattgattggttctgatttaattgggtctctgggaacaggctttcatttctttgggctaattggaacttttcttttttagagggttctgctgtccgtgtagcttgtcagttacctcctgtggctgtcctgagagggcctgtgaggacaaatatgtaaatccaaattgtttctttccatttctccttcccagtctcgatcccctcctgagttttgttggacatttctaatcttgagctattgtgaacatggcttgactttacaaactacttattgcaaactcattggagggtaaaggaaatggggaacccatggcaccatcactttgcctcttcagaggcatgggaagccacattttggtaatatttctgagcgtggagagtggcatcttgggtcttgtggcccagcatcctggctgaactctgtgccctgaaagggaagagaagggccccttgcccttgtctcaagaactttcagctgaatcccctgaaatctttgcccttaactctgcaggtaactggactctgatggctggcaaggggaccttcgagcaaaagtggtgatcttgggaagactctgcactctttggtggggggtgggaagtgcatttggaagtacttgttactggtctccatggtgtgtcttcagggataggctttccactcatttttggtgctcacggagtgctgccagatggacatggtggccattcacaatggttttggtgtagcccacttagcacaatcatcatgagggcagaagcagggagaatggtggataacagagaattgcaggtgagacacagtgagccttcaacaacgaactctctcccaacacagccctgagaattgatgtcctctgagcctggctgggtcaaatgctgatggctctatgattcataaagttgtgctgatttgatatatcttttctgcatatgtgaaactgggactttgtagggtggcagaaagaataatctctccgcttctggttccatgctatttttcctgcatggaaacagaacagactttcattatggccagggaactgtattttcttggctttcactttgcttctgtgaaaccgtctcctgtcaaagtcgtggtgaccagtcgcttggctgtgcagaggcacctggagaccaattagacagcacagccagcaaagagtggtcctggcctagagctgtttctgttgtgaagagcgtgggtggtgagaagagaacaggtgagaggggagtagaggaagctatggggagaacttgcgcattaggatgtgtggcaagcggctcatgcattttctagagggctccttggcctaaggcctgttcctgacatcctttctttttttttttttttttttttttttttttttttttttttaatttttttttttttaattatactctaagttttagggtacatgtgcacattgtgcaggttagttacatatgtatacatgtgccatgctggtgcgctgcacccactaacgtgtcatctagcattaggtatatctcccaaggttatccctccccccctcccccaaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttgggacatcctttctttacacacaggctggtcccatcaggcagagtcacattggcctgctgacctcatctcactagtgactctgacctcatcatgcatttgtctttataaaattgttaattactaggaaaatgccccatctaccccaatttcaagttatgctcatagtgtagaggattaatgagaaatcatagctttgtcttcccttctcccctcttccctgctgaggttggtggctaagtctattctctgtgtaggtcccatgcagcctggctcttcctgtgccagggaggccgagttggctctcagcagactctctctctctctctactgtgtagcctaaaatattgctttagctgaagttggactgcagggaggaaggggaggaggctggggctgttagaaggaacctggcaggggcaggctccttatctatgtgctagaagctcgagggctgcagtatcccataagggtgaccatgggggtgtctcagaaataggcagagaagatatgactgtcatatcttctgtgacaacccctgagtggccagatcctagctggagcactatgcatatgtggatctgttcttcccctgagtgctgcctgagggcttggctttccctcccaggacatagtccttggagtttccagaagaagctgcttcattaggctgcctctttagctacactggggactcagaaaatgacaatgctatgcataattctccctgccatcctctcttgcctctgcccctgccccaggatgaccttagcttgctattacagagggcacgtgccaacttatggtgcctaggccttcattgtctggggctgtcatgcacaggaggtgcaggtggatgaaagaggaagggggtatgcttgggtgcaagagacctaacctaaagataggggctggttttagtcttggctctgctgcaaacttgctacgtggttttaggtaagtcccttttcattgacagtcatatcttctctgcctacttctcaaagtgtgtgaaaatggatatgagaatattttctaagccatgccatgctacatattgctaggtgtcattgtccttaagctctgaatcacccttattaagaaaataagattctggaatgaagatggcatgggactccctcatccagagacacaggtcagcaggaatcctgaattcccagtcatcaccttcctgcatctgcccaggcccagctccatgaccaccaagcagtgacaagtgaaaacagcagagaggaataagccactgttcctcaactgatcaaagggcaagttaacacatgtttgaatgttatggctcacatggcctgccttaagccaggtggtctaggcaggtggtctttgtgaaatgaaggaccaagtggagagagaagactctccaagcccaagagagccatggtcttcagaaccagcaatttttgaccccagggaaggcatgagagccctcagaaaggttttacaaagtgacatccccagttgcctccttctgagatggtgataagtctcgtatatggcccaaacatggggattttaaaaaatccaagaaccccagctctaagcagcagaccaggaccatgtatgtgactggtgtccagaagaaagggaccccagggtaggtcactgaagatattatagggttactgggatttgtagacaggatgaacctgggtgcctgaggggatgaagaaggagtctgggagaggggactgcaggagcaggctggcaactgggtagaccaagaacaaagcctacaggccaccaggaggaaggtatccgagcatcactaccccttgaataaagactggaggctggggaaagccatacagggcagccctgaacaacccagagtatcaacatgatggcacagctgataaagcccgaaaagggctcttggcagggaaaagaggggcagaagctgaagactgactgtctgggtgttatagaaacaaacatccctgcagctagccagcaccagctgggtccctaggtactgtcttaagaatgccaggggtaccactactggtcccagcagcatgatcaaacctgcaggactcctattttctgctcaggcctacaaattggggctgggaatgaggatgcatgactttaactgggaatctgtgtaggttttccagaaggctctcagatcacctatgaccattctaactctggacattggcagggcctttacaactctaacagaagaacagaacagctctcgatgtgcctgtcttcccatttggtgtctctctgcaagttatggctggtgatcccaccagcactgccttaggctctcctcttgtcagacgcttgctgtcctctccttcctggctgcttcttcattcctccgccctctccaagtggggacttttttctttagtaaagaaaacctacatgtaaattccttcatgcctggaaacccaggggacattttgaacctttcaacagtttctgcacctttgtcagcttgagcagctgagatgagccactttataagcctgggggagttgagatgaaaaatttgcaggatttgaaagtggaaaaaatacatctaatttaactcttcttggaaaaagaggttttcggggcctgcttccatctcccttagggttgctggtcccagctctgggttccccctgcctcctcatcctgagctgctgaaagagaaggtgaggaacacaagggggtgtgtgtgtgtgtgtgtgtgtgtgtgtgtgtgaggcctcagtgctggaagccacattcaagggcaccaaggagccctctctgctctctcagtcccatcagctattggctggtgagagggaaaccacagcccagatagcctcctctcaagctccagggagaccggctgtgttcagggccaggggaggccagggtcattaacaccgcagccctgtaacatgagcttcataataggatttcccaacaggctacttcatttagaaacctctcgggcctcctctgctccccatggcggccctacccagcgacccccagagaggaatcagatgtaattggctgtctgtaattgactgtgacaccggcatgagcaacagcacagggagctggaaggatgcccctctgcagcatggactccaggatgctgggctctggaggcggcagaggatggcaagcgggagttctgggttccaaacccccttgtgctctgcataatgatcctttctgcctttgagacacagggctagaagcacccaaattccactagtgttgagcaaataatcctgagtcttccaggccaatgttagagctactgatcatgatttggcagcgtcccatgcatgagagctgccctaggtggattttgtttgaacttggtcatccatgacttaatatatatgtattatcaaagatgatgacagagacatcatatggttattactgaggtggggtgggtagtgggaacatcaccacgtcaggagtccaataggggccctaatgccatcgttttcttcaccaacgtcttcccatgaagacctctggggtctgaaactgctggagtgagtggtatggagatgctgagagactgcctcatttatccagagaggggtccgccaggagcatttctgggcaccagtctagagagccatggctagttaatgttagcactgggattagaactcaggtctagggaggccactatctgcctccacttctgagactggcttttgctaaaaataaccatcctttaaagcacaccatgtgttttcaggaatatcgaacttctgtcaactgtctctcacaaatgaccctctctcttgtgtttttataccttatttcttcttggggttctggtggctctgtggttacacatttctgcactgtccctctgcacaggactccatgtccactatcaccacctcctttttaatccctctaggggcagctccatctctccagagagctctgacatgttaagctgcttatgaaccagcagataatacacagcccctcagagggcaatctgaggctcaccagggaagaaaaggctctgaggctttgtgcttacaggaaagggcagagggaaggaagggagctgtggactgggggattgtgtttctcttatttgtatcaaggaccctgcatgggcctgtgagggctgtatcccagctcagtcagggctgttgtcagacttatcctttgcttttggtccccatctcttgctgtggctggacagtcccttcctgcagaatttgagcacaaacatctgcacctttttttttttttttttttttttttttttttttttttttttgcatggacggagactcaccacttttcagtttgaaagatggagatgaaaaattatactgaatccaagcctgcctgcagtggagtcttttggttctgggcccttaggagccctgagagatctgagttctgtttccactgctttgggccattgatgagttgaattgatagggccttaagacctgggtctcaggtctccctcagtgcagtagggtgaagaagactggaaagagtaacttgagggctgttgcaaatggagaaggaatgcacctcaaacactggcaaaccacccaggaacaagccttattttgccaacaggtctttgacaggcatgttgagagaggtgcaaccttgcctttccctacaggctgtaaatgttcaggctaaacaaagagcttgagtgctagttacctggcaaggcagttgagcccccatttttgtttcaagggcctgttaataatactgagaaggcaaagtctggggagatgtggtttagtccagaagagtatggctgggtatgttttgggtcccagaagctatccataagacagagagtatctcatcttcctttgtacccacctagcctgctgcaggatgagtctgtgaagctgcaagtgtgttcgactcatcctcttgtgtatgtatgaccagggaggtcaggaagaaatgagcttagctacaataggcccctggagaggctggtgagaaggaggcgttgttgagagcctcaggaagcctcttgaaatcactgggcataaatttgggccagcaaggccaaacccagccctgatgaatcttttcattgaggataggacctagttcattagaaaggctgcagaatgaaataggcattttggtttctggcttttccctggcctctgtctggagtagactactcagcttcagggtctctacatcagcacaccacacattcctggtcagagctggagtcactgggtcttagggtatggtccttggaggcccactctgatcatttctttgcaggcctcagcagttatggccttctccttcctcattcaaattggattccactctttaggtcatgcgggttggatggtcccatgtcttttctttcttcagctacttattgggcaccaactggtactgggccctgtatgcttatatatgagattcagcatttttcttccaggaatatgctgcattcttagctcttagaaagtgttcacaatgtccagaggatgctgtggctgcaagtggtgctgttgctctggagaacctgatggagcatggccacatccggctagataaagcctcgaaggacagcgagtcaagcacaccccatgaccccactttgctcttccacagtggtcctcagcctaattttagacacttccagggatggaacaccgttacttccgaaggaagcctggttaatttctgaacctttcttccttggggtggaacttttatacaaatctccactcatgcaatttacctttttttgttgttactaaaaacattttgaacaggtaatatatgtgaaaggtcagtttccctccactctggttgtcatcagtctctctcattgtcagtttctaatattctcttgcagagagtcgatggatttgtacactcttcccccttgcataggggcacactacagaggactttgcacctagtttccccacatctcttctcagttaacactgaagtttaacagtagtttggttatattacatatagatctgcctcattctttccaatgagtgttattatttcattgcatggatatattttacttaattggtcatttatatacatttagattgttttctctcttttgctgtttctgaacaatgttgcaacagatatccttgtgcatcagtctttgcacctatatgtgagtatatctgtgagaaaaattaatttatttattcaatgaatacttattgaggattttctatatgccaagcacttttctaagcactaagaatgcagtaaattctcagaagtaaaattgctgaataagaatatataaatttttaattttggtagatattcccaaattgtcctccccaaaaaggcattttctaccaatttttgttcccaccagcagtgtttgagagttcctgttccctatacctttgccaagataataaaatatcaatcatttttatctttgccgatctgagaggtgaaaaatggcatcccattgttgttaccatttgcatttgactttgcaaagttccataaactgccctgttcaggaactgagactcaagcattccagtagaatgcattaagttgggtgtgtttgtgtgctgcaggtggttcgggtatggtctgtccttcactctcttctgtcccattccctccaaccctgcatcatcctctgtatgtactctttgcccatctctagtatcaggacattttgacacgtgcctcccaccgattttggcacttcccaagctgtggtaggtgaaatgtctgtagatgggacaggacaagtgcaggtgcttgacgctggaagaccaccccattctcacagtccagtctcaggaaggccgaatctgcctggtttgctaagaaacacactttgcttctcccatctgtctccttctgcccctgggcctgtgtcagggcttcctgccctgccgcatgcatctctcagctctcaccctttggcccttcaccccacatcctttcctttaattttcccagcttacctctggggcctctagcctcagctcaccatgttgacacctccatagccccgccttcctagatcgccagccctctgccctcccctcctcctgccccctcttcatttcttcagccttcaccagacctgccaccccttccccagcagccccaaatcagtctcatccccttccctgaccaggtgtctaccctctactggagcatacaccttccactctgctgaagcccaggtcttgtctctgccaggggtgttggctcagctctgggctgttgcttgctgcagctatgcatatgtctgtttggtttttgtccccctgctctgtggcagctctttctatctggggccatgcactccctacttctcttacttacctcagtttccctttcccctcccttcccctcctctcccttcttataccttctcttgctccttccttccttccttccttccttccttccttccttccttccttccttcttccttcttcttctgtacttttgttttaaagtgaaaatattcatgttaaaaagtgagttaatttaaagaaaaataatgaataataataatacatttaaaacctgccacatataagtatggcaaaaaggaataaagataataggcaaacagctgatatttgaaaagaatgctgatgctctgtttacctgggctaggagagcagcttatgcactcttcagtgtagccccacattccactgccactgatggttgtatgatggttataacctgggtatggagcacacttctggattggcttccatcttgtgtcgaaatgctaatacagtgtggctgtcatttataaagcagtgacggtgtgctagatgctctgccaaattctttttctgcattaactcttaaatcctcacagagctttatgaggtacatgtgattattagcctcatttttccattgaagataccgaggcaccgagaaggtaagtaattttctcaagatcatacaacacaggacttggaggttctgctggtaaccactattctctatgcctcccaagctaaagaagagccaagatttgtaatttttgatgggagttggcatcagcattccatttggactaagatgtaagccttcactaacatgcacaaagaaaagtcatcagaatttgatctacatttggggacttcacggatagtgttcatttcccattggtaagggatgaaccaggaagttcatggagtgatcatattcaccagtgagagtgaactgaagtcactgtcactgcacctgtcacctgcatcatcatgcccagctcacattcccgttcctctactccctaagctcctcaggggcagtggccatgcctgatgcatctctgaatccctacttgctctgtgccatctgttaaatgaaaacagaacaaaacacactgaaaacaaaatttgtggaaggagaatatgagctgagaagggagagtctttgcattaggatgtataagaaaatatcccagcagcattgagtagagggagctccgaagaaactggggaggaatcgggcacaaggcatgcacttgtggaagtgatgatggcagaaccagatggaggcagtaaccagtgatggcagaggccttgtctgtctgttgtccaatatagtgacacattgtgcacaaacatacagaacaaaaacaacagaatggtcgcaagcccatacgttatgaaactcactaaaagttggtgataatgtctcagtttgacagaggacataaggtcagtgcaacgtgtgtatttcaagtgggaaatgacaatctgctctttgcacaagatggatagagcttctcattgaaattgtatggaatatgcaagaactctgccaaatcatgaacttggcaaaaatgtgcctgttctgggaattaggcgatttcagggcttccatttggtttctgggtctgtcacacacatgcccacatggatctgaatgtggaggcccttgtgacttcaggctttgctttgcttttctcactggctctgtttgtcttttccctctgcatctttggtcaaatttgtctactctattttctcttcttttcctccatttattccgttctcttgtctgtcttctctctagacttgtttcgaaaagagggaaaagaaacatacatttcattgatagaattttaatgagtgaatggctatttccattcattgtttttattttgtctctaggagtctgtcttgatgcgaattgcaattttaaaaatgaactcttttaatagtaaaatacaggaaatcaatgattatcattgaatcaatagcaaatattacaagtgattttgtcatcaaaatgattaataatcacacattttgataaaagatcattaattaaaaagaacagtagcttttaaaaattttaaactgtcttcgtaggatgccttccttcttcagtctcattatttttctggagcattctttgcttccttcaccttcttcagccccattcttgattactcttggcttatgagaattatttcaagcctcccttttcttctaacatattttgaatctttcattccagatactcattaagaaccagtagccaaagctgttcattgttgaattttacatacctgatgagagtgactgcttccaccttgcaggatgacatgttccttcccctgctctacctaccctgcctatctctgcctacctaccctgcccacttctctaagagtttcctctagggccaggcgaggtggctcatgcctgtagtcccagcactttgagaggccatggtaggaggactgcttcagccccggagttcgaggctgaagtgagctatgatagtgccactgtactcctcccgcctgggtgacagagtgagaccctgtctctaaaaagaaagagaatttcctctaataaaaacaattattttggagagtgttttatctgtggagattgattttttcagtcattttctctctgacccacatcaaagggtcgactacccttctgcccgcttgtagagagagcctaaattcgagttaaccatgtctaagcagtgcagcagccctcccgcccccacctccaccttgaggaccttctgcagccctggaggctaccgattgactactcagagagctcatagcctcagtgcacaaatcacactgacttggacatccacacaaccacttctttgggaggcagaagtgcctgcatctgcgcatcccaggggttggtggccttgactctctgatctgcttccccagtggccaggcctcttcagatcttttcccatctcctgccttccctgcctgtagctgtgcactggcccttcctttcaggccacaaagagctctgtagacagaagctgtgtgctgtttgccaacactgcactgggtatacagaggggcaagggagaggccatctgctcgctcctttcacacagacctttgctttctccctttcactctcctccttctctctgtctttgaatgagaatacaaaaattttttaaaagcagttgctaattagagcaagagaatgagagtgagcctggaagagagacacaacagagaggccagcccccgtgcaaatcagccggcttttaagagccagtgaggaaagggacaaggagggggccttgaaggggcttgggaaggatattatgacaaaataagcaacaaagcttcttcagaatggcaaagagggctttgtcttaacctcctatcataaaaggggaggaaacaagaaatgacagagagtttcttgtgaactccctctgcaagcctccacctaccctggctcttcttgtcttttttactcactcaatagcctagtaaacaatagtctctatttagggacatttaagtgtatccttttattgataatttttgttctggctgatagagagtgagcaattggtggcttctcttcccaggcagggctggcttccccaggcagggagcttgcccatgcaggagcagctaagtcaccaggaagccccagcttggaaaatatgtcccgacaagtcaagactttctttcaggattttgcccccatcactctatcctattcttggttcacctagtgatttcttttcccatctgcattcctgccattctgtttgcccagagcaaccctgatgtacggtgctgaagtgcttgcccagtgcatggccaggggaatggcagtcagtgttagaacagggccccgctctggccctgagttctgaaaacccactcatgctcaagaaggttctggccaccacagcaaccagggatgggggcacctgcatggcagctgtgccatggcttagaatagagctgccttgtcctttattcaaccagcctcactctaaaggctgggaggtcccagaaagaccaactttggagagctgtgaggcagagggagggacacatggtgaaaagactcctctagagatgcattttcttcaggcatgagatgaatggactgatggcccagatatataaagacttttaagtaagtgctatgcacattgaaaaacttgggtcattttctgatttcatggagtgtaaaaaaatgaaaatggagtggtggaagcctcatcacaacacacattggtactaactagtcagggaggaagaaaggaaaaggaaatagaacctgggaagacacatgctatggtctgaatgtgtcccccaaaagttcatgggtttgaaacttggtcctcaatgcagcagtgttgagagataggacctttgctaggtgattggatcatgagagctctgcactcatgaatgaattaatccattcatggattaatgagttatcaagggagtgggttagctgttactagagtggatcttataatagttatattacaatggttgtattgttaccatttggccatctctcttgagtccctcaccatgtgatgccctgcaccacttcagggctctgcagagtccccaccagcaagaaggccctcaccagatgtagcaccttgaccttggaactcccagccttcagaactgtaagaaataaattgctttttctttattaattacctagtctcaggtttttagttataacaacagaaaatggactaagacaaaaggatgataattgatttatcctctttcactggtgactttttaaggtgatggatgcacatgagaagaatatcccactggagtctgttggaaaacatctgctcattctaagatgaggtctcaaagtggacttttcaggagtccacactcagtggacctgtctctaacacacaggtgtgtttccctgaaccctcagtgcagtctatcttggccctgtccaaggacctctctagaaaacaaggacatgagtccatttgccatgcaactagccagggtggaaaaagctgtagagaaaacagccatagaagtatagttttaagagctggcagcttgagttgttgaatcctggctctgtgtttattaatggagtgacttgtctgggcctcagtatgttaaatgatgacataacagcactgagctcatgtttgctgtgaagagtttatgagaatctgcatgtgtagagctgagcaaaagtcttgacaccttgcaaaggtttaaaaatggatgttgatgtcaacatttttattattaaacaagccaggaggtaattttctatctttgggtgaaccatatatgaattgtgggaagaatgtagaaaatttaaagagatccagtaaatatcaagaaggcttagacaacatgatctggttcatacgtatataaaatattttaaagtaaattccctgaagatagtggaaaccatccatctagtcataaatagctatgggtttgtccagtttattactgcaagattaaattggtttttgttagttaacattttttaatttttgtgacttcttaattctatttttaaaaattataatacagaaaatttgacttcttaacttatttaagtggacagttttatgaattttgatacatgcatagatttgtgtaaccactatcataattggggtaccaagagctcctttctgctacccctctatagtctcctgtttctccatcccccacccccagggcaaccagtgatttgtttttcatcatgatcctgttgtctttttaaatgaaatgatgtattatggcaaccttttgagactggcttctttcactcagcataatgcctgcgagattcatctcaattgtatcatgtagtaatagtttgttgcttttaattgctgagtagtatttcattgtatggatgtaccataatttgtgtatccattcgcttgttgaggagagtgtggattgtttccaatttttgattataaatagaggacatacattttcatttctctagggcaaatacccaggcaagctcttattgagtcatatggaaattgtatgtttaactgctagatcagttttcagggtgcctgtaccattttccattaccatcagcatcagtgtgagtttcagttgttctgcctttttggcagcacttggtattatcagtattttttatcttagccattctactatgtgtgtcatggtatctcatggtgatattaatttgcatttctctagtaaatcatgatgttgatgatctttcatgtgcttgtttgccatctgtttatgtttatcctcttttgtgaagtgtctcttctaggtttttgcccaagtttcaattaggttgtttgttgtctttcttgaaagaaaggaaaagaaggggaaggaagggaaaaggacaggtgaggagaggctgcctcttctcttagaggagccctgggaggcaggtgtggccatgaggactggtccacacaggggagagccaattcttagacacgctagtttctgtttctgatctgtgatgaaggccttcatttaaggaagacatctcagccagctctgcttgggcttcttttctgtgaattattataagtgttaatgggagtcttcatcaaagcatcatttaagaaatattacaagttaagttcctctcaccctcacaggtctgatgactaaaaatcagacttgaaatcaaatttttatcctctttaattggtgacgttttaaggtgttggatgcacatgagaagaatatcccactggagtctgctggaaaaaatctgctcattctgagatgaggtcttaaagtggacttttcaggagtccacactcagtggacctgtctctaacacacaggtatgtttccctgaaccctcagtgcagtctatcttggccctgtccaaggacctctctagaaagaaagggcatgattttgattttaaaaatcaaaacttgaaagttttgagagttccttatatattttggatataagtccttttgtcgaatatgtgatttgcaaatattttctttcagtctgtaactgatctctttattctcttaataatgtctttcacaaagcaaacattttaaagtttgatgaagtccagttaatccatatgttcaagtttatctaaccaattatttttcacttcagccaggtcaagttcaataattctttgcctaaccttggcacaaagattttcttctctgctgtcttctaaagttttatgttttacacttaggtctataatcaatttgagttaatttttgtttaaggcatgcagctcattttatcatcattttgcctgtgatgtccaattatttcaacatggagagagctgtatgagtggctctttcactttttccaagcctttacttgaatattatgttctcaggaaccctaccctgtccactgctcccagtgtgaatcaccttcaacagcctcccatctccctccatggctttgtcttacttcatggcacttattatagtgtgagctttactgatttatgatgtgtattgtctgtctctcctcactagtatgtaggctatatgaggacagcggtatttgagtgtgtatgtgtgtgtgtatgtagggaaaggatctgcttgttaactgatgtatcctgagtgattagcacgtatttgaagaatgaagaggctggagtcccctaggccacacggctgcagaggtccacagtgcagggacagttgctggggctccaaggccagcagcagctatcagatgcgagctggactctgtctcacacgttcatcaggcaaaacaggtttgtcacagttaatgctccgaagctcttctctcactcacccgcctaccatattgaatgaggctaataagaacataagcaattaaaccattttccccatcagtcttaaattatttgttccttgaaatataagctttatccttttctcaccccgatacctcttgaaagaaaggaagtgctctaatgccctgggaaaataatcttaaattctaatcagccctcaatcctgggtgttagaagtgactcatagatgaggtggtgggcaggatggaggggaaagctgtttaggaggcaaagtcggctagaatggaagctttcaactgactaacagtgcttcaactccaacaatgaggcttaacttatcaagtgtggggcccagggaatctgagatgcaagcagcacaaagatacagagagaccagaagaaaataaagcagattaaataaactgggagtgggtttagtggattcttgttctctgcaaatggagctcctcctcttcattctgaccctaccctgagttccaacttactttcctcaccagtggcatcattctgcccttggtctttccagtagcaggtagagtcgatgcgtgacattcagtctccctgggttctgctctggaatttataggaggagcttagggacaacagtctggatggatgggtggatggagcgagggcagctgggctgcatttgcacagcaagcacactgttcttaatgtgaatgtttatttgtagtgcagggagcactgatgggaataggatgagaggcaggccctggctggtgagggctggtgtgaagcatctgcagaggttgctggtccttctccttcctcaatgcagggacactagtccctttaggtaccatcccatctcccaccccagcatgatgccctgcagatgcagcagatcctgtcaaacagccctgctctttgattatctctgaacagctaaggctcctggcctgtttgaaattgggtcacatactgtttgttctcagaaaagcaaactcatgttgtcttctatttccatctcatttccagcactggattgaccaagtgggctaaaattcttttttgataaatttgtttcagttcaatgggaggagctgctgatttttagtcatcagacctgtgagggtgagaggaacttaacttgtaatatttcttaaatggtattttaatgaagactcccattaacacttataataattcacagaaaagaagcccaagcagagctggctgagatgtcttccttaagtgaaggtcctcatcacagatcagaaacagaaagtagcatgtctgagaattgcctctcccctgtgtgggccagtcctcatggccacacctgcctcccagggctcctctaagagaagaggcagcctctcctcacctgtccttttcccttccttccccttcttttccttctccttcagagcatccttgctatgagtcaatgctgcatgtggggcttcttaactgtacagagagcatctggatcttgaggtctttctctaagagtgtgtgtgtatatatataaatatctatatcatacgtgtttatatataaaatatttatatataaatatataagtatattatatatcttttatataacatataaaagaggtaatatatattatatgtattataaatatctaatatatattaaatatatactatacattatatatttattataaatatatattattatatatttattataaatatatattattatatattataaatatattatatattaaatatatataatgtatattaaagaggtaatgtcaaaacagggttacaaaaattgccgtaatatttgcattcaacaaacaagtacttttaacacaaaaattgcaatactgtgtgttatgctacaagaagagacttgacagatttataaaatgtatacatgcacagggaccaagaggcaggctggttggacaatgggacacaatttgaagttgtggatggacttctcatttcagtcctgtgagtgtatttcactcagtgtgaatttgaggcctttcttgaatgggagcaggccaaatggccgtcctgccttgctgtgacaaccctatttggacctagagtctgggtgggtgggcagctctgacagagttatgtcccttgtgttcctgcacatcccaggttgggcctcagctgcccatctctggcccaggggggttggtctggcttcccttcttgctccctccacagcctggataggtgttccagcaataaggcattggagtctgattcagatcatagataaatctggcacagttacttacctttcttgggtgtggggaatgtgtcctcctgcaggagctccagctgtggcacaccctgtagtctcaggtgtgcagccctttccaagggcagacacacaacaacaggattgctttctctggctgtgttcactggctcccttgccttcttcagggatggggacagtgagaacctgatagtgaagggcagggttgaccaacaaggtccacagcaagtttctggctcagcctggaagagatgcccctgcttctttaaccaatggtaggtctggcagtgggagaggaaccgagcagaagcactccttgtctgtcttctagtctttttttttttttttttttttttgagatagagtctcactcccgttgctcaggctggagtgcagtggcatgatcttggctcactgcaacctccacctcctgggttcaagcgattctccttcctcagcctcctgagtagccgggattacaggcatgcaccaccatgcccagctaatttttgtatttttggtagagacagggtttcaccatgttggccaggctagtctcgaactcctgacctcaggtaatccacttgccttggcctcccaaagtgctaggattacaggcgtgagccactgcacctggcttgtcttctagtcttaaaaaataaattatctgagcagaattaaaatgccaagggttggtaggagtgggatagggtagggcttgtcaaaaagccttgggagaaagcatttccggaatactcaatcctagagaaaatctctgcagctgcaggattcaaggcttggcctggagagtataccttattcctttagggaaatgctgagaggttttgtctgacctggaaaaacaagaggagcatgtctgcaggagagaggacccaaaggccagcaggaagttggtgatttggctggaaggcaagtcttcagagagtgctgtgaagtgatatagagctgcatctgggctggaggaatatcccatttctctgcctttatcctttatccagtcacagtggtctctgaccacaccctagttcatctcctctccccagatacatcttcctaaatccaagactcagtcacaggtaagcattcaaggatgcacacgtgcgcacacatacatacacacacacgcacacaaacacacacacatacacacacgggccccaaacccagtttgtttaagagtgtagactctggagccagactgcctgggttggaactctggtgctaccacttactagctgtatgaccttggggtaagttactttacctttctgtgcgttgctttcctcgttgtaaaatgggattgatagtaatctatttcctagggtgttatgggaattgagtgaattaatgcttgtaaagtgcctaaaacactgctggccctcagagaacattcagtatgtattagctgttattattttccaccttgcatgcatagcgtgctgtgtccccacccctgccccacctcttcaacgccaacagtttaaattgtgaatctcatcaacccttcttcaagccttgcctaaactctacctcttgtgtgaagagtttttgatttcctgctccagtgccagctgacatcctaatggcctcttgttggcacctgcctcagcatattgcctgtttctttcctctttgcccttttgtttcccaagtccttgagtcagactgtgagctccccaaagcagtccgcagtcccatgacttcatctctgatccgtggcagcattttcctgtttccagcacgggaggggctctcagcacacccttcctgcttgagctgctcctgtgccttgcacctccctgcccttcttccttctctgctctcctctcccctccctgccactgcccatcctctctgtgtctcttttttcctcccctctctccatctcttcccttttgattctccttgcttctctgacctcccccacctctctcttaatgagaactttcacacatcatattgatttggagtttcaaaaagccggcattgatttttctgggagacttttcatgatcttatttttaaatgtaggaagaaggctgtttccaaagctgttgactttgttctattgagttagggagtcgatgttggaaacttttatggggactcagagagctcagggacctgagatgccatatctaatgagctgggatcagggttgccatcccttttgcaggcctgagtttggtggcagagagccttgggcagggcaggggatgcagaactggggtggatttctgggtaaggctaaagagcatgtacagagagtgagcaaagtcaaaacagaaatactataggctgtaagagagtgaagggtaggcttagggggaagaatagtggtgggaatttgctgtggggggccacagctcctgatactctgctactctggcatcagagacagcctcccaggactgtctcccctagcccctcatgcaacacatactgacccaacacccagcaccaatgtactgcctggtcctgtactgagggctttgcttacatgatctcatttaatcttaccaataacttcaggaggcaggtcacattatttacatctcactttatggataaggagtcattataggcataggttaaagttagtgaagaacagtgttttttttttaaactattcgtaaggatagaataatagaaagatttaagagggcagggggggagtgagaaagacaacatcttgcctcctaaagggcatgtgcagatgcatacatgtgcacacatattggccacattaaatcttctggagatgaggccagacatataaaaacaaacaaacagaatcaagccactagatgaggatataggatgaaagggaaataaagacagagaaataagatgatatgtggctgaaggtcctgacacccataaccagaagtgggtggattaacagaatgcagaatggaacaggcacctggagggagtctgccttggcctgggtcctggatggggtatttcaggccctctgtacgggttagttagttgtcaccaggtcagatccacacacacacccctgctcttgccaggttctgcagccattaactgggactgccgttcccctacatgaattcagagatctatgggagcagctagggaggagcaggcacagatgtcatctgagagattccagggcaagagcagagaggaggcgccaaggacaggatgggatgaatgcaacagctcctttgcactgcagcctggcagccccctggcaaatgcaggagaacagctcctcacctgactcaataaaggcagcactgggcagggtcaattcaccaggaagttgaaaggtgatcaaaccacactgagatgacaggaaacctttggcctgcttgctaactttctaatatcatcaaagataaatctaattttgtcgcaggacagtttgtcttgtttggtttgaaacattcttgctctcctttttatctagcgagcttctctggtgttgcatctcagcttagggttcactttctccagatgtcaccccatctcctcctctatgcatctgtaacacccatcatggcccaaacatttcttctgtgatgccacatattcttccataaacaaccttatatgcaaaactgcactccaaatagcagtgcttatggggttaaaaaaaaaggttagggcttgtccttcaacacctgcaggagtttgtatcaaaagccctaagaaaaacaaccatcctaatagaaacagcagctcagataaatctcttgcacccagcctcccagtaggtggagactttgtggccttgaactctggggctctgccttctccttggaaatgtaggtgctagagggcattcatttctatttgaaacccagttcatcaacattacaactctgacaatttttatttgacaattttacttcaataaagctgaggaacaattctgaaatttccttgaggatgttttcacacaggaggaatgtctttgtagcttctccatctgcattttcaccttcacagcttagcagaatggtggagtagaggtgcttgaagcctccaaaccacccacaatgtacactagaggaggcacttgtgcagactttcagcttgtgcttcacactcctcaaggcaccgccactgttgcgagtggcctgggatgtgaaggagaatgccttggaaaatctctagctccaggcctgtggcctttcagcaaggtgtgctctgggaggggtggatggacctgcagaaaatccatcttcacgaagaatggactcctgcatcctgcattcctttaattctcactctagagcccatgccgtggcagactcccccgcaaatacctgttccttcatttacatgccttcatttcaagaaaaatagtaaagaccaagaatgtatctggcagactttccttcagtggccaggacatccttgtttgtccctttttctccacatcccctgcctccatttctcctgccatgctgaccacattcagtcttctccagggccaaggctcacctgggccccctgacttgctcctggtgaagtacctgctttggttttccatctgtgtgtagagggtgctcctttgttttctgcgactttccctcaacatcctcccctctgccttctcagcttcttctccagccccctccatcattgggaggatggatttgtctattcccctaaaacacctagagcccacagtttgctccacagagggataggagtagaggcctgaccccaggagatgttggaaaccaccttaagccctgtaacagagctggcaccagagcctcctgccgtcccagccctggttctacctgtgaaggagagaatggaaggaggcacttgcctgatgccatccattctgtttttctttccacagtgtccaggcctttttggaggatccttagacagcaggattgacattggaggagcctggtatttctgccacactcacacagcctcctctgcatccaccccctctgaggaagcaggtgacttgcttgtggagcctcaaaaatggaagatccaagttttccctttctcccctcagaagccctccactcctgcaatccactgagttaccaagtcctatccattccactgtggaagagctcaaccttccctttctctctgctgcccctaccctaagccactgtagttgggctctctcttgtcttccgggatcctgccctggcccctcagtgcatcttccacatggttgctccagggattttcccaaaaagtaaagctggtcctgtcgacctatgggaggctcttctttagatgtcttcattactcccataaaaaagtctgaaaaccctgccttagcaccagggcatttagcaatctgcccccacccctcctctctagctccatctcctgcagccccactttaagtatctggccactcggtgctaaggggttcccagaactgagtctggtctttcatgctccaatgtcacctacacactctttcctcttcctggatttcccttctctttcctttcagttggcacaactccaggtctgctgaaacagttcagccttactaagccttccctgtctgtagtaggccttgcttcagtgtccccagtgctttttagcatctgactccagtgtcattggttgcactagacaggcagagtgctcttgcctggtcctcccatgagactgtgagctgtggcaggacagcctccaggttgctcctgtggctctggcacctagcatggtggagctattaggagaaactcaccgcagatgtgtggaatgaataagagagcattgtgggacctacccagtaacctgagaggtggcaacactactgccatctggcttcagaggagtaaaataggaccagctttcttgggttttctcctccatgatgttgtcctcatggagggtggggccaggggccttggggtctggcatcccaaaaccaggcaaacacttaggatttctggcctcataatgtggcttataaaagcttccaaggaaacaaaatcaaaatgttagaggatttttctttggggaaataattactctcatcttatatttagaatggtacagtgtcttctactttgtgatttgactgacagagaagtgtatttgaactatttttaacttggaatattaagaagaagaaatcaagtgattagattttggaagctattgtataattcttaaactttggtaaaggagcatgttcaaagggggaaaaaaaggccaaccagattggcacgtttcagttctttctgtgactttagacttttattccaaaggaatccattgtctttagaaaggcagccaaggatgtgcctgtgtatgtttgtgtaaaagccactccattctccataaatagcttcagattatggtcttcacttcaagaagacattttagaaagggcttctctcactccattgacagcaacagtgagcgtttgtacagggctaagcaagttacactttcccatttgctttttaaacaatcttataagggagttactacagatggcccccaacttacaatggttcaacttatgatttttcaactttataatggtgcaaaagtaatatgtatttgtgtagaaaccatatagattaaactatgatgttaggtgtattaaatgcattttcagcttataatgggttgatcaggagcaacccattgtaagtcgaggagcatctgtagtctgttgatgattttctttgttttgtagagggaaaaaaatggaaacaagagtgcttgaatgaccaacccaagaccatctagtcagtatatggttgtaggtggtatttgtgtctagaccctctctcccttaatcagttttttttgttgttgttgttactttgaggcccaaatgcaaaagtcatttgggttatcccacattgcactgctggagaccttaactggaaagattgtgtttttattaccaattgctgcatagcaaaacacctcaatggtagtttttgacagggcatgacaggaatgagttatttctgcttcattatatctggggcctcagctgcaaaatttgaatggctgggagatggaatcatccagagacttatcacatgcatggtacctggactgagatgaccagaaggcagaactcatctgagactgttgactggaactctcagatatgccctctgcatgtgacttgagcttcctcatagcatggtggtctcggtgcaattggatttcttatgtggtgcttcaggattctaaaggagactgttccagtgaagaaggaaaaagctttatggcttttatgactcagtctcagaaatcacatatgatcacttctgccatacccgattggttgaagaagtcacaagcccagccagattcaagaggaagagatagataccacttcctaatgggaagggtgtgtcaagaatttgaagcctttacttacactcacaagaaactgtttctcttctgactagattgcccaatgtacagtgctatctagaagaaagtaaatgagcaagataatctctagagatctagagagacttgctagcaatgggctctagatttctccatccacatgagaagagaggcctgacagattgttccatttagttctccctggcataccaggtcagagaagaggtgactcttgccatcctttgctgaggataaatactcaaggcatgtgtgtcttcatgtaagatgagttacctggcaccaggctaggctaggggcttaagtattatatggcttgaggattccctgactgctgctcgtaagtcataacattgtatcaccttggagggacaatatttcctctgccacaatccttcagaataaaggtactaagaacctttgtgagtgaggagaagccaaagaaacagattcctgggaattcaaggtactttatccatgagctcaacaggttcctctccttcaagccttaatcaagggatataagcacagggcaagcagggtatcagaccttacaggatcatctttgttgtaccaaaccattgctaacacactggggtctcctgaaacacagattcactatctgctttattcttggtagtcaaaggtagccccaaataaccttttatatctcatttcccacatggtgctcctcttaccagcactctgaccatgctagatttttgtcattagatcatcatgattaactgtacctgtactggtcagcgggggctaggttgtgttgcaataacaaaaactccccaactcttaatgccttaaaacagcacaaatttacctcttcctcatcttgtgtgttcatcaagggtaggcaggtatctgttccatgtcactggtagtcatttggcagaaggaaagggagcactagagggtcttggattggcattaaatggcctggttcagaagtgacacatattacttctatttacaactcactttccagagctaaaattatggtctaatcccacctcaaaatggccaggaagtacagttttaccatatactggaacacagctagaaaaaaatggcaaattgcattgagtaccacatgacaaccacatgctgtcattctttttttcttcttcacatttttatttctgcatccatgcctgcatgcatctgtgcacccacccacccacttatcaaatgtttagtgagtacccaccctgtgcccaggtatggcttttaggtgccaagcatatggagatagaaatgttctttggagaagttaataattttgctgaagttgttcaaaatctgtccaatttttccaggctatagctggactctccatgaagacagccagtattaatggattcttccttgacaacaagtccttgatggtggagcataataattattaatatttagttattattgagcccttacaataagccagataattttctaagtctaatttaacccacactacagctttgagtggtaggctatattatgccatttacaaatgagtaagtttaacttcacaggggttaagttgctcgttcaatatcatacagctacaaggtggcagaattgagatttaaatttggactttctgagtccaagtccttactcttcaatggctacattacacttatctttaatgctcacgcaatttttttctctaaatcgtagacctggaaacaacaaacagacaaagattatcctctgcagttgtactgtgagggcttagaagacagaaatcatccagtgatttctgatcattggattcctttttgatgaatgaataaaggagggagagaaagagagggaaagaagaaagggagaatagagaaaagcaaagaaggaaaaagaaggaggagtgaaggaggaggagagaggagctgattcttttcacatggaatgcaaatcttgccagtgaggtggtgtgttcctgcgtgagaaggcaggcaaatgcttgtatcctgaggaaaggtgttctgcaaatcgttggcatcactctcataacctgatcatcagctctgtccctcagtctaccagttctgtgcctcagcacgtctcattacgctgaagaggttcttcagtctaccacgtctgaaccaactacaattaaacacacagatgtattcctcctcactcggctgctaaaaaggaaatatttttgaaaaatatgacaagtcagtatcacagctcgaagaaactggaggaaggaagaaagggctacaaagaaggcattaaacagagcttttaaaggtcactctctgattttgtgtgttactttccaaagagatattttcagattaaaaaaaaaaactgtgaatatagcaattatggctagcctctggcctgtgcagttaaataatggtttacatcggggatcaacaacagtcagtgaggcctgaaagcactggctttttctgcagcctgaccctgcatgcccaggtccaatttgttttccacgattactctgtccttatcaaaagaacaatctgcaatcccatgctgttcttatctggtgccggagccttagactgtgtcctatatatcgatataaggcttggagtaacctagattcatgtaataatgcagcttctaaacgttttaataaagaggcctcccttagtgactttcagtctccagcctcacaggtcaaattgctttgtctgtgttcactccttcattggcgagtgtgtgtgtacccctgaatatgcatgtgtgtgtatgtctatgtgtgcatgatcatgcatatgctagtgactactgtgttggcaactttcatcctggagataatgtgtaagtgcttaattgcatttgctatttagcaattaaccacttgcaggtgcaactagttgtgagcacagttctgcatgtgtgactaattacaggtgtaaaatattcacctcttcagttctcatcatggctcagtggggctcaatgctaattctctcttgccatctgggttcagactcatccgctggccagaggatctcctcaggagaggggtcatgttggggaggcagaggtgctgttttagagcaagaagggaaatggaagtgaaggagagcaggacagagtgcgtgagagactgcagggagtcagaagcttagctatgagcatcttccccaccatgctgcctgtgcaaagcagaggactagctgtgttcttggacctccatatcaggacctggcatctccttggttggagccccctgtgaggggtgctggctttctgaaggatctgcagaaggcatctgtctctctccttagaccctttgcataggcagtgacccaaaacctcatagacaggtggttgatggaagtctggacaagtttttagaaagtgtttactctctcagcagtattgccaccatgctgtgtgatggctgcatctttggtccccgcaattcatctgcaaagtaggggtgacaccctcctccaccttcctagtggaactccagggtacctcaagggttaggtgaatgtggacttgcctagtgaagatcaaatgctctgtcctgcaagggatcagggtaactcttgggtggtcatagggagtttctcacttgtaatattttcacagtaaaagtcactaaaggggtaaagaggatgaagaagtaggaactagagtagaacccctgaccctgagtttcattcactgtgtctgtgcctctttgcattgccagtggaaagcagaggtctgagaacagctttttgatgatcctcttctgggtgaggatcatcctcttggtggccccacagctgtgggctccactgcagctcggccgtcttccctcaccactgatcccaccacccatgtgaacagtgaccctgagagtagccatctgagagcccctctccacagcttgaagtctggatgggatggggcttcagagaagggagaagtgggagaaggcagtgtccaaaggaagaataaaagccaggatgtggctgggacaacatcagaacaaacagaatatttaaaactcttcaagaagcctttctggaagatctgggataggggaatcagctactcttctaggccctagagagggaagggccctcacctgggccccagagagggaagggccctcacctgggccccagagagggaagggccctcacctgggccccagagagggaagggccctcatttgggacccaaggaggtcagagctcccagcctaggaacttgcactgagccatccttgccacattagagggatcacagcagatccaggtatgtgcctccagtgtgtgtgtggtcaggggagtaatggggggaaagccttgaagaggcctagcgaactgagtgcgggggctaggggcaagccagagaggagggtgtgaggatgtggcctgaggcaaagggagagatgaggtagcagaggtagagtagttatgtcacagtccacttcatggctggagttagagagcttggtggcatcaaaaaaagagctgtggatgagtgggagaagctgggccagtgtggaccagcaccctgatgtaaggttttccgttgagtactttttattgcacaatggaacttggcttaccagttcctgactcttggtttctgactctggaccactttcagtagactaccctacaagagttggcttgttccctgggacctctggtgtgttttgttttgttttttgagttggagtctggctctgttgcccaggctggagtccatggtgcgatctcagctcactgcaacctccacctcctggtttcaagcaattctcctgcctcagcctcccgagtagagtagctgggactacaggtgcgcaccaccacacccggctaatttttgtatttttagtagagacagggtttcaccatgttgcctaggctggttggaactcctgacctcgagtgatctgcccacctcagcctcccaaagtgctgggattacaggcgtgagccaccatgcccggccggtgggctttaatggagtgcagcagagcaattaaagatggttttctcttggaatcattgtgaactggtcctttatactttatttcaccagagattcaaaagcaagaaggacgtttctgtatctactctaccactggctacttgtgcctcagtttcctctctctaaaatgagatcataatagaacctatttcctagggctgttgtgaggactaaatgagatgagtaacatgcccagcacattcgatggacagagaaaaccctcactaaatattagctactcaagttactcctgttttgttcttttagttcactgaggctcctttcttccaaaaacatctgcctccacctagattgatttgagaggtggtgtcagtgttatctgttggctttagatagcagaagcccataattctgagatcagtacagtttaagcctgaatcactggcttattcataatagcaaatgactttggagcctgctgggaaaaccctggtcaggagtcacacatgcagaattccagccaagcagaaaacatgtttgccccagatagtgactgtcagacacagatttcactcccaataacttgggaatgaaacacaaataaggaagtctgcatttcacatgtcttcttagattacaaattcaggcttagcacgttaggtcaggatgtgatagctcagatgccagctcttcagctttattccacaagcaccgggagtgactcttttccagatgattacagaatgtgagtgctggaagaatccctcatgattattccatgaaaccaaatttttcacttgagaaaagtggtgacagggtattcagtgaatttatcaagggtgggccaagtaggggtgctttgtctctgagatggttccttttaagtcattcctgtcaaatgcagcatggcatagacaaggctttcttaattgccattcctcacaaatgagcatgtgcattgacatatgtcttgtctgtgtgcgtggcatggaccatcccagccaacatgcggctgattccagatgttagcttgaggggccaactcaggttcagcatcagccaaagcacttggaaatacctaagtgatgtcatgatcccatttacgcatctggaggatggaggcctggaacataaaactcttattttccagtccatattggaccttagtctagcctgtgttcttcagactttgcggccaaaaatgttctctaaaatgtcaggttactattataaacttttgatttaaagatattaacacacacacacacacacacacacacacacacatcccaaacaaaaacaagagacctattttccatcactggtgcatcattcattaaaggaaggtcagcttaacaccaacaaaaaattttgtaattgtaatctcagaatttaaacatttaaggattcaatatttatgaaaattattgcaaaaattcaatctttgtgaaaatctcaccacattgcatttagcccttttgtgttaatagagtcttctcacctctgtcagatctgagtatgaaaacaactggactaacctgaatttattaatagaatgaagggcatccctttcttaccttacacaacccatcaagatacttacacagagggaactttgaccatgaaatactgggcactcactattcctcaaatgttagcctatcatgcctaaataatagtaataacagtaacaacaacaacaataataataataattactaacatttattaagcatataatacgtacaggcattgtcttaagtatattgcgtgcgttaatttatctaatcatcacagctgtcatggactgaattacgtccccttaaaattcctgtgttgggccctaaagccctgtagggcctaaggctctaatgtcctctgatggcatttggttataaaacctttaaggagataattaaggttaaatgagatcataaaggtgggactttaatccagtgtctttataaaaagaagcaccagagtgctgtttctgtacatgcacacagaaaagaccatgtgaggccaggcacagtggctcacacctgtaatcccagcactttgggaggctgaggctggcggatcacgaggtcaggagatcgagaccatcctggctaacacggtgaaacctcgtctctactaaaaatgcaaaaaataataataataatcagctaggtgtggtggcacgcgcttgtagtcccagttactctggaggctgaggcaggagaaccgcttgaacccgggaagcgcagattgcagtgagccgagatcacgccattgtattccagcctgggtgacagtgcaagactctgtcttgaaaaacaaacaaacaaacaaacaaaccatgtgaggacatagcaagaaggtggcatctgcaaaccaaggacggaggcttcaccagaaaacagccctgctgataccttgatcttggacgcccagcctccagaactgtaagaaaatgaattatgtttaagctacccagactggtattttttttaatggcagcctaagcagactatacaacagccctatgggtatatacttttatcagctccattttgctaaagaggaccttgaatctcagagttgtgactagcatgaacaaggtcaaatagaaatcatggagcttggccttgtttaattctcagttggcatccattaagaagcaggccttatgttgagatgggaggaaggcccaagtccttgatctcctgtctgagccagtagctctgtccttctgagccactgtacaagactctgttgtggaataactgccaggccagaggggctgttattacaaaaaggaaagactagaaagtcctgaactcagggctgggcacaaaggagggagctcaagaaatgtgaatggaatctgctgaacaaattaatgagcagtattgtcattggcattcctttgtcttcaacttcatgtgtgcagtcacagtcctaagcagactatatattttttttcaaaaaagagcagttagcctaatcaaatgagtaaacataagcagaactaatgactgttgggttctataaattgtgtcttgaaatgctaacggccctaataagagcatccacagtaaatgaatgcaccattaggctgaaaacaggatcatcaataccagaatatgcccactcctcctccttccccatttattagagttggctgcccatgagagatacatggtacaagtattcaggtaaccctatcatgcggtttttacttgtattactcacagtgatttgtatgtatagtaatccttccccaaccacagattctctttttatgaaattctggtatccttgaatttatttctgtatacttggagaatttctgttctaggatattcaggtttttgagtcactgctgttgggtataatttagaaatagagaaactggtgggtggtaggagaaaagagtagaaggcagaacaggagatgtttcacaatgcagccttggcagaagacctgggagtgccttctcctgttcacgtctgctctgggaagggaattgagatgtgctgacctaagctcagaactctaggccagggactgaagagctctgctgtctatcatgctctatttttaagggagctaagaattggacccctacagagctcttttgagtaagttaaataaagattcctgcaagtgtttcaaacttcccgcttactgtgtctctggcaccacggtggaagtggtgaagcaggatcacaggtgacataaatcagaaaggctctgaatatttgattggaggacaagatagggaggaaagtgaatttactgcaccagagggggaacattacaaatgccttattgaaactgtggagagggagattctgaagatttttgtattcaaggctagcaaatgggaattaactaacatggaaatcattattactataacttatacaaaacgctgttgatattctacttatgtgtgtgtgatgtttttatattagaaaagactttgcttttattaaagttacacatttctattgacatttcaatacacacgcctgcacacgcacgcgcgcgtgccacacacacacacacacacacacatatatgtgaatgactcaaaataatccagaaactactattgttaaatttaggtcaacatcactttagagctgtatctataagctatcttcactgtaactagaaagatggatggcaagtcaaaactaattttagaaagatgtgatcacggtaatctttaacacattaatttaattgtgttaaatgtaaaggaagaaaaataaatgaatataaatggaaggaattgctacatttgataaatgcttcttcaccacaagatatactctttcctggaagattattttaagattaagaaataattttatagaaacaatgagatttaaatcactattttaaaagtcacacttcgattttaaatagtaccaattaaccccttgctatgaaagatgaggaagttggtatacttgactatttctaatatttcttcacctttccccacctcccaatttttactacttttaatttctttttttattttaaggtttataacttgttttggttttatttatgtatttaaaagaatgtaacaattcttggttgctttatcacaatttctccttaccaaattcattaatttatctcttagttgattgaattttgttatcaaaaaactttcccctctagaaggactctctcccttccctgagattctagtacattcaggagaacctcagcctatgaatatagctatagagaagtctgaagctaacctatgttttcttttgaggtgatttatttattctatttgctggctgaataattctttctttatctttgaaattcaacaatttcaccaggctatgcctttgcccctgctgattcttccttcattttaagaaatttttttattataagctctctgaatatcttttttgtttgtttgttagtttttgtttttggatagagcctctaacttagggatgctagtaatcctccatatactattgtgagccgtttctttgttcagaacttattttccatgtattttctccatgttaatagttcagttttaaactctatcaattatttagccatttcttttttatttactagttttatctgtcagtatctgcagagatctgtcagtatctgcagagaatttgtaccaggactcctggggatactggggatctaagtcccttagacaaaatggtataatctgtgctcattctcctgtatattttaaattatctctagattacttgtggtacctactacactgtaaataacttatactgtattatttttattgttgcatttaaaaaatgtttttgatccatggtatgttgaatctgcacatgtggaaaccatgaaaacagagggccaactgtattgttactttgatccacaatttgtttcctgaactcggcaatctcccttttatatattattccattatatttggcttttgagcttttgtattattgaattcttttggaagttaaatccttacggataactttcttctatttcttggggtacatttttttccacgtggagctctttttctgtctttttcatgctatgctgctatatttctttcttgttttttctaaggcaattgagaatgaatttgcatatttgccctgccgtttcttttcatttgtgctcacatttaagggcagctctgtacagacctcttgtttgctctaatgtgggctgggtaattcctccttgactctgcccactttgtctgaggttcatttgtctttatacccaagccacagtttaattgcctggatatgtctcctgtctccctttctgtaactgtggaggagggctggaaagtacagatgcatcggtgtacaggctttgatgcactatcactgtcttctctctctcttagactttgttaaatactcgcaaccagggctggtcttccttggtttgaggtagtggtggggtaaagccttggtattcaaattgttttcctgcctcagagtggagatctgcagtttatgtttccatacgggcatcagccctgaaaagaaaaatatttttaaaaataccctctcagcatgctcctttccagccctccagataaaggggtctagaggaatttctcagaactctagctcactagtgctgctgccactggccccatggacctcaccccttgccccagtgcaaacactctcccctggctgagcacccctactgagggcctgctctttgttccttgcctgccccacattttctttcaacttgaggcctttccaatattgatccctctgcctggattgcacctccctttcttccctcctcattccctaagtcagtctcacctgacccgtcgtgtccccagggagtcttgctgacccctccaatgagacagagtccctgttatttgcatgcacagctctctgctccccatggtaagtattttgctgcttctccaggttgtggtgtgtggttacacttttccaggacttccctttgatgggtaaatctagaagcaggcccatttctagggctgcttatttccataatccttctctacctgcgactccctcagcccccacttttttttagctgcattttagaaactttaagcttaggtcacctgtgaggaaaaattggctttccttttttagttttttaaaggtcacactctcaatgagcttaatgttgggaccaaaaagacaacacggggggccagggaagactgtgatttatggtgctgggacactagcccagcactcagggggtgatccagggagcaggcgggctgctcttggagaagatgacggcctggagtctgttttcagggccctgctctgtaggagtctctcatttcaagccataggctgtggggccttggctttgcctctgagagagccaaccacgcacagctctctgtgcgcaaaggacacatgctggtcccaggacgacattgccaagcctccggtcagtatggcaaaggcaagtttgtttcagttcttgtttcctgagaaaaagaggttgaagcaagacaaccatgccacaaatactgagtgagcatctgctacgtgtcaggccctgtcctaagcattttgagcacaagtacaaggtgatccctgcacagcggaagggtctttcctagtgctttggcttccaaggtaaatggcctcaaaatccctggggctcacagccttcaagtgcctgcctaaagggaacagagtgtgtagagtctgaaaggggaggagagggggagccttgttgtcttgtctcaccctctccacactgtgagttccctgagggcaaggcctgtgtcattcacctctctactcacagtgaggcaggaaatggaacaaaatctcacccacttccttattgctgtatttgcttccctgggtgcttgaattccatcccttctgacctaaaccacactgaccccactgtcacagcccctgaatactggatttctaaccctcatttccctccagtgtttgaggctgactgatggactccccactgccagctccaccagccctggcccatcctcatgtgtcacctgccttgtgagcttttctgaaagcttctcctgagagtgcacttgttcccaacaggcatctcaaagtccagaatgatgtcctgcctggttggaaggggtcctgttccccagtaatccccattaagaggttgctagtctgcagttcttgctctgtctgtttctaagccaaaacagcacaggcagttggctgccctgctgccaaagcaaggcctgggaagcaatccagcctcatcctgatgttagacgagcaagtcctggggaaacagatagatctcatcctggcctcagaggggacagctaaattgtcaaacagcacactaatgggggctgctgactgcacaggtatctctgggttataaatgcccagcaccagagagcctcctaagtcaccagaggacaactttatgatccagaaagtaaagaactggaacaagatcagcttgtgacagggatcaattgatcggggactggagagagcttggcccgggagttcagaactccataaaacttccaagctcagcactttcttgggggacctgcactggccccagtacaaggagcccagaaaactgactgagagctctggagggatgtacagtgttggcctgcagcatagatgagggctaggaaggagcttccctgaacttccccagttcattctgtcactactctcagcccagttgattatgagcctcctttttggaaaagatttcagtggctccccatcacccttaaatgtcagactagtctccttggcatggcaatcaggacttcgtgagatcttaggttgatgagcttgccagcttcattcacatcttacagggtttctacctctgtgttccagccacatttaaagtcttgggtttccccagttgtgatgtaaactgtcacctctgggctgtcatacaagctgttgatttctttagccttgaaggccattcttccccactttctattcatttggatttctttcactgaaccttcaggttttagcccagatgccatctcttccatgaagccctccggggttaggtaccccttccatgtgcacataatacgttctgtcatggcacttgtcacacagtgtatttgcatcttctgtttacttgtctatctccccagcaagatctttgtggggtggagtgggaaaggatgtttatcattttatttattgttttattcctaagccatcatgctgcgtctgacacatggagaatatttgttgaacaaataagcgaatgaatgaataaataaataatatgataaatatatgaaatatcatgatagtgggaaaaaagttggaccctcccagggcatcccctctccctgtctgcactgcttttgacccctgcccagcaggcatctgaagctcttgagatacagtcatcacccactgatgccacatccccatcttctgtcatcccgtgcctgggaatgttcttcttcctcacagtacttccagactcctcaagtcatagcctcttccacgaaggaccctggaatttcttgtctggcaaaatacccattgtgcctgccccaccctcaaggtctctcagtattccttgcatagctctgtcttcatttattatttttttagaactgaggtcttactatgttgcccaggctggcattgaactcctaggctcaagtgatcctcctgcctcagcctcccatgcagctgggacttcaggcacatgccacagtgcccagcctatatagctatatctaagcactttctttgttacattttcattgcatattttaatgtttcattatggttttctaaaactttttattgagataattatgtattctcacgaagttttaagaaatattaagaaaaacccatttacccttcatccagtttatgctaatggtaacacctcatgtaactatagtaccaaatcataatcaggaaattaactttgatacaattgattgactttagtcagatatcaccagttttacatacacttgtgtgtgtgtgtgtgtgtgtgtgtgtgtgtgtgtgtatttagatctgttcagttttatcacatgtagagttgtatgactaccgccatagtcaagacacagaacagtttcatcacaagcttccctggtgatacccttttatagccatggccagcacctttcctccttcttctccctgatcactgacaatcaatgtgttcttgatctctataattttgtcattacaaggtgctgtataaatggaatcatatagtatgttaccttcagggatgggcttttttttcactcaacataatctcaacctggatggatctcatttccatacaagttgttgtgaatattaatggtccattccttttattgctgagtagcattctatggtatggatgtactacagattgcttcaccattcatccattgagagacatttgtgttgtttccagttttgggcaattaagaatgaagctgctataacattcatgtacatgtttttttatgtgaacatatattttgttttcatttttctagagatgaccaatgagcatatgaaaggaagtttaacatcattagccattagaaaagtacaaattaagacaaatgcaaattaagaccacaatgatatatcactacacagcaaacagaatggctaaaataaaaaaaatgattacaacaaatgctggtgagaatggaaaaactggattacatccattgctagtgggaatataaaatggtacaaccactttaaaaaagaatatcactgtttcttacaaacctaaacatgtgcatatcatgtgacccagcaattgaagtcttgataattttaattgtattttaaaacaagtttttaaaaatgtatatgtaattcatattcatggtagaagtagaaatacaaataaacataaagaaactatctcctataatactgctatgtagacataactactactaatatattggtataatgtgcatgtattattttgataaaaaattatgccataatgctttatgacttttttttacaatatatcatttctctccttcatgtgaatggatgtccatgctatcatgttaacatttgccttatattaaatttagcaacttatttcactaaacttagacatctaggtaatttcaatctcctaataataatcaacaatatctactaattaggttccttatttacatatttttggtaacttaatgaataatattcttttatttatttatttatttgaaaacagggtatcactctgccacacaggtgggagtgcagtggtgcaatcatggctcactgcagcctcatcctcccaggcttgggcaatcctccaacttcagcctcccaagtagctgggactgcaggcacacaacaccacacccagccaattttttgtagagatggggttttgccatgttacccaggctactcttgagcacttgggttcaagtgatctgtccacctcagtttcccaaagtgctgggatttacagccatgcgccaccatgctgggccataatagataatattcttaagataaatccaacacgtagaagttttggattaaagtttttctcatttttaaggcttttaataaaaattcccaatggctgtttagcaatgctatactgatgagcccttcatatcccagctgcccatgagagtgactgcttcttcctagtatttccaacaatgatcattgtaattcttttgattatttgttagtctgatagctgaaaaacgttaaatcttagttatattaatttggatcttaaaaattgattgccagttggactaaaaaacttatttgtatttcttctatcttgaatgcctgttcatattctttacccatttttctatttagttgcatgaataaacctttgtcatgtatatttcatttcttttgagtgtcataatttgttttaggcctgtagttttttagcaaaatttaacatttttaatgtagtttgatctatcagtctttttccttatgtgcttttccctttggttccttctttggaagttcctcctcactctaaagttgtataaatggtcatctgtgttttatcatactacttttatggcacaatttttaatttaagtatttaatccagcagggattcatttagggattggatataaagtagggatttagcttgtttcccagtagctaacttgtgtctcagcctcattccttgggaaattgatccttcaccactgattgaaaaggtctcctttgttattgtctatgtttcatcacttctcaggtctgctgtctctcagaaatgtctaaagccaccttattcagcttgtgaatagcctgcattctctctgacattatcttaattttccaggatatgtctggggtctccttctggtgatttttcctggtgagctcatctgtctgtaggcagaaacctttatctttaattcagtaacattttattacactatgtctttcatttctcttctttatttgtggtacattctattttaggaatctttattgtctgcctgtggttcttcattctctctgttttccaaatctttcaccttctgcccaattgttttaatttctttcatatttgctttctacattactgacttgatgttctgaagcttcagtactactctttcctccctgcaaagtggctttgtttctgctataacgtttttagtttccttactattcttccgttttggataaaccttccttttcatctaaacctgcttattttcctctcttgtgactttctctccctctgacttagaggtcatgccttcttgtgcactcctgaaaaagcaaacagtttcctgaatttttcttctcaattctgcagtatctcatttttagaggtatgctcttcctctcacacagtagaatggtgttcccattcctgcagtagctggtattttccctattctattttaagcaaaatggactttgctgagacccagtgaggttttataggcggggttaatagcttattctaggactccatttctgctctctttcagggtgatttaattatcttctcagtttgcaccagctgtggaggagatcaatgtgtgtaggtcttagttcaatttctcatacctgaaatgctttctcttgatgtatctctgctctgctcaggtggcacggcagatctaaagcatctggttcttcagttcttctggtctgatgcaatatgtgaaaaatacagtttcctgcatgcaccacttctgggtcatgactgtctttaccccctctcacagagtgcttttcccataggaccacttctaggttctcagaaggcattgcaccatttctagtccttgggtagctatgctgtgtatagatgttttctgggcaaggaagagaatgtaagtcatgaagtgaaaactttcttgactcacaacatagcccagttcctcattggtagtagccctgggtctctaaggcagggcagaagctggactttattacctttttcttcatgcaatctctgttttaggcagtagagttaggatgagcatgtactaagtctggggaggttttctcaaaccatctctgatgcagataccacccattctgacactgggttatttgtcagtattaaagataggttgttgtgaagtttcaacatttttctgacactataataaatttgctaaaaaatgtgtgaatgctttggggataccatccccattttgagctagaaacttcttaatatattgcgttaaatcatttattcatttatctgtcttttcctccaccatttgtctgtgaggctttgaaagaattataattcaccactacatcaacagtgcctaacacagtgtctcattcataatatttgatagatttttaaaatttatactgggatgagattgccaagggagagaaagtagagagagaaaaagggatcaaggataggcactgggctttgagggacatgatggcgacaggaggaagaagataagccaggaagggaaacaaagaagtcacagtcagagaggcaggaagagagcagagccggaagcacaaggctgcacaggctgactgggctgggaagacaggtccatggcatcagtgtcagccaggtggctatgcagggtagtgagtcaagtaaacccgatacctggtcagtcactggtgatggttaatttcagaaccatgatggagacaaccccttccctagttggaaggctgagtgggttgagaaagtggaagcagttaggcatagatttaaaaacaaaagggaaagaaaaaaagagagcttgagagaaaatcagcatgccggaaggttttttgagttactgttgttggaatggggaagatttgatcagcttcatatcttaagggaaggtgattgtgactagaaacagcaatttgccagacagagaagggatatttgaaaaagccattctgagtctaatctgaagaggataaaatcagatatgaggagagaagggatggtctgaaaattccttgagaacaagggctgcttcttaccagaactggtgagggccccaagcaaggaaagtgcaggtgacttggatgcagaaatactgtggactgtggtaaaaatatattcaggtgagaaggaaagacggtgagctgctcactcctcacctcctgcatcttagtaaaggaggaaggatcatcttcagaggagaagaagggctgggcacagcccaggctttatgaagaaggaaaaagaaggatgagaggattgcctggcagctcccaggcccaggctaggagcagaagaagcttgtagacatgttatggggcagtactaccagagagcctataaagcgtcttgcctcaggtggccttgtgactctgtggtaacattgactggctttctgggaggctaaggaaagcttttaaaagtggccttgattaagccaggaaggaggatctcccttggaccaaggtctgctctttctcacttttcttgcagggtattgctccatacttctgtctccaaagatgttaagtacataggctgcaggcacacaatgcactctgtggagatgctccttgtcctgggtcctctggtccccaggctggtactcaccagacatggaaagtagttctctcacccctatgcatcctgcccacctcctcactggaaatttacttctccaggaactaacttgaatctttcaactagactggcttagcactgccagctggataagaaagctgcatgtgaaaaacctagctttgaaatggaaagatagcctgctgttgaaaaatgaggtctctcttaattagagaattaatcaattaataaatacagcatcttttgacagacttctgtgtgtcaggtgttgacaccatagaggtgatgaggcatcatctctgcccatgagaagggtacatatagctcaatacaggaaactgacagaaagacctttaagagggaaaaaaatcattccatgggggaaatagtccatttaaatgagaggcagagggatagattaagtgacagctgaagccctatcccaagcaagtcattttattataaaacaggacctgcaaattggcttttctttttcgtattcttcctcaccttttcaaacaaataattaatcatgcaaaaataacgcaacacattctagaactcaattcctagtactactctccagagtacttgaaccgtgtcctggggttggcattgttacaaaaactcttgatgagaataatgcctgatattgtgcaattgtgtgcagttggcccgtcttgcatggttctgtgtatgcacatcaattacacacatttgttataatttgcctttttaaaaatcacaccttctatttcaccccaagaagataaatggatcctgcctcagtcccagttccattgattttttgtggtcctatggtgaagctattatcaacactaatctcaaaccctgccaggagccaggaaggccttagaatacagaacaccaatttctgcaacttccaccttatttttcttttcatagacttttgttctgactcccctcctcatctcattttcaaatatgatttgattatcatcatgtgaggtctgttcagctggctcggagcagacaccttttccatgtatctggcctggaggaggagggtgtcagaggcctttcctgattgagtgctgatcctccttggggcagggtgttcttgcaactttgaagactcactccatggcctctgtctccagcagtgtgaagcatgaacagccaggcgggggagcctgcaccttccatcttgcagctctccaaattacttttctggggaggagaggaagaaaagaagaaatgggggattggaatcaagaggctacaaggcatctgggaggttgttaacagtgagctctgtgtttgaagatggggtggcagtggcgatgtgtccagggcttgcagggataaatgtcggctggtcccctgcctccatctcccagggctgttctatagcctcatggctgtcaaacactcccacctgctgctggacccatgaccacactcaggactttaaaagatcatatgccaatttaaagtattgacaaattttgagaaggtaaaacattcagttcattaaaatatttccaaagggcatatagcaaagccttccctcaccactaaccccaggcccaatggcctcccagagcaccactctcactggcttttgtggaggcttccagggacagcctaggtgtcgggcatgcactcagttcttccctttgctgctgctgctgctgcttccttcttgcctcctctatgttatccttctcttcctcctccttctttcctcataatgtatcttatagatgattccataccaagactcataaacctgcctcattataaagagttgcatagtatcctcatgtatggatgtaccataacttatttaactagtctcctattaatagttgttgtggttgttttccatctttttgtcatcaaaaagaatgctgtccaaaagaactgaaagcagagacttgaacatatcatttgtacagcaacattcacagcagcattattcacaataggcaaaaggtaggaacaatccaactcttcatcaagagatgaatcgataaacaaaatgtggtatatatattgaatggcatactatccagccataaaaatgaatgaaatgttgatgtatgctgtaatatggatggaccttgaaaacaatattcagtactgacatgttttgggtctatgtccccacccaaatctcctctcaaattgtaatctccatgggtccagagagggaggtgattgaattatgggggcatttattgatttgcatatattgaaccagccttgcatcccagggatgaagcccacttgatcatggtgcataagctttttgatgtgctgctggattcgttttgccagtattttattgaggatttttgcatcaatgttcatcaaggatattggtgatattggtctaaaattctctttgttggttgtgtctctgcccggctttggtatcagaatgatgctggcctcataaaatgagttagggaggatttcctctttttctattgattggaatagtttcagaaggaatggtaccagttcctccttgtacctctggtagaatttggctgtgaatccatctggtcctggactctttttggttggtaagctattgattattgccacaacttcagatcctgttattggtctattcagagattcaacttcttcctggtttagtcttgggagagtgtgtgtcaaggaatttatccatttcttctagattttctagtttatttgcatagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcactaattttttgaagggttttttgtgtctctatttccttcagttctgctctgattttagttatttcttgccttctactagcttttgaatgtgtttgctcttgcttttctagttcttttaattgtgatgttagggtgtcaatttttgatctctcctactttctcttgtaggcatttagtgctataaatttccctctacacactgctttgaatgtgtcccagagattctggtatgttgtgtctttgttctcgttggtttcaaagaacatctttatttctgccttcatttcgttacgtacccagtagtcattcaggagcaggttgttcagtttccatgtaggtgagcggttttgagtgagattcttaatcctgagttctagtttgattgcactgtggtctgagagatagtttgttataatttctgttcttttacctttgctgaggagaggtttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaaatctctttgtaggtcactcaggacttgctttatgaatctgggtgctcctgtattgggtgcatacatatttaggatagttagctcttcttgctgaattgatccctttaccattatgtaatggccttctttgtctcttttgatctttgttggtttaaagtctgttttatcagagactaggattgcaacccccgcctttttttgttttccatttgcttggtagatcttcctccatccttttattttgagcctatgtgtgtctctgcacgtgagatgggtttcctgatacagcacactgatgggtcttgactctttatccaatttgccagtctatgtcttttaattggagcatttagtccatttacatttaaagttaatagtgttatgtgtgaatttgatcctgtcattatgatgttagctggttattttgcttgttagttgatgtagtttcttcctagtctcgatggtcttttcattttggcatgattttgcagcagctggtactggttgttcctttccatgtttagcgcttccttcagaagctcttttagggcaggcctggtggtgacaaaatctctgagcatttgcttgtctgtaaagtattttatttctccttcacttatgaagcttagtttggctggatatgaaattctgggttggaaattcttttctttaagaatgttgaatattggcccccactctcttctggcttgtagggtttctgccgagagatctgctgttagtctgatggtcttccctttgagggtaacccgacctttctctctggctgcccttaacattttttccttcatttcaactttggtgaatctgacacttatgtgtcttggagttgctcttctccaggagtatctttgtggcgttctctgtatttcctgaatctgaacgttggcctgccttgctagatttgggaagttctcctggataatatcctgcagagtgttttccaacttggttccattctccccatcactttcaggtataccaatcagaggtagattttgtcttttcacatagtcccatatttcttggaggctttgctcgtttctttttattcttttttctctaaacttcccttctcgcttcatttcattcgtttcatcttccattactgataccctttcttccagttgattgcatcggctcctgaggcttctgcattcttcacgtagttctcgagccttggttttcagctccatcagctcctttaagcacttctctgtattggttattctagttatatattcttctaaatttttttcaaagctttcaacttctttgcctttggtttgaatttcctcccatagctcagagtaatttgatcgtctgaagccttcttctctcagctcatcaaagtcattctccgtccagctttgttccgttgctggtgaggagctgcgttcctttgcaggaggagaggcgctctgctttttagagtttccattttttctgttctgttttttccccatctttgtggttttatccacttttggtctttgatgatggtgatgtacagatgggtttttggtgtggatgtcctttctgtttgttagttttccttctaacagacaggaccctcagctgcaggtctgttggagtaccctgcagtgtgaagtgtcagtgtgcccctgctggggggtgcctcccagttaggctggtcaggggtcagggtcagggacccacttgaggaggcagtctgcccattctcagatctctagctgtgtgctgggagaaccactgctctcttcaaagctgtcagacagggacattttagtctgcagaggagactgctgtctttttgtttgtctgtgccctgcccccagaggtggagcctacagaggcaggcaggcctccttgagctgtggtgggctccacccagttagagcttcctggctgctttgtttacctaagcaagcctgggcaatggtgggcgcccctcccccagcctcgctgctgccttgcagtttgatctcagactgctgtgctagcaatcagcgagactccgtgggcgtaggaccctccgagccaggtgcgggatataatctcctggtgcgctgttttttaagcccgtcggaaaagcgcagtattcgggtgggagtgtcccgattttccaggtgccgtccatcacccctttctttgattaggaaagggaactccctgaccccttgtgcttcccgagtgaggcaatgccttgccctgcttcggctcgcgcacggtgcacgcacccactgacctgcgcccactgtctggcactccctagtgagatgaacccagtacctcagatggaaatgcagaaatcacctgtcttctgtgtcgctcaggctgggagctgtagaccggagctgttcctattcggccatcttggctcctccccacatctgatggttttataggcatctggtatttctcctgctcactcttctctctcctgccaacttttgaagaaggtccttgcttccccttcaccttccgccatgattgtaagtttcctgaggcctccccagccatgtggaactgtgagtcaattaaacctctttcctttataaattaaccagtcttaggtatttctgtacagcagtgtaagaacggactaatacaagtactaagtgaaagaagccagacacagaaggacaaatattgtatgattccacttatatggggaagaagaggcaaattcatagagacagaaagtagaacagaggttactacgggcagatggggagttattgtttaatgagtacagaatttcgtgttggggatgatgaaaatgttctggatatagatagtggtggtggtgatataatattgtgaatggatttaatgcaactaagttatattcttacaaatggttaaaatgataaatatttagttacagtattttgcaccataaaaatgacaataaaagattgaaatgttttgccaaagcctaagaaagagaatgatgcaaagtagcacatacctgtaatcctagctacttgggaggctgagagaggaagattgcttaaccccaaaagttcaagtgcagtctgggcaacatagtgagacactgtttctaaaaagagagagaatgagaggagaatgctgcagtgaacatccttgtacaatagagtgctctgtaggaatccaaatatatctatacggtacattcccagaaatggggttacaaagtgggaaagtgtatgcattttaaattttgatatatgatgccaagtttttttttttcaaaatattgtgctagataatgctcgaacccatgaagtatgagggttgaccattagctagtatcaaatattttgatctttgccaccccgacagctgaaacatggtacccttgtagatttaacttgcatttctcttctgggcttatgctatgtgaatggaggtgagacccaatggatcaggagtcactttggttccagatcaaggcagaaacaggtcaggagcagcctagaggcaaaaggaaggctggctgcctgggatatgaaagatctgatttagtctacctccttttcagtttcccactacctgcctcaactttatcatgtgattcataggaccatggaatagcaccttgaaagaggacctgagggtcccagctgcctaacgcagtagcaattctctagacactcccttacctcccttgcagagcctgggtacacagctaatgacaggaagttcactttttttctgattgttggaaagattgtttcatcaaatgcaccttctggtggtctccagcccctaatcttagactttctgaagaaccagacactcttctgttagtagttcttaggccaattacctgcaaaaataaagcccgaaataatggcaagtggattcatgaataaatgaatgatgtgcaaactccagtcactgttgttcgtattatcttgtggcttccataacaatacagaactctttggaagggatgtccttaattcagaggatagtgagtgggccttttctgggatgcagactcaccctaggtcatggcaggaagtgcatattcacctgcacacctccatctccttcacatattgtgctgcaaagccaaggctcccgatttataatttacatttgtcctgtataaagagcaccttctcttggcttcaatccagaatttcaatccccacgtgatcagtctgaatcttaactccccagcattttagtcattcttccagctttctgtcacttcctgatttgatatacatcttgttaaatacttttcctctacttcatggattaagctgttgatcaggtcaggacgaagggcagcaccaggcgatgacatcccatttctcagggatgacgggacacagttatttaacagaattattactaaggggatggccgaggccccagccagccttcacatccgtgacaaaatcatgaggggaggctcaaatgctctgctgaaatcaggacaactgagattgtgggaggaggcaggggacaaaacaggaaagctactattggcgcctgagctctaactaccaaggaagaactagatggttaactagatgggggcatgcagggcaaagcatcagcttggtacatggaacagaaagaagagaggaggctggttgcattcagacacgtagatagaattaaggaataatcataacaaacatatacatagtgcttactatgtgtcctatgcacacttacaatgtgaactcatttgattcccaagcattcctataaggcaaatatcattattatccccattttacagatgaggatgctgaagcacagagaaaggttaaatagtttccctgagtcatgctactggggtttaaacctaaacaggctggctacagagtgtgttcttaagcatttcactctatggccttgaaaagctcagcctccatgatattatcaaatgaatttcaaagaatgcactggcatgttcagccagcacactctttgaaagtggatttgaaacacgctagggattctagttcccagggcagtttctttaggaccagcagtcccttgtggaatcttctctcagcaaaatgggagaggtgaaaattgctgctatgaggagcagttaaataatctgtctcaaagggtgtctcgttgtgctctgaatgtgtaaatggcatttcctagttgagtggaaatggcatggggccatccgagagaagagctggatccagggaaggcttgaccaccacctagcaccttggcctttatttgctccatctttggaaagatgaggctgacccaaggacaacttcagtgtagttattttacttaagaaagagttcagtgtgtcttgagatggaggaacacaactcacatgtctgggtgttagaaagattgagtgcattcagtgcggccaggcccttcactgggcaggtgtggtcacaggggcatggacttatggatcccatcctactctgttgcagagtcccagggccatgggttgcctggaaggaaaggaacagcataaacccccatccctccttgtctgactgggaggaatatggatgcaggagcagatgtgagggtagtgattagaaaccctggctgcaatgaaagccaccaggaaaggtttgaggccctctgatgcctggcccatctccagagttggattcagttccctctgactcacctgacagcggctgaagtctacaggccccagagccatgaggaggacagggcctgggctttaatatttttactaacgttccctgggtgattctgataaccaccaaaatttaagaaccattggtctggggtctggctcagaaagtcatgtattaaagggcctgggtgtcttattatgcagctcagctactataatttgggggctttcctgtatctgtagatgatgtatcctgtatctttgagatgcagaaaacagaaaagtacagagaaagaaaggcaggccttggtgagcccaagcaggggcaaaaaataccaagcttctcccactgccaaagctgcaggcactgagcctgagggcccccaggccctggagagacagagggtttgcaactacctgagaagcttcctaacagaaggcattgctaagattttctaacatcctaatgcagaagcagtgtttagtgatggggagcaggtcacattttaggcagcttatcacccaatttgccttcttttaacctagttttaattaccttttacttcaaatttatggaatctgagtactacttagagcattatttaaatctgttctgttatgtaaaataaaaacgtttctgattatgcttttaaagaacttttttgtgtgaaaatagtagacgctattatttgctttttaaatcaagtaatgtacaaaagtacaaattttaaaatgacaaaaaacaattacttcaaattccaccatccagaggaaatcattaacatttggtgctgcacagctatccctctgatagaatgatagctaattaggtgaattcaaacacatttacaaaaatagaaaattactgtatatcttttttaaaattaaaagcaatataatttgatttgaatttaatagattaaaaaattaaaatgaaagtgcaaaaattgctaaagttcaaaaatgtttttcttcattacaagttattttaatttctgtaaagttttttgggtagagtaaagatgagatttattcacattttaaaaatttcacagtatcccttgatttcctacttcctctccttccctcatccccctactctggatttcttatgttactacttttacattgatgagatgtgtagctgttacattctgttctctgccataatacacaggcattttttttcttatccactcagctgccattgcctgttcttccactatggtttctttgtcctagaaaagtggttcttaaggtttaaagagtatattaagtgcttgggtattttgttagaataagaattctggtgcagtgagtctgaggtgggccctgagggtctgtatttttttctgtttttttttttttttttttacgcagagtttcactcctgttgcccaggctgcagtgcaatggcacgatcttggctcactgcaacctctgactcccaggttcaagcgattctcctgcctcatcctcgcaggtagctgggactacaggcaagcgccaccacgcctagctaatttttgtatttttagtagagatgggatttcaccatcttggccaggctggtctcgaactccggacctcgtgatccacctacctcggcctccaaaagtgctgggattacaggagtgagccaccgtgcccggccgagggtctgtatttctaacacctgcccccaacctccatgatgtcagtactgctgctgcaagagccacacttggataaacaagttctaacatttttggtttatgttactttttgtttgaccagattcccagattccattttcaggttattcgccacccacctcccaccctccatagctcactggtgctctgttccctgaagttttgagaatgcttgaatcttcttgcctatttgtgtacatggggttgcaggggcaacctgcctgggtttatatacatgggtcacataaattaaaattcctttgctcagaattcatggacattgcttcagtgtcttatggcattgaacgtggtcagctgaacatggcattgcagtggtcagttttagggcaggcctcatttttacttcttttaggtcatttgatttttttctacctggatgtcaagaagattccttctttatcctggagatttagtaatttcaccaggatgcatcttgattttatcttaggatgtattttgactttttcaaatggcagttccaagactttaattcaagaagcctttcttctgtgtgtttttgaatagttttctgttatatttgttggtgttctcctctccagagtatgaatgaagcgcgtgtcgtgggatgcccaggagtgtgccttctgctgagggtgctgggggtcgtagccactgaggctgctgctctgcctgcttcatactctgttctggaagtttctttcagccaggaggcagtgaagatgggagtgggggaaacagagacagaaagaacaccctctgagctatcccacaggtccccacacttcccttacaacatgtggctgtcttattactgcagggcctctcaggatgcaacatttgcctttagagaaacccaaatctgggccaaagtctgaggaggtgtgagtctgctttcattgttcttccaaattccactgcattttctactaggtggtttgtaatgccaccatttctttattttcgtgaagattgatttttctcttttttcctatctcctgttttgaagggtgtcaagagaatagggtatagaaaaactgtatcctgacaatgcagtccagattttttttactggataaagcaatactaacttgattttcatattctttccttttggctattccatgccagagagagtctgtcagagtcttctatatacgtaatgagggaccacttgatctggtggcagtgattcaaactgaaggtgccttgtcctgaaggaatcaataatctctgaataatacaatgtataaattcagtaccaccaagcaattactgggcaatcaggactgtcactgctccaggacagagtagtgctcagctgagcacatcagggcattctttgctcccaaggcatcaacattgcagcttggtgtttgtgcttggtgtgcatttggctgccatgtggcagtgggctggtgtgtgctcagtaagcacagccagtcctcaaggctgacttcctggaatagcacatggtggcagtcagtgaagcggccgctcactcatggctggcttgtacacacacacttagaacatcctccgtcagttgccttgttctggaatgttcatgaaggtgtgtagcttattaaaacaagaaaaatacccttcatttatacatttacctagagacatgacagaggacatagagagcttcagaaaaacttcattttcccctacttttcagtcttggccaaggccagattgtggttcaaatttgttggatttagttggcatatttctttcttgtttccccaattaacatggctaatagagggatacatgccaggaggtgcctggctctctgtccccactgccctgtctcctgcagctgtaggaggtcaagcctgtgaggatcccccaagccaactccctcagagggagaataaacatcagctcaagcttctcagcttattctctgcaaaggctattttattggcaaatggtgaactagcagaaactctgaatccactgatccagatccttgagtaaaagccacatacacccagcatttcatataatatatgtatttgcatgtacatattttattgaaaaccagggactttgctggaagtatttaaaggtaaccaaaatctgccttttgcagtacatttccaagctgagacatcataatagatgtggcacctgatgatttcagaacgaaagcctttcaacctccaaaatcatccccacctttacactacttacgaatgggccaaacgggatggggagtcatttccgtttatcagaaggaaagctgacagcacaggaatgcagtcacttgcctaccttgtctataccccaaatgtgaaaaaggacaacagtcccaccctctcaggaccttagtaacaggaatatcgggattgagtgagtagcagaggtttgcccctgcaccgtcattgtgtggtctacccctgcagtgccaactctgcagtgcccacatctctcatcaggacagctgtagagtcattgcctgcctgtcagggggagtgggaaatgagcagattgcagacactgggaggtagcggcctgacctgctatatcaccaccgcataccgaggaatccgtatgtcggaagacacatctgggagagttagcgggtgatttagacagacaatcttagggtgagagcagagagacagaaaaggaggcatcaaccactgggctgagaatcctggggccaagttgctttaggaaaggcaaccactttcagtggtttatagtccatattacaaccacccagcccgcccagcttggaacaacttagctctataagggggctaatcttatttccaaatatattcccaaagagaatgtccacaacctcccttggtaaccagaggctaaagttacaactgcaacagtgtttcctcttggctgtggatgttagcacattgtaaacacttgaatatatgactaactcaattacacatcaatcaagagagcttattcctgcttgaattcaggtactttaaaaaagtctgatggaaacagtgattctgaaggttgaagatgagattctatgctgtgatgaccctatgtctaatggtggtggtggaaacactacccacaatccaaatgttcattcctgcttgagtcgggagccatggggatgggattcttggggtgggaaaggtggagctgggttattgggaggaggaggtctgccctgtgagagtgccaggaaatccaaagggcccaggtggtcttccctcctacttctggggagctaggatgtgggcacctgatctcaaaccagctacctggatgctcctgactcgggctttgattgttaatggagggaattgaagattcagggagaattgagacatctgcaactgcatcaagtgtttggagggtgggcagggacagaagcgccatccagaatgtccagccaggtcactcagtccctgtggtgtggcccatgctctatggcccagcccgacttgattctgagaactgcttcaaagctttccaaaagggggccttccttttctgtttcttttattcacagttcatttctgttgcttataatcagaaatcctaactgatacaagagtggtgctgagttttgagttatccaggtatttatttagtaggggaaggctgcttctagcaggaagaccatacatactgagtggactgataaatgtttaattttaatgcagcaaattggctattgagtgtgtgctggtggctggcactgtgctaaacactgggaaaacatgtgtccttgtggggctgcagaccagtggaggacacatgcctgcccagcttccaggtcacccttccaaatggatcacattttgaagcctgccttgcctgatgagagcatgtgtcattcatgaagcaatttccctgcaggccttagtggagtcacacagagcaaggccctggcattccacagtgatggcccacctggagctggctttcatgcaggcataaatcaccctctcttttatgagttgttatacttatttcttccagtttttgctttctggttttactttcctttcttcttatttaatagacctcaagagggaaagaatttctggtcacagccaatcacagattaaccccctgtctttaggaacaaaaggaccctgggctgcaggtgtgtgtggaggagagtgggggtgtgttagaaactcccgtgtatggcaccccagcctcacaggacctcacctccacctctggtcctgactccccctgtgcgtggccattccagcaactgccctcttgccttttgctcatggagtctgactacatccttctgtgggccggactgccgctttcatctcccagtgacagtgcttttctcagtgctgtccagttgtccagtgcctggttttttttttttgagatggagttttgctccattgcccaggctggagtgcagtggcatgatctcggctcactgcaacctctacctcctgggttcaagcgattctcctgcctcagcctcccaagtagctggaattacagtcacatgccaccacacccagctaatttttagcatttttagtagagacggggtttcaccatgttggccaggctggtctcgaactcctgacctcaggtgatctgctcgcctctgcctcccaaagtgctgggattataggtgtgagccaccatgcccagcttgttttgccatccctaatgtcactgggcatctaggtctctgggagcctcaggatccctggctgcttaccaatgacccagtggcctttggcatacccctgagagcagacagagatctgctgactatgaaaaggtggcacagatccagaaaatgctgatcttttaacctggatgaacttgaaaatggcctgggggaggttttaaataaagatggagtgtgtctgtggctgggactgctttagctggatagtctgggaaggcctctttgaagaggtgacacctgagctaaggccagaaaaatgaggagccaaccacacatagagaagtgggaaaggcataccaggaagaggacccagacaggacaaaggccctgaggtgggaagatcttggcagtgtcaaggaccagataggaccatgggctggaagtagcacaggagaagagtggttgagatgaggtctgggaagtagccaggagctagtggcagcagcacagacgttgctctcaactttccttcctgacaagtggagaaagctagccctcctggttggtgcaattataaatgggtaaaggtggggatgagtttggagattgaagggccttcattctgaagtgatcagctgccacgtctactttaatgtcatagtttaagagaatactaaagaagcaaggtttgggtcaccttaaagtacttccagcaacagcctctgttttccaataaaatgcagatatgcgataatagcatatgaaatgataggggtgtgtggtttcacctaggatctgtgtcagtgggtttgatggtttcagattttctcctgattcaccatttgccaataatatactctttgcagagaaacaagctcaggctgaagtctattgcctctgtaagtgtgaaggaagctgttggagagattggaggaggggaacaagtgatccaacctaagtgaaacaataattctaataattacaaccaccaccactctgggcaatatgtgcacagagctggttgcagtgcagccagtgtggaagagcagactttgaggggctgagggcaagaaatgccagttgcctttcccatggccacccagtgcatcagtcataggcaggatcaggcctaaagacccaccctggccagggtctggctggccaggtgagcccaggctcccctacatggcagcggggtgccagttccttcctcttgcctgggaaaattaatagctttttttccttctttcaagatcaaaataaaaatttcactgattagcattgcttccatcccatccatgtgatgtctcttccttaaaagatcccatcaggctcctttctcgggactctggccaggtatgtttgcccgctgcagagattcccagagttctcctgcttatctgggctgtagctcaccccaaacagctcccttccctcatctccaggcatccctgaagcttgaagggaaggaggaggcagaactggcagacttcttccttaggcaggctggggacatattgttcaaatttaggccttatcctccaagaatgaaaatacgtgatgcttatgtgaataagtatttgtgattgaattaaatgtaagtacagggcacttctaattcacagctctgtgtgcaagtgcagggtctgtgtcaccaagcaccgccttcactgctgggctggcagtgaaggtggctcctgcatctcccaccttccctgctcatctgtcttgtttgcctctcccagctttgtcaaatgtaacgtgaaagaaagggaaattaaaagaaaacaaacaaaagagagattttcccagaggggaaatcagatttatcctaaagtaattaaatgtgtaggaaactgagaacaaaggattgcaaatagtgtgcgtgtgtgagtgagagagagaataaatcattatttcactggcagccggagccctccaatgaatcttaaactcaggtccctgtgaagtggagtaggcaggggaatcggaccatagctgtggctctggtgtcccagcacctgcttcccatagctcccacagctcttctgctaggcttggggactgggggactggggtatgccctcccagtcgtggttggtggagctactgttcactccttttctatgctgcctcctatgctcccctccctgtgggactggccttctctgtgttgagtacttgggagtcttggcaggctcctgttgcccaagcacctggtggcactgggcgtgtctttttcctttgtctcattacttagaggctgagtgtgttggggtcaaggactgtgtcttttcactggggcaggcccaagtgtccatgcagggcctgaactgctgtggttgctcagtctgtgtttgttgaattaatgaaggggcccttaaacattcagagacattgaggttgtcgcactatgacctttcactgcagctgctgttgtggctggggaggcaggcacatgcaccatgcctggactgtgagggggggcatgatgagagctccagggagggcagaggaggtaggagaagcagtcaggtaggagatggtgtttaacctgggccttgaaaggtggacaagtctttgacgtaaaggggaaaaaacatcttcttcagaaagttgatgtgaagcccccaaaatgcagggtgcttgtacttccaagcaggccccgtgatcatcccatcttccccatgttctgactagcttagacccattaaggcagaggtaatttgagatcatgtgctgacaagtggctaagaaggccttttggctactatgatgggggtgctgagcaagagctgacttcctgggggcttcctggggacaaagtctacacagcccatctgatgctcctcccacctccaggaatttgctgatgctgtcacttcattctgtaatggcctttctccaaaatgctgccctccctttcttcgaagaccagctcagatgtcaccttcctccctttctcagcccactgcaatcccaccccttcttaaagcacccaccgatctcctccatgaaatcttcccagctccctacagcttcccagcaatctttgttgtgaacatatttagtagatacctttgaacaaatttagcagatacctttgaacatatttagcagattcttgaaacctctgcttacaccagcaaccacaatccacccaccttttcctatgatagacccatctgtgagcctcgcaggacacaaacagtgtctcattcttcttggggacatgtagcctagcactgtgtctgctgagtgaatgccggcctcatttcctccacagaccaatttactaacatgttttcagtggctacgatgtgacagggattgcacatgggctttggtgatggtctcatttactcctcaatgctgaacaggaatgagcctcgccagctgatagggactgagagataggaattctaagctgaggctgtgccttggagaggcatgaggcagagaggacaggggagagagggagcatcagggaagtctgtctgtgagcaccacgtgttcagtggcgtttcctaccagggcctcagccatcacagccaccaaagggagctctgcgtgccccactccacaatacctggaggccccacaccccatacctcagaccccgagcctttagcaccagcacaggaggtggctgcccccacagcagtaggcttgttggctgagcaagattcttccctacctcttccaaaggcctgaaatcccatcacaaagcagtcttatcccccagggataagaatggagcatgtatctggggtcccttaggctggtcaagcagggtggggctttaaaacggcttccaccccaggactctgggggccaaaggggagtcatgtgtgtgcaaagcagacataagcctttaaaggaatagcattgcagttattcatctctgctgtccaaagacttgcctgtagatgaatatttcagaaaaatgacattttcttttctaatcacagaaataaaatatgcctatcgtagaaacatggaagatatgggagatataaagaaaaaatgaaaatcacccagaatgacaccatctgaataatttctaccagccctttgatatattttattttagcattgtgtgtgtatgggatcacattgtaagcaattttatatccttcatccattgaatattacattgtgatcgttttccctatcattaaatttattggaaaacatttttaatgccttcataatattcaatcttgtggctgatccataatttatttaaccatctcctcctttttgagcatttaagttatttataatttgtgaatattaaaaatatccacaaataataatgttgtgaacaacttcattcataaatccataggcacttttgtgcttatttctttagaataggttcctagaactggaatcaaagggtctgtacttggcaatgagtctggatacctactgccaaggtattggtctccagatgcaggctttgcctcaacagctgagaatgcccttgtcccagcaccttcatccgcattgagcattactgcttcttaaacctctgctaacttggtacaacaaacggtgttggttaatttatctgttcattgattttttttccagctttccaatggtgtgtcagtgttttacttattattttaagtgttccttatatgtcaagtttattaccatttccccaaacatgttacaatatttcttcccgttggttatttgccattaatttttttataatagctgtgttgagatataattcacataccatacagttcacccaattaaagtgtacaattcaattcagtggtttttagtgtattcatagagttgtgcaaccatcgccacaatcaattttagaacagtttcatcttcccaaaaagaagcccttgcccaatagcagccactccccatttcacttcaactcctcccccagccctaggcatccaccaatccatttgccatctctatggatttgcctattctggacatttcacataaatggaatcatgcgctatatggccttttataattggtttcttttgcctagcaaaatgttttcaaggttgtagcatgtctcaatacctcaatttgccattagactttcttatgattttaatagcagcagttttaaatttttatgtattgactgtttcaagctttccctttgtgatctacccctcctattctccgaggttaggtgtcctctagttaaatttacaactatattttctgctaatttttttaaaactactttgttaaaacattaaaataattaaatctcaaggtaatatatggatatagtcctgttgtaagtggctttagtttttacattaattcttcaatctacctggaatgtattttcgtaaatagtaatagggtgagagtctaatttaatttttttttcccaatagtcaattgtcgtagtgtatttctaccccatttgctgctactgcttccttcataatttattaagttcttaaatgtacttgggtctatttcaagtcttctctgttacagtgccttgtttatctatgattgtaccagtgttgtattttctaattctaacagttgtaaactaagctacatcctggttagacaagtcacctctcttattgtttttacagtctttcttaattcctttgcctattcattttaccagaagatcttagaattattttgtcacatctatctgtcttctttttaaccatgcattttccccaccagtaaacagctgccaataattttatttgttgtgttttttaaataatacattaatttgggaattgattgtattcagtcttccatctggtaacatatgtttcatattgtcaaatcttattttatatattttattatgtttttaattttttctatttctgtgccacaatttagggccttcccgatgtctttgattgcttttgattttttttattgctattgtgagtggatttctaaaactggttatttctggtattaaagaaatctctccccccaccccccaccggtttacttttctcaacactcttttctaattataagatattttctggttgtttcctttgcaatttctatgtctttaatcatactgtccaaagcaatgattattttttcttcctttttaatagttacatctctaatttctgtttcatttcttattgccctggtctgatctttgaaaagtgtaaagcattagtgaaggggaataagattatttctctctaattttaatgggactgccttttgttgtttcatcaataagaattgtgtaggtttaaagtagaatgctaggaagaaaataacacatattaacttgaaagaatagtaaagaagaatatatatgtttggaaataaggatattgttttccttgttgatcaactgacatgaaattttgattactattaatgaaaacatatgaaactatatttcaattttaggatcaaccttagtcatgttgaatgttgtgttttgtttgtttgtttgttttagacagagtctcgctctgtcgcccaggctggagtgcagtggcacgatctcggctcactgcaagctctgcctcctgggttcacgccattcttctgccccagcctcccgagtagctgggactacaggcgcccgccaccatgcccggctaattttttgtattgacgaggtttcaccatgttagccaggatggtctcgatctcctgaccttgtgatccccccgcctcggcctcccaaagtgctgggattacaggcgtgagccaccgcgcccggcctgttgtgtttgttttacagtgctcttgtttaatgcttacatctgtattaatatgtaaatttctctctctttttttagttacattgccacattttggtataagatttttactaacttcataaaatgaactagacagaattttatattttttaattcatgaggcagttaatatagcatggaattatgtttcttaaaagtttgaagaaacccacttgtaacactactcggtcttggaatctttctcagatgtaaactttggtagttttgaaaaattctgtccttataattgacctcttaagtttttatttgttcttgtgtcacaatttgataatttacattttctagaaaaagtattaaatttgctgggatttttcaattcataagcacagtaccatatagaaaggttttaaaacagaagacaacactgtctgttgttgtatccccttccttattacttgtgttatttattttctctcattctcattatttataacaataatgtagagaactttgcatttaaatgggttttattactcacctccagcttcctcattctcaaattcttcatttggattcattactcaatagggtggagtgtgttttcaagtattatgttttttctaaaatcatatgttataactttagagctcatgtgtgtcttgaagtgtgtttgttgctccacatttagacagtgtgttggtcaagtagaaaatgtctggccacaatcattttctgcaaaattcagtagatattgtccaacgtgttctgttcttgcctttgtgagatgacgggaggctagtccttcattggttatctggtttcttcttttactttttctcctgcctgaattcttgttgatttttaaaagtccttttggacaaatatgagagctttcaaacataatgtattaagatgtattaagttgtttctgtgtgtatgtttgtatgtgtatgttaacaagagtatgagattaatatgttcagtatgatgagaaacaggcactcttactgccttaaaatacatctcccatggagtacagcagtttttctcatcctctgcattactgaaattttggtctgaataattctttgttgtggggagctgtcctgtgcattgtagaagatttagcaggatccttggcctctattcattagatgccagtagcaccccctctcctcaagttgtgacagccaaaatatctccagaaattgttaaatatttcctggggttgggggttggtgccagaatcgccccctgttgagaatcagtgcaatagaaggtggcctgacttgtatttttttatttagaacttaggggcagaaatagatcatttccactattttatttcaagtttgctctgtttcaggcaaaaatccatttgtgtgcctcagtttatgtttttaaatttcactttcatgacctaataattgatggaaatccctgaaggttctaggactgtgtcaatttgtagtatatgcaggcttcaagtttttacttctagtttttatggtattttagtgggaatctgggagaaactgtgtcaggcattgctgtctagccactattttataccattcttctttttatgtgaattttctcaccctgtgcatgtttatactttaaactctttaaaaaataattcctgtttcttaggagaattgttttgaatatatagtttggtattttaggtgaatatatcactggttaagattataatttgggatgaacaatgaagtagtttattttgggccaaactgaaaaggggccccgctgcaactttaaatacatgtaatcagctcttccagacaccaccaacacttggttcaggccacacgtggtaatgatggctgagctgagctatcagcttacagtctctacctagtcaattctgaaaccaggcagtgatgaaaatcccctctaaatgcaaagaagtgtgagactcagttgaagcatggtgtgaaaacagtttggctgcataccctttgcccaacttcatctcaagagactcgggaaaaatatagaaacacctcctttccatattgtttattttcatgtcacaaactgttgggtggaatgaaaacagggctctagtgttgctctagttgtgaaaatacaacttttacttcttctgttttaatcccagagaggggaagttccaactaatctgctaaagccaccttctttaaaacctttcaaccacgtggtttagaaacacggatggacatcgccagaatttaaaagtgtgctagttcccagccagagcagagcacgtgtctgggggctcccttttcatctggtctccatccatcctacaccggggggttgtctagcacctttttccttcctgttgtagtgggcccactttggaaatggcagcttttcatttcgtaaattaatttctatttttattaaagtaatggattaaacaattccatgagtaccaaaaggaaaaaatcagtttcctgatcatctcccctaccccattcttttccctaacacttcctatctgtttcttagatatactcccattttttgaattatatgcttaatgtgctttattgatgtcaatttagacattgtcttttgacttccctttatcaatgctgaggatttggatctcttgcccctttctatatttttcttcttctcttattttgctaatatctattactatatgtattatatatccatgtggtaattatatatgatttttcatatctacatatgtataatacaaaatgtatatttgttcactttgttaacatatatttacaacttttttgttaaatgtagcgtgtttagattattatatctatacaaccttccttccttccctccctccctccctccccccttccttccttccttccctccttccttccctccttccttctttcttttttttttttttttcaagaaggttacaaagaatatttatttatttatttatttattattatactttaagttttagggtacatgtgcacactgtgcaggttagttacatacgtatacatgtgccatgctggtgtgctgcacccactaactcgtcatctagcattaggtatatctcccaatgctatccctcccccctccccccaccccacaacaatccccagagtgtgatgttccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacatttgcttaatcaagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttgtttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactgtgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtatatggtgtaaggaagggatccagtttcagctttctacatatggctagccagttttcccagcaccatttattaaatagggaatcctttccccattgcttgtttttctcaggtttgtgaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcgtaggattgacttggcaatgcgggctcttttttggttccatatgaactttaaagtagttttttccaattctgtgaagaaaggcattggtagcttgatggggatggcattgaatctgtaaattaccttgggcagtatggccattttcacggtattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctacatatacaatcatgtcatctgcaaacagggacaatttgacttcctcttttcctaattgaataccctttatttccttctcctgcctaattgccctggccaggacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtgcataagctttttgatgtgctgctggattcgttttgccagtattttattgaggatttttgcatcaatgttcatcaaggatattggtgatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttgcttggtaaggtattgattattgccacaacttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcactaattttttgaagggttttttgtgtctctatttccttcagttctgctctgattttagttatttcttgccttctactagcttttgaatgtgtttgctcttgcttttctagttcttttaattgtgatgttagggtgtcaatttttgatctctcctgctttctcttgtaggcatttagtgctataaatttccctctacacactgctttgaatgtgtcccagagattctggtatgttgtgtctttgttctcgttggtttcaaagaacatctttatttctgccttcatttcgttacgtacccagtagtcattcaggagcaggttgttcagtttccatgtaggtgagcggttttgagtgagattcttaatcctgagttctagtttgattgcactgtggtctgagagatagtttgttataatttctgttcttttacctttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctctttttgttgaattgatccctttaccattatgtaatggccttctttgtctcttttgatctttgttggtttaaagtctgttttatcagagactaggattgcaacccctgcctttttttgttttccctttgcttggtagatcttcctccatccttttattttgagcctatgtgtgtctctgcacgtgagatgggtttcttgaatacagcacactgatgggtcttgactcttgccaatttgccagtctgtgtcttttaattggagcatttagtccatttacatttaaagttaatagtgttatgtgtgaatttgatcctgtcattatgatgttagctggtcattttgctcgttagttgatgcagtttcttcctagtctggatggtctttacattttggcatgattttgcagcagctggtactggttgttcctttccatgtttagcgcttccttcagaagctcttttagggcaggcctggtggttacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacacttatgtgtcttggagttgctcttctcgaggagtatctttgtggcattctctgtatttcctgaatctgaacgttggcctgccttgcgagatttgggaaattctcctggataatatcctgcagagtgttttccaacttggttccattctccccatcactttcaggtataccaatcagaggtagattttgtcttttcacatagtcccatatttcttggaggctttgctcgtttctttttattcttttttctctaaacttcccttctcgcttcatttcattcatttcatcttccattactgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccatagctcagagtaatttgatcgtctgaagccttcttctctcagctcgtcaaagtcattctccgtccagctttgttctgttgctggtgaggagctgcgttcctttgcaggaggagaggcgctctgctttttagagtttccattttttctgttctgttttttccctatctttgtggttttatctacttttggtctttgatgatggtgatgtacagatgggtttttggtgtggatgtcctttctgtttgttagttttccttctaacagacaggaccctcagctgcaggtctgttggaataccctgcagtgtgaggtgtcagtatgcccctgctggagggtgcctcccagttaggctggtcgggggtcaggggtcagggacccacttgaggaggcagtctgcccgttctcagatctccagctgcgtcctgggagaaccactgctctcttcgaagctgtcagacagggacatttaagtccgcagaggttactgctgtctttttgtttgtctgtgccctgcccccagaggtggagcctacagaggcaggcaggcctccttgagctgtggtgggctccacccagttcaagcttccctgctgctttgtttacctaagcaagcctgggcaatggtgggcgcccctcccccagcctcgctgccgccttgcagtttgatctcagactgctgtgctagcaatcagcgagactccttggagtaggaccctcggagccaggtgcggcatgtaatctcgtggtgcgccattttttaagcccgtcggaaaagcgcagtattcgggtgggtgtgaccctattctccaggtgccgtccatcacccctttctttgattaggaaagggaactccctgaccccttgcgcttcccgagtcaggcaatgcctcgccctgctttggctcgtgcacggtgcgcgcacccactgacctgcgcccactgtctggcactccctagtgagatgaaccccgtacctcagatggaaatgcagaaatcacctgtcttctgtgtcgtcaggctgagagctgtagactggagctgttcctattcggccctcttggctcctccctcaagaaggttacaaagaatcccttctctcttttcttccttctctctctctctttctccctttctctctttctctgtttcttgatggggtctcactctgtagccttgtctggagtgtagtggcctggtctcagctcactgcaacttctgcctcctgggctcaaataatcctcctgcctcagcatccagcgtagctgtgactggaggtatacaccaccatgcctggcgaatttttgtatattttgtagaggcagggtttctccacattgtccatgctggtcttgaactcctgggctcaagtgatctgcctgcctggatctcccaaattgccggggttataggcatgagccactgcatccagctgcaactatttttcaatgcttagccaagtagagttacattgttattttctttttcttgtacttttttccacaaagccaatcaaaattctataataataacaaatattattttccaaatgctcagatagttcagatgatctcccaactccttcctcaagtcctctcttcaaaagtatgcttgaaaggtaaatgttttgtatcctcacttctctgaaaatacaattatcctacccttatatttcgttgattggctgggtatgatgtctaagttaaaaatcatttttcctccaaaatttgaatacattgatttggcttcttctgcttgtcagtgctgctgttgggaaagccagtgacatttcaattttccttattttgtttttgggtttggtttgattttcttcgttggaagcattcaagttcttctcttttatccctgaaattctgaaatttcatgtttcttctttttctaatactcattgcctgggtactgcacagatatttcagtctggagtttgatgtctttttatctgataaaatttattctagtgctttttggataacttctatccattttaccagttatctttctcaaacttttgttagtaagatatgagacttctcagatggattcttttatttttttttttaaatctcttttttctatctctgattttttttttctttttttaggtcatttctcctacttcatcataaaactattttattgatttgtttttatattagcttttatttttatttcctaagacatttattttcatagcatcctgttttactttcatgagtgcaatattgttccatctctctgaggatatttattctagttttagacattttcttcaattatctgctttgcttctttttcttctgaatcctctgtttgtaggttttgttacctcagactgagggcttaaaaaattgtatctgagcacccaggccatctcttcatattttagtgtgaggcactgaaaggtgatcagcagctctatgtgagtggcgggggctgattgatgaatgggtgccattgttgggtggtgagatggcaagatgatcagtgcactgaagttagtatccagatatcttttctcagatgccttacaatttttaaggagaaaatttctctaatcactgaattttatttattcatttggtgggagcatgctccatcccctacttcccagaactgtgcttttgagttccagtgacaaagaagctcatgtagcccctccagagacatgaaaattgtggccatttctcaaagtcagtgtctactcctctcttcaaaaatgtgtacagacctcttgtatgctgagtattcctcccagtgctctttgtccaggggtagtttacaccttttctcttctttattgtcattgcaatgggattccaaaaagcagcaaagagaaacatgtttgagtcagagctttgagtgtaggtgacattggtggtaaaagtccatctccctgaagaatgactagcactaggagcagtgaccaccgtaataactgatggacttcaatgcaggattcagtttgtgttgggatagggcagcatgggggaattcctttcctgccagtgtgacagtcagggtagattctggaatcgtttatggtgggttcggcttaaagacagagagacagtctcagagaacccaggccatggtcatcctgaagaaagggtagcatgcaccttgtgtggaaggtcagctcctcttgggggtccatgctttgcctttacagctaatagagtctccagaatcaaccagtcaactcacacctgtaggaaacacataggcagctgctctctctgatatgtgtattcactcattctcaaacctcctgactctaaagtggggaaatgtttcagctttctggggcctgtggctgtgaaaaataaaatgtacacatgcatttggagggtctaggaaagttaccactgttcattgaggacctgctgtgcacaggcatagcactggggattccacagaggtaaattcttcttcgtaatggattttgatcgcctccgaggaagatgggagataactagagctgtccttaaggatatgcagggtagtatcttaaaaaatgagaaattgcagtttctgaatacattgtttgcaaataggttgagagacaaccaggaaatgaagactaatacgttagctcttttcgtattgcatggagaaggcaccatccaagtctaatgtatccctgccctggcctctgaaagctgaataatgtgtcacagattcagagaattttgttgccgtaagggaccccagaggttctagcaaaatgccgccttttgtagatcctgctgcagaggagctattgtgctgcacggtctccctcacaccattagtgtcaaacctccgtcaatatttaaacattcattattcagaatttcatttctctgcttctcttttttttttaaactctgagaaggaaagaaaaacacggttagcaactgtatcctgtatttcttcaggaaagaaatgagccacttcaaagctgagctgatttactggataaatatatatttaggcatttggggactttaaatgtgtatgatttaccagagaaacagggggcatccttcagaatccactatgcaaagatatattgacacaatttcaactgtatggttatgtctctgataaatcagcctgcctccctcagaccttcatggtccactggagataaaatatgcacctcccgttcagggagggcaaggggcaggcagacttcaaagtacagctgggtctgccttggaggatctcacagggaaaggtcctgtgcagcaccagaggcttgatctgggaatcacgtgtgagggctgcaggctcttgactgtgcatctgtaaacagtttctgactgctctgagaggcaggtgctgtctgcctgggggaggattagaggctgaaaacccatgcaggaaactggacaggtggattgtggtgaattgatagctaaatcttgcactttagtgcctagacaagattcggtctcaagtcacagccgcagggactctggacaagtcctgccatgtggctgtgcctggggtgccctgccaaggcagctgtcatggcttccagaagcaggcactttctaaggtccccagctggaggcctatgaatgctcaagcaggtgggggccccagcctgtagctgacttgtaagtgcaacactttattgcctgggagccttttgaaaccttcctgggtgtagaccctacaggatagcctctgcctgtaggacctgaataggatgcacagccagaggaaggaggacgatggacaaggaggctgtcatctggagctgaagaaggatacagagaaaccttgagtatgaaaggcggagaagaaagctgagtgctcacatgctacccaggctggagtaatcttcttgtagtgcactccttcctactgccagctcatagtcatttctcaggccagcttcctccgttgctacattccaatctcatgcttctaactcagtggggttttggagtcacatggccttagcctggggttctgctgcccacacgaagtggggatgggttgtgccaaacaactcccctacttccttctcctgtcctgcatccatcgctccttggggaggctgcaccaaaacctgccatcacccctgcttaggggtcttgtttccgttgtccacaggacttcaccttcagcctttttccactgaaagaaactggcttctacccacagagttgagattttgttgcctacttccacagagggagaaggtagacttgcttgggggaaaaaagaacattctcttattccaagccagtatttccaataattacatgcaatggtaaatggaattgggaaaagtgaattacctttaattaaggagtcttttatacttaaagtacatcctagggagcacatccctgggtaattagaggaggaggctgaaatctagcgtgttctgttttggggcttggaatcccaccaggaccctcctgctcatcagcacagtccctctcatactcattttcatgggtctggcatctgtttctgggaaatgctggacagctggagacctactgtccactggccttgaggtactactccagcatctcctgccactgcacatatacttgcatgatgcattagtcatataccattccatagcatatgagcttgtggcagggtcaggtgactggcccatgtggagggctgtctgtaacatgccagcactgctataccaccaaaaagacaagtttggtccatagggtagttggctcatgggatttgccgaagcatctggtctagccaggtccccaggtttgaagaaaagaggggcataagtgtatggaaatcctctttggagctaacattcatttatctatctctccattcatttttccttccatccactcgtctctccatccattcactatttccacatacatccacttagtactctccagtggctgccaggctttagtctaaatactgaggacagagaggtaagaagccgcttctgaccccaggagcctatggttgggtgggaagacagaggaggccgttggcataggtagcacagcaaggccgttgagacgctatctctggaggactagagcctcaggcccatatcataactactgggggagggtgatgccagagaggactgaggccagtgcaaccaagcagctgggggttgcttgaattggacagggagaaaatcaatcagggaagtggtggaattggcatatacccatccaaaccggtcaggatggaggaggcaggcctgcatggcctgtgaggtcagctgacccctcactgttttcccattctgtgttgtctttgccatgtgggtgctctgcagtgtataggctactgtgccctgagactgagagagatgggtacctgcaggcttgcacagttcaagtgttgctgtcttctacattaacttcacccttcagacctgtggagggtcctcctaactcagccaccatgaaagtgtgactgatgggtgtcctggccttcatcttcttctgaaccgttgtataagcatgggataggttccttaacctctgtgatcagtcaggtcctatgtctatttaggatatttctagaatatctagcagctaggtcagctaggtccacaggcagctaggtcaggaaacccaaatatggaagctgcatcttgatctgtggacggtagcactggactgatgtgactgggtttcagggctgcagaggtttacaaaagtgagcagtggggcttgatgagcagtcctgatgtggctattaggacagctttctgctctcctgattgattgattcgggcagccaagtgtcaggccaagtgggcaggaccagagcaatggggtggtaaatagactaccgagaagatagatggattgttgttctttaatcaggcattctctcaagacatggggaacatcttgacctgggatatcgccaccctcatcccaggcccagtaatgagagaattagcacatgctgaagagctagagtaactgctcaggcttggaagcaaaatagagggttttctgtgcagcaaatcactttgaaactaaatctccttactccagatgcactctgaaaatgaaaagtctgttctttgtttcaaatctccaagagacaggaagaatactgggatcagactgtggcctctggggaggatttgatagaatgctccctggtcttggccttgaaaactggaggaggttcaaatcctcagggagacgtcccttgaggacaaatgctttgtacaggaaagcactcgttagatatgtactggagaaaatgactggttttgcatgaatttggcttttaaaggtcactagcattagctcccaacataaaaccgttggaagggatttagaaatcacatagaccaagtccatttgacagaaggggaaactggggtccagagagtttaggtgacttgcctatgaccagggacaccattgatttaccatctatctccccaccgcccatcagtgatgctttctgtataatgatagaaaaggagtaaatgaaccagctaaaagtttgcactgtatctcagattcactttggataaaagtcttattactgaacaagccaagaggtacaagattgaaatgtggattttacatttcctggaggtttcatgatttctgcattgagtgggtacaattaatctatgttctttgagtggtgaattttattaaaccaggttttctctgcctcctcagacactgactggttaaatgacttataaaataaacttgcaggaattctgcagttagtgttagaattggtgtgccccatattaggctctacccttttcttatcacagtcattgtttacctaccagatctcccaacctaagagccgcaggaacatgtgggcttatcacagagctcgggtgtgtccccttcctgcaagtatgcttctcccactatcctcaccagagtaaggtgtgaggggcaagttagccatttgtagctccagtgaacagtccaagctccactggggtagcctccctaagtcctgcttatataacatgtgtgagtttacttttcacccgtggtggggtaggaatgacagaaaattctttgacacatatccaaagaagagatggtgcccatttctcctccctttgaatctgggctgggctgtgattattttgactaatggactgtggcaaaagtaacactttacccgttccgagtcttgcctttaacagcatgtgctgcttcctctttggtcagttcgtgccctgagtaaacatgtaagtcctgctcctctgcaagaggggagtacatagagaatccctgaaacttcagggagagagagataggcccagtctggcagctgaccctgtcaaggtgccaggctgctgagttggaccattttggctccttgaggccccctatgtccggaattggtgggttcttggtctcactgacttcaagaatgaagccgcggaccctcgcggtgagtgttacagctcttaaggtggcgcgtctggagtctgtcccttctgatattcagatgtgttcggagtttcttccttctggtgggttcgtggtctcgctggctcaggagtgaagctgcagaccttcgcggtgagtgttacagctcataaaagcagcgtggacccaaagagtgagcagtagcaagatttattgcaaagagcgaaagaacaaagcttccacagtgtggaaggggaccccagcgggttgccaatgctggctccagcagcctgcttttattctcttatctggccccacccacatcctgctgattggtagagccgagtggcctgttttgtcacggcgctgattggtgcgtttacaatccctgagctagatacaaaggttctctatgtccccatcagattagttagatacagagtttcgacacacaggttctccaaggccccaccagagcagctagatacagagtgtcgattggtgcattcacaaaccttgagctaaacacagggtgctgattggtgtgtttacaaagcttgagctagatacagagtgccgattggtgtatttacaatccctgagctagacataaaggttctccacgtcctcaccagagcagctagatagagagtgtcgattggtgcactcacaaaccttgagctaaacacagggtgctgattggtgtatttacaatccctgagctagatataaagactctccacgtccccaccagactcaggagcccagctggcttcacctagtggatcccgcactggggctgcaggtggagctgcctgccagtcctgcaccgtgcgctcgcattcctcatcccttgggtggtcgatgggactgggcgccgtggagtagggggtggtgctcccgtcggggaggctcgggctgcacaggagcccacggagtgggtgggaggctcaggcatggtgggctgcaggtcccgagccctgccccgcgggaaggcagctaaggcccggcgagaaatcgagcacagcgccagtgggccggcactgctggtggactcagtacaccctccgcagccactggcccggctgctaagtccccccttgctcggggccagcagggctggctggctgcttcgagtgcggggcccaccaagcccatgcccacccggaactcaagctggcccgcaagcgccgcacgcagccccggttcccgctcgtgcctctccctgcaagctgagggagtgggctccagccttggccagcccagaaaggggctcccacagtgcagtgggggggctgaagggctcctcaaatgccaccaaagtgggagcccaggcaggggaggtgccgagagcaagcgagggctctgaggactgccagcatgctgtcacctctcacccccagccaccaactgaatacattgagggactgtagtccctgccacatggagcaggagaattcctctgccaattaccaacctctgtctgaattcctgacctgcaaaatctttgtagataacaaaaatttgagtttggagtcaagtttcttgggtttaaatccacactctgccacttacttgctgtgtgttctcaggcaaatgctgttcatctctgaaacttgattccaccatccatatctggggtaataatactttcctttcaggagattcgagatacatacactataatgtggtataaagggcctggcatgtagtaagtgtgcaataagcccaagctgatctttggaattttctcagccacccagaattctatcaggcaggggtgtcttaggaatagctccccacatgcagtgtgacatcctcagagcagcctggcttgtcctcttggggacctgcagcattgggagggatgggccatgcagagacacagagccctggggctggggggcatttggtaaaacaggcccagccctgacctgcaggagtgtgggactgaccctggatttgtagatgagacacacctgtgtccacatgcgtgtttgtgtgcccttgcacagacatgtgcacacatcaaagggaaggagaaggagctgctgttgaggatgttcagcccaataaacatggctgtgaggggtcctgaagccaggggttgtgagaactcagggaatcatgtcatagccctggcaggtcactgctctgcccggcctcaaagatactgcaagagaaagctctttctaaactgtaaagcattctatgtgtgcaaggtattattcttaatagcgtgacaaggaggaggaggagatagaggaagtggatgaggagaaatccgcctgaatcctcctgataacaattttacatctataattccttccccttcctaccacatcggaattttatgggggattagtgagcgtccagctgcagaaggcctggagccccttaggataaggctcagctaggactttatttaatgaatccccttagaggggattttcttttgtggtggaaagttccctgctggtaaaggatatattccaccacctggggcctcttccctgggctcctgtaaaccagaagagcagggatgcatccgctctgcagtgtgtagtggtgggcgtgctagccaacatactgagaactttcagcctgctattctattttctctcttcttgtttttgcctcagagagaatagctcccagtgctttcaaccccccagccttcccccaaaccataatgtggtactccctggagttcacttgtctggctcagtaccactgggatgctgggaggcacagtgtctggggggccttctgtgacccgtggaaatgtgagctgtgatgctggtgttcatggccttcctgtaaagatacctcctcacatggagttcctcaaatgcaggtattccaactacacttgtgcaaagaaccccatggtctcactctctcctgacagccctgagcaggttcacccctatgaaaatgaaaaggaaggtccagactgctgagtactatgggcaagaaggtagagacttgaagcctaagatttgagaccccaaataggatagggttgctagctaaaatataggatgccaagttagatttgaattttagataaacaatgaatgcttttttagtataagtacgtccctgttttagtcattttgggctgctgtaacagaataccacagactgtgtaatttataataaacaaaaatttgttgactcatggttctgaaggctgggaagtttaagattgagggcccacatctggggagggccttcttgctgcgtcatcccatggtggaaagcagatgggcaaagagagggcacctgcacacatgagagagagagagacagagagcacacaaaagaggggattgaactcctgctttcatttatttattttctgagacagggtctcactctgtcacctagggtggagtacagtggcatgaccatggctcactgcagccccgatctcctgggcagtcctcccacctcagccacctgagtagctgagactacaggcctgcaccactatgccagctaattttttaaatatctttttgtagagatgaagttttgccatattgcccaggctggactcgaactcttggactcaaatgatccaactgcctcagcttctcaaagtgttggtgctatggtatgagccaccatacccggcctcatctttttatagggaacccacttctgtgataatatccttaatctgttcatgagggcagagcccttatagcctaatcacctctcatttggccccacttctcaacactgttacattgggaattacatttctaaaatatgcttttcaggagacacatgcaaaccatagcagtctcaaatggatttttcacaaagaacagtattttagtgtaagtatgacccacaaaatatttaggacatacatatatgagtatatgaaaaaaaaattcactgttttgtgtgaaattccagctcaactgagtgtcctatatttttatttgctaaatccagcaaccaccctgctgaggagggctgcccctcctgcagtgctggtggtctgggtcttgcttattgagctgagtttgttgagtttgcaaggcagccttcactgggctgattgtttcctcttgaaaaattcacttgcactgaggttggtgactctaggtaggtaaggtgctgccttattatctggtctgtccaaacagcaagctcattatccaactgatcacaggaaaattctcgtgactcatactctaagacctcttcctaaaacatgtatgtatttatttattttttattttttattttttttgagacagagtctccgtctgtcgcccaggctggagtgcagtggcgcaatctcggctcactgcaacctccacctcccaggttcaagtgattcttgtgcctcagtctcccgagtagctgggactacaggcatacgccaccatacctcgctaattttttgtatttttagtagagacaagtttcgccacattgctatggctagtcttgaactcctgagctcaagcaatccacctgcctcagattcccaaagagctgagatgacaggtgtgagccattgtgcctggctcttaaagtatttaaacagctccctatatcaaactgcaaatgccagagtattgaatttaaggaagtccactcctaggattttattttcttgtggatatcttacacacatatcaaataataaataataataataatagtaataataataataataatgtgtgatatctgagcccctaaatacagtttggtacttttctctgtaatcttctatctgttagaaagccaggttcaggcttaatcaacgctggaattggggtctccatcattcccaaatctcaatttcagagtgagaagccctctatgagaaaggtctgtgggcccgatgccttcctgggatggaagcctggagtgaagtctctccccagcttcagctcttctctcttcctccctatacctttccataccatcttctctgctttgactatcaaggagcaggcctcactgacctccctgtcaggtaatcacctgtctctgtgtctggtttgtgactgcctgaggattccttgcacctggtgctccctccacataaggtccggctccatcctgatacagacgttcctaagatatattcctttagcggaagactcttgcatccatagaaatgcagctgcctcttccacggatgacaccttcacaaattctttcccacgttagtgcttgggaaggaagaagcaggacagaagctgacctgcctattccctgaagcctggaggtaagaggtcaatgaaggagaggcactgagatcaggccatgttggcctctcagtgatcttcacacagccctgccatggagcctcctgaagactccactctttgcaggtctgaatgtcagggctgggctaatgagagaacaaataggacaggcactgattagcaggcagagtttgtataatcaattccagaaccatacatttatcagaaaatggattctaattaaaactaaatttggctcacttacaaatcactaacttaaggggaataaaaagatttgcctctgtttattgcagcttgccaggatgtgaaggggcagacatttctgtatatgtcacaagcatagtgggagaatcctgatgctttgtggggagtctggtggctgcattgttactgtagcagataaaggaaatggaagtcatcagaaggcaagaccatctcctgagggtttgcaagtgtcgccaagccatgctttcctggcagggagtggctctgcctacatctgccctgagggaccagtccctgtgggtaaaggccagtatccagccctcagcaagcagagcaatttcagctcttctttgcagcacattgtgtgctgctgactagtgtgctgcaaagaagagaggttaagaacaccagcttcatggtcagccagaaccagttcataatcccaattctgcttacttatttttgactgtttaatacggagcccactgcttcacctctttaggtcttagtttcctggccttaaatggaggcaaaattatgcttgtttcatagggttgttggaaagattaaacaagataccataggcaaaggtctcagcacaatgtctattcttgagcaaatgcttaataaatgacactgattgttcttagaaaatatattaactaggtctttaatatcctaacatatttggttgtttttaaagcggtgtcttaaaagctaaaataagctgcctactcatttcgagtacatgtgagtattcctagctgatgcattatagtatagaaatgttttttccaattttttttcttccatagttttaccttttgtattttctttgtttgaggcttttaatgttttcaggcatctcagaatcaaggctgagtatgaacaagataggttccggagatgcctgagaagtgccgagtaatttaatgctgctgtagcatagtggtggtcaaaatgtgcccacagacccctgggagatcctgtcagggtgatctacaagttcagaactattttcacaataacacttagagatgccattgcctgtttcggtgcattgacatttgtgtggatggtgtgaaagcattgatgggtaaagctttgttctgtctggctatgaaaccagtattgcaatgacaccaaaatgcactagtagtcattgttatcctttacaccagtcactgaaaaaaaagaaaaagaaaaagaaaaagaaagcaaattttgctgaagaatgtctttgataaactagtaaggttagtgtttgattaagtctttatccttgaatccttttgacattctgtgtgataaaatgataagttcaaataaaatacttttgctgcatactgtggtatcatagttgttgcaaggacaagcactcgtgtgattgagttgcaagctgaactagccaattcttttcatggaatattatttttcctgaaataacaataaacatacacaagctgtgggtattcagacttggatatttggaggatattttcttgaaaatgaaaggagtgagtttatcactccaaagcagacaactgaaagtgtttgttgcaaatgattaaatttgagttttcaagtgaaaattggagctttgggaaacttgacagcttcccactatttaagagttgatattaatgaatatgggttttcccatattcattatttcccaatgtatgatgtgaccaaatcaagccagaggtaaaagttccattggaagttcaaaatagataaatgtattttaatgcaatattaatgcaaaactttcattgactaggtttaagattccacactgcaacttaactttttgagttttggtgtagtagcaaagaatattcccaattatctgaaagagctattacagtttgtttccgtttttcaactacatatgtatttaagatgaattttcttcatgtaatttaacgaaaataacatattacatcaggctcagtctggaagcaaaagtgaggctatagctgtcttctactgaaccaggcatgaagagatttgcaatgctgtaaaacccagttttctcgctgttttatgaaaatagttatttttcataaaaatatgttctctgtgttaatatgtaatgagtttattattggagtctgataattttcaagagtgaaaagagccatgagaccaaaaaagtttgagaactgctgctctagcaagtgctttgttctttctaaactatagctcttgctacgttgtattgtcattgtcgcatgtgagcttctattactagctggtcacacaagctccttgaggatctcttcttctttttgtttgtatccatatcaaccagcacagggcagtatatgtttggtaaatatttaatgaatgggataatgcatgtttgatcgtcttaacatctataaaaattcctcttggcctacaggattacctgaaataatatcaggtttcaacagagactctactgtacaagagacctggttcccatttacatctaccccttggtgtctgtgtgtttgggcaagttatacaatttctagtctaaaatattaatccttcaattgagaaatacaaattccccagtcccaggcgagactaattaagtcagaaattctgggggtggggccgagcaatctgtgtcttaacaagctctccaggtgattctgatgtcccctaaagtttgagaacttctgtgcatcttttattctcctctaacatgggaaatataacccttactctgtgaagttacttgcagattacatgagataacacacataaaatgcttagtgacaatgcctgaacactcgataagcagtacctattcttattgtaaaaggcaaggaaacacagactattttttattttactgaactctttccttgcccacagccacagccccttgttcacattctgtggccctgagcttgatgtaatgagtctgactgagttggagagagtagagggacccaggaagctgaggaggatagtgtgtggccaaggccccgaggcttatgttttcttctctccttgatgaaagcctgttgaccattagcccggcaggttcacttctcctacatagtgagggacagcgcacaacagtccaatgaactcaaaaaaggccctgatggagggagagagaggaaaagaagtgacagcttacagagaggtcaagagaggagaaatgctgggcaaattagagcaagtaacctttgcagatggcagctggggaaacagaaggtgagaaactgtcattccaaattgcaactttcacaaggagaatgaatcagtaccttggcagacaggtgcctgagtttcccagtgtcatactctccagcctggcttctcagaggacccattcccgtgaccctgttaaaggtccattggcatctgcaggtcttcttgttaattggaaaagcatcgaactgcacagccagcaaaagcccattgaggattcagggcctctgcaggactgactgacctattaactgcttccctgcctgcagctctcagctttatgtactcagaggtccccgaggctgtgtgctttctctgtagtgcattgattctctcattcatctactccgtttattcattcattcactcattcatttctctgtttatttgtttcttcccttaacaaacatttacttacacccttgtgacagtttctttttactgtaggccagtgcttctagaacagaagcagttttccatccttcccttttgagatatttggccatgtctggagacattttggttgtcaaaactggagagtatattgacaaatggtggagatgatgctgttacacaccttaaatgcacaggacagcccctccccctacaacaaatagttatgtgaccccaaatgtcaatagtgtcaaggttgagaaaccctgccatagatgaaagatggacatttgtgggttacaaagggattgaataggcaatggagagagcagatattgaccacactggcaagatgggcagtgaagagctagagacagtggagtgatggctcaaaaaggaagcacagggaaactgaagggtgctctaagagtcagtggagggcaagggtggaggtgctgggaaggaggagggaagggaatcctcccttagtcccttttctgtctgagtctctttcaagtcttaaaaaaaatactctttttttttttttctttttctttctttcttttttctttttttttttttttttttttttgagatagggtctcactcttccaggctggagtgcagtggcaccatcaccaacatcatggcttactgcagcctcgacctcctgggcttgggtgattctcccacctcagcctccccagtagctgggactatgggtgtgtgccaccatgcctgcctgttttttgtaattttactagacatggggtttcagcatattgcccaggctggtcttgaacttctggcctcaagcagtctgcctgcctaggcctcccaaagtgctgggattacaggcatgagtcattgcatccttccaaaaatactcccctcttgccaaggtcccataaattagatttgaagcagatgtcatgaagcattagggagcagagtagccaagtcatcaccacacctgcccctcgtgcacgcacatgctggcatctagccacatctggcatgcagtgggcaccatgttcctgggtctacctccatactagggctgagtggactttgctaaagggccactgtgtcttctgcttcttccagctttgtgcctcatcctatgagtgtctgtttcaggagatgttagaacaactcaaatgcccaaccaatagtcagttaattcctgcttgcttcatctgtgggctttgttgctaagcacacattgctggtgtgtgtgaggatctgtagagctgggagttctagcccctgtggatgcttccttacagcctcagaagtgggctatctattaccctatagaaggtgcctttggccatcacagtccactggcttttttgggatctaagtggagccgcctattctgcaaacactgccttctgtttccttcttccccgccactgggctgcatccatcattgagcaggtgagttagagagatgccttgccattgagattttttgctgtctttaaaagcacctccttgcctgaatatttgaatcaaattacatctttaagccacttaatgtgttctgatgatctattgtctaacaaacgcattggctaaaaacaacgttaatcatgtcattatttctcacggttctgagagtttgctgggctcagctaggcacttcttgctcaccttcttttgtgcaattgcagtcagatgatggctgaggctggggtcgtcacaaaggcttcttcactcacagatctgatggttgatggtggcatcaactgagaactcagctggggctatctttcagaatacctgcacctgtcctctccctgtgacctgggctccctcacagcatggtggctggatttcaaaatggagcatcccaagagacaggaattgaatgccaccagtttcttaaggccttggcctagaaactggcataccatagcttccattatattaggttggttaaccatttacagaacccagatttaagagaggaggcatagaccccacttctggaaaggaggagtatcaggtactttggggaccaggttttgatacctctttataatatgtgatcagagaagtcctgagcaccaattttgagttggtttctatgtgaggacacaggtgacgaaaccaggcctcctgtccatgaggaacgcacagcttgtggactaacttctggacctgtgaagtctgtgctctgagtgtttttcctgttggaaacatgagatagggcaaaagctggctggtccctgatgttgctctcctttatgcttccagtggtaccccgggaccctgaggagccccaccctgggcatggtgcctgcctcctcttacctttttgtcttcacagccaaggcattttatttgaagtttaaggtcatgtgcagtttgttttctgttgctggcatccaaattgatataaatcattgactaaaggcaagttagaggaaatgatatagagatacattcaagacagcatgtatacatgactaatatggatggccgattgaggggatcttctaggattagattacacatgattttgctttatttgatgactttagatcctaaccttttgagttagacgtgactctcttgaaaatgtaatgaccacctacagccactgttattctgtaaaagtcaccttgatccccatgccccaaatggtaaggacataatgtacagcatagttctttaaattaaaataaacttatatgtttaaaaaatatattgcatttgtcatatttttgccatcatattgcaacactgacaagtgttgtgggcattgtcttcctggtgctcatcctcttcgtgtgggaaggtgagtggcttttgattaccagggcctggtttctgctttttgctgctttgggcatgataaggtttggatgttttgtcccctccaaatctcatgttgaaatgtgacttccaatgttggaggtgggcctaataggaggtgttttcgtcatggggctggatcccttttgaatggcttggtgctgtccccatggtaataagtgagtcctcactctgagttcaggtgagctctggttgtttaaaagaatgtggcacctcccccatgctctcttgcttcctctctcgccatatgacacgcctcctcccctttcaccttctgccaggatttggtaagcttcctgaggcctcaccagaagcagattgcagtaccatgcttcctgtacagcctgcagaatcatgagccaactaaacaccctttgtgtgtgtgtgtgtgtgtgtgtgtgtgtgtgtgtttaagaacggaggtttaatagacaaaagaaagagaaaggagaatagctccttctcctgcagagagagaggggcacccaagtgggtcttccctaaacctccttttttaaaatataaattacccagcattaggtatttccttatggcaacacaagcaaaccaacacaggaccttgcctcatttcgtgagtatttgcctcagatccactggtagtagctaatagaataattcaaatgtccagccacccatgatatctaagagtccttctatcccttactttctggggctctgttatcttacctttgagaactgctataaggaagggaaataagaaatccaacaagctagattggcagggtcatttcattctagcccacctttgctctgggcctgggtgctgaccaccttccaaagtttattttttctttgaaaacttaaagcaagacaaaggcaccaaggtgattatttcctaataataaatcccccaaactgcttcctatcactctattaataacttattccttgaaggtttcctctctgaaatttaggaatggctcaagcaagctgtcatccttctaaatggtttctgatcatagcttcaagattgattagtaactgctctcctatttctccccacctggaggcatctttgagagcaacatgctgaaaagatgacaacagcaggacctaaggaattcataaatggctttgactgcgtgggttttgatgaggtaatatggaaaatgattgcattaagtattgctatttatttacttgactttgtacaggacaatcaattttttcacgttccatgcctcctgtcaggaagttaaacggcagagaaggcagactggaggcattacctcatttctctaagagatgctgtcactcctcaaatcaccttagaatgttgttaataacagcatctttcattcctatccactgagggagtagagattctcccttcacaaagaaaggacactgaggaaggcgagatatgaccaggaaaagatgagctaattttttcatgaactatataaaaatctacttctgtaggtcaattattggcaattttatataggtaacccaataatgtaacacatgactttgtcagtataatgttaatctgtcctaggaaagcaagatttggctctatttgagcatttagagaaaaaattccagacccttgtagagaaagctggtcaatgtttagccttggtcagagcagatatcaaactggagttatataaagagatatgggtcagaggctgaactggacccattgaatgaacttgatggaacagtgaatgcatttctggtgtgtgtcgattgaatattttggggaattctggaaaattgatcagaatgattgatggctcctttaagatggtctcttgagtttgaatatcaagctctggaaatcaggctcctgggttagaagaaaaggctggttagagaaagagaaaaaggaaacaatgtttgctttttatttaagaggtgaagtgtggaagagggaagctgcttagtcatgaggtttgaatttgagtttaggctctgacagcactgtggccaagtcatggtgtctccaaggatcagctttctttctcataaagaaaccttataaaaatataaatggccaagcgcagtggctcacacctgtaatcccagcactttgggaggccgaggcgggcggatcacgaggtcaggagctcacgaccatcctggctaacacggtgagaccccatctgttctaaaaatacaaaaaattagccgggcgtgttggctggcacctgtagtcccagctactcgggaggctgaggcaggagaatggcgtgaacccgggaggcggagcttgcagtgagccaagatcatgcccctgcactccagcctgggggacacagcgagactccgtttcaaaaaaaaaaaaaaaaaaaaaaaaaaaaaaatatatatatatatatatatgtgtgtgtgtgtgtgtgtgtgtatatatgtgtgtatatatatatatgtgtgtatatatatgtgtatatatatgtgtgtgtatatatatgtgtgtgtatatatatgtgtgtgtgtgtgtatatatatatatatatatatatatataaagttggtgtgttggttaatataatgtgtcaccttgggagtccatggtatccagatatttgttcaaacattatgttagatgtttagattttagatgtttctaggaaggtattttttagataagattaacatttaaaaaaagtctcaacacgtagaaatgataaatactcaaggtgatggatacccccaaatatcctgacttgatcatcacacactctatgcatctaacaaaatatcatatggagcccataaatatgtaacatactatatattattctttttaaaaaggaaggagaagaaaacagtttggcagttactcaataagttaaatatatagtcaccataagaaaaattggaaactttatgagaccttttgggaactggtttaaggtgagatttttaatgtggaggtttaattagaatggtaaggatcaggatgtaacagtgtaagactggcaacacagcaagatgaagattttgagatgaggtctttgaggggagtcttagcatatcaatagttgtttgatgctctctgtatatgcatcttttgttttcttgggcaattgtttcctgacatagcagtcatgttgatgaaaatatagtggcaagtgaagagatgctatatgaagatggtcaaatagtaaagttaagctgggcatggtggctcacgcctgtaatccctgcactttggggggctgaggtagcaagaccacttgaggtcagaagtttgagaacagcccaagcaacatagtgagaccagtccctgcaaaaaagaattttttcaaaaatatctgggtgtggtggcacgtgcctatagtcctagctacttgggaggctaaggcgggaggatagtttgagcccacgagttcaaggccgcagtaagctatgattgcttcactgcactctagcttgggtgacagaatgagatcctgtctctaaatatatatacatgtgcatatgtgtgtctgcatatatatatatatatacacacacacacacacacacacacacacacatagcattatttatatgacaaatttatatcatataattaccaaaatattgacattaaaattagattttaaagcagattatcccccataatgtagatgggcctcatccaatcagttgaaagcctcaaattaagttacaaaaaagactccaaaaaacaaagtttacctcctccaaggaagaggaattctgccagcagacttcctttggacttgaactgtaactcttccctgggtcttcagcctgccagcctactgtgcagattttggacttgccagtccccacacttgcatgagccaattctttatatatatatattcctttatccaactgtatttttcaggagatatatatatcaaagttcagagaactctgagtaaatgcttagaaaggggcgctgtatgctgaacgtctcacttcactctgcccttgtaggcctcagatagcatcactcaggggtgaaggaggcaactgtccagagcacagagcacagccagctaacccccccattattgttgtatcaatagccgtgcttatctgtggggcacctcagacttcttgcagcaccagctagcacggatgttagctcataggatcttcacagatttattataaaagatttatattgtggacatatttattgctattttttccagacacaacacagtttccacaaatattacgtattcattccttataaactcaaatttattatagacttagcttttttgcctctgcatgggttttatccctttcctttctatgtgttatcctcaccttaaaagtgcttcctccaaaggcctgcatttgtccttacacttccttcccttataccacctatgctttcatttttgttcaaatttttaaaaatttagtatgaaattaacagatgcctactgtcaaaaatttgaaaagtgagacataatgaagaagtaggcaaaatagtacccataattctattaatattttggtctatttactttaacttgtagcctctttatccagtttactatcattttgtacccaacaatctattctaaacattttgatattaaaaaaatcaagaaccttatttttaatgtctgcccatttggcggtctacctttgggtataatatcatttgctaaacggttcctataatgttggacatttggtttgtatctgtttttcaaaaaatgattatgcataacacttcaaagaacatattgtccttaaatctcagtctgccttttgggttaaatatttaggaaagacactcgatcataacaccggctcacatctctcaggccctcccgtgggccagcccctgtctgtgctgagagctgtgcctgtgcttgcccaggtgttcctagcagttgtcttaacagaactcataccatgatccccattttttcagatgagaacaccaaggtacaggaagataaggtggttggcccttgtccacaatggccatcagctaaaaagcagcagagctctttgaacctgggcagtctgctcctgacacacgtcaccactcactaggttgagggcctgggcatcttccaaggcttcccatacagatcaccaagttgctttctaaaaggtagtcctggtaagtccctgtcctgagcgaacctgtcttgtcatccttgttcacacccggggttgttgtgggaggatgaacagggtcacacgtgtcaagtcgcaacacaagcctggcacttggtaggtgcccacaaaagacagctgctgtcatttctagggtgaaggctgtcaccacacaggtctgagtatgggctcatcttcatggcctttaggaaggctctttcctactctctgtatctgtgcaccttcctgtcctgtgaccagaggacagggaagcaggaaacacaacagtgtttacctgggctctcttccacctgggggcttccctcacaccaccctctgttctggcccagaactcttccctgacttcctccatcttagcactgatggcccacctatcagaccacttactcacaggagaagaaagactgtccatttctgagtccaggctgtcagttaccaagttattgtactgtcagttagcctgcacaccagtgtggaacatcgggcttctttcagcagatccagagctttctgcctgcaaagcccccatagggctggtggctaccactgtgcatgaagaaggtaaggctcccttctgtggagctggtgctctgggaacctgctcaccctccgtggcctcctctgcctgccaggccgcatcatctctccgtcaggctgcgtcatctctccatgtgcttgacacacccttcccctgttcgggcagagcagccgtgctgggctctcttgggatacacccttctcagcaggtgtttgaactctctagagcctctaaaagggcctgtcacaggcaaagctgatgtgatgctctctgttttacccttgaagcaacagattccctagaagggccagcactggcatggagactcactcaggtggtgctgactgtgccctagggcacttctgagcaaaggcaggcccacaaccaggcaaatgttagatagcaacatcaaatccagaactcagagaaagaagttaaattcatctctctattctactgcagtctcattagatttccaatagatttcatgcttccaaatgtattttccacacaaagatgcttggggtttcttggagccctcgcagacgagacaggtgggagggaggagtggctgtgtggtaggaggctgggctctgggagtagggacacttgtaagcagagcctgaggtgtaggggaggcatccaggcggtgagccccaagggctgccatgctgggagaagattcttacccaagtgcgtgttattcagggcacctgctcctccccagctcagctcatcacccacctacgtagaatgaaaggacatctgttatgcagagtggcagtatggagagtcccctctgggcctgctcagtgaacacccccctaataaatttgttgctggattcagacctcaagcacatcacagccacattcttcctgctgcctctgctcccagaatctggtgaggaaggggctggggaaggagcctgggcaagccaaggcttcatggttgcaaagatgagctccagatgccatgttcagcccaggatatctttagagagtgtctttcccagcaggagtccccggataatgaaggcttataggagaaagagaagaagtcacaggcctgatgaaagggatggagaggagactccatgggaggagacctgtgattcctcagtgtccaccactgaggccagctggctcattccatattctgctctctggacagcagcacttgcctctcttctcttctttttcctttcccactttctttcctctcattattctcttcttcttccccagtggaagggccagggtctctgctgggttcttcccatctgtgatgctcactgatgtccacttgtcctgccttcttccctctctatagagtcaggcagtctgggttctggctcccttgccccgctcctcagaggggtcctgtcccttttatctccagtgctttggctactctcacttttttgcaggttctctgagtatggtggccatattttccaatctcgatgtcagattccttgacttgtgtgcacatatgtcataggtatgtgtatacatacaaggtacatatactgcatacatatgtgtacatatatctgtatgatacatgaaagcgtgtcctatgttgcatttactgaaagtctcagaaaacctagccagcgggattgagcctccacctgctcaggccattgtgggagcctttgtcttttaggttggcttcattttagctcccttagtttaagcgagtttatttttctctctcaactggaaaatcacatttgatcagctgtagacagcagtcagatactgaaacattgggattttgcccagaaggcaacccctgtaaagctggcgtgggttctctgaggcaagatgggaccaacagggagacacatacagactgaggggccatgagtcaggtggactgcggacagatacagatggggagacaggaatgagactggaataaagccaaactgtgctgagcactggagccatgagcttctgggtttgggatggtgcattctgtctgcctcactgtctccctcattcctctgctctagtcacagttgatgaatgtggcagagggtgaatcagagcactaatatttgacccatctgctatgggacatgctgtgaatgggaatggcggcccgcctggcaggtggtgagctctgcccacctctcctctcctgtcccttccctgctacgaatgggcccctgtacatcctggggaggaggagggccaggccacaataggggctgtatatctagcttgtctttaccaccattccagatctcaaggttactgctctcctgctgctgtataaaaggtctccacattgtcactgggtctctgtccacataaacctcttgggtacacacctcagtccacaatcctgagggtgctcccattcaaccttctcatcctatcttcatgggcaagttcaaagtctttaaaaacacttcacttgctaacatccccagcatgtgaagctttacctgttccttcaacattgactgttccctgcagtacagctggggcccagtcagagcatcctctgctccacagagctcttctgcctccggctacatggggattctgcagaaagggattcatgttcatacagatgagcggcttgtaggtgggtttcttccctgcagggctcctccaacattttcttattacggtgtactttttaagtcaccaatggagggtttagtatgaaccctttcctaaccttaatttgccataggaagattttattctcagaacactcaatgacacctcacagaatacaatttggagaaggggttttggagaaaacaactggtttttaaactactcactcaagcttgtgaaaatcaagtgtgacagatattatcaaataaatcatatcagcaaatatttctcatgtgtcttctatgtacagcatatcaagttgatccccgatgtgcagcagattcttctgtacagattctattctgtggtaaaactggggaacttatgttccccttctcaacaagtttacttctgaagtagaaaaaattttactacagaaggagccctttctgggtgaaacacaattatttactgcttcacagctactaagctggcatttggaattcaggtgtcactgagagtgcctgagtaccatgttatctggaatattatgacatgggtcacttttctcctggagggttggtccctggcggctcaccccattacaggaaggtcttccaatttgccattacttgaggagtgaactcccacctgcttgaaacaactcaagaaggggtgagagaaagaggggagggagagggggagggaaaggcaggagaatgattacatggagagtggaatgtgaggcaaccagtgggagctttgggaagcaattgttgctgggtctcccaccttgactgttggagttcgttgactgtgatgggtacagggtttttacctgtttcaggtgtggtggatatttgcttaataatgggatttgatgcaggtggtgattatttggacacaacaaagtatacatttcattccaaatagcatcccagggtcttaaactcctggggaacttgaacaggccctgagacacccagaggttggagatatgggttctgactccagttctgccaccactaatgcgtgacctttggcgtgtccccatggcccgtttgggcctcagcgtgccgatgtaagagatgagaatccatctgggccactgatgctcagatacagtgcctgcaggagcccagccagcactgtagattagcaaagagaaccagagtcaaggccagggaagggatgagtgcacaagtgtgttcatcttctatttctgaaagaacagacaatattgaaatatatttaacgtactgtaaaattcactctgtaaattgctttttagtattatccacaaagctgcgcaatcattaccgtgatcttattacaaaacatttcttcaaccccgaaagaaagccatgcttgttaacaatcacacaacatttccagctcccctcagccctggtgaccattgatccactttctgtccttatggatttgcctactctggacattttatataaatggaatcacacagtatgtaatcttttgtgactggccttgttcacttagcatatgtgtttaagattgtctatgtcgtagcatgtgtcagtactttattcctttctgtgactgaataatatttgattgtatggatataccacattttgtttatccattcatcagtagatgggcttttgggttatttctattttttggctattacaaataatgctactacaagtatttatgtataactttttgtaaggacatatgtttttaattttgtttggtatatacctaggattggaatttctgggtcacatgtgaactcaatgtttaagtatttgaagcattatcagacagttttttttatgatagcattctttttaaaacttttttatttttaatttttgtgggtacatagtaggtgtattatttatgggatacatgagatgtttgatagaggcatacagtgcataataaacataccatggagaatggggtatccattccctcaagcatttcatttatcctttgtgttataaacaatccagttacactgttttagttatttttaaatatacaattaaattgttattgactattgtcaccctgtcttgctatcaaacagtaggtcttattcattctttctatttttttttttgtacccattcaccatccctacctcctcccaacaccctcactacccctcccagcctctggtaaccatccttctactctctatgtccatgagttcaattgttttgtttttagatccccaaataaatgagaatatgtgatatttgtctttctgtttctggcttatctcacttaacataatgatctccagttccatccaagttgttgcaaatgattggatctcatttaaaaaaaaatttccgtaggttattggagtacaggtggtgtttggttacatgagaaagttcttcagtggtgatttgtgagattttggtgcacccatcacctgagcagtatacacggcatcctatttgtagccttttatctcttgtcccctcccacctttacccacaagtccccaaagtccgttgtatcattcttatgcttttgtgtcctcatagcttagctcccacttaggaatgaccaccccccccccgacccaagtccccaaagtccattgcatcattcttatgcttttgcatcctcatggcttagctcccacttatgagtgagaacatacaatgtttggttttccattcctgagttacttcgcgtagaataatagtctccagtctcatctaggtcactacgaatgctgttaattcattccttttttatggctgagtagtattccatcatatatatttagcacagtttcttttttttttaattatactttaagttttagggtacatgtgcacaacatgcaggttagttacatatgtatacatgttccatgtgggtgtgctgcacccattaacttgtcatttaacattaggtatatctcctaatgctatccctccccactccccccacaccacaacaggccctggtgtgtgatgttccccttcctgtgtccatgtgttctcattgttcaattcccacctatgagtgagaacatgcggtgtttggttttttgtccttgcgatagtttgctgcgaatgatggtttccagcttcatccatgtccctacaaaggacatgaactcatcattttttatggctgcatagtattccatggtgtgtatgtgccatattttcttaacccagtctatcattgttggacatttgggttggttccaagtctttgctattgtgaatagtgctgcaataaacatacatgtatttagcacagtttctttgtccactcgttgatgggcatttgggctggttccatatctttgcaattgtgaattgtgctgctttaaacatgcatgtgtgagaatctttttcatataatgacttcttttccttggggtagatatccagtagtgggattgctggatcaaatggtagttctacttttagttatttaaggaatctccacactatttttcatagtggctgtactagtttacattcccaccagcagtgtagaagtgttccctgatcaccacatccacgccaacatctaccattttttaattttttgattatggccattattgcaggagtaaagtggtgttgcactgtggttttgatttgcatttccctgatcattagtgatgctgagcattttttcatatgtttattggccatttgtatatttcttttgagaattgtctattcatgtccttagcccactttttgatggggtttttttttcttgctgatttgtttgagtttgttgtagattctggatgttagtcctttgtcagatgtatagattgtgaagactttttcccactctgtgggctgtctgtttactctgctgactgtttcttttgctgtgcaaagttctttagtttaattaagtcccagctatttatctttgttttcattgcatttgcttttgggttcttggtcatgaaatctttgcctaagccaatgtctagaagggtttttccaatgttatcttccaggatttttatagtttcaggtcttggatttaagtccttaatccatcttgagttgatttttgtgtaaagtgacagatgaggatccagcttcattctcctatatgtggttagccaaatatcccaggatgatttgttgaaaagggtgtcctttcctcactttatgtttttgtttgctttgttgaagatcagttggctctaagtattttggtttatttctgggttctcttttgtgttccattggtctatgtgcctatttttataacagtaccatgctgttttggtgactgtaaccttatagtatagtttgaaatcaggtcgtatgatgcctccagatttgttctttttgcttagtcttgctttgggtatgtgggctcttttttggatccatatgaattttagaattgttttttctaattctgtgaagaatgttggaggtattttgatgaggattgtgttaaatttgtagattgcctttggcaatatggtcattttgacaatattgattcttcccatccatgagcatgggatgtgtttccatttgtttgtgtcatctgtgatttctttcagcagtgttctgttgttttccttgtagaggtctttcacctccttggttatgtatactcctaagtattttatttgattttttgcagctattgtaaaagggattgaattcttgatttgattctccgcttggttgctgttggtgtagagaagagctaacgatttgtgtacactaatcttgtatccagaaactttgctgaattcttttatcagttctagaagctttctagagaagtcttcagggtttttgaggtaaataattgtatcatcagcaaacagtgacagtttgactttttctttaccaatttggatgctttttatttctttctcttgtctgattgctctggctagaacttctagtactgtgttgaagaggagtggtgagagtgggcatccttgtcttgttccagttctcagagggaatgctttcaatttttccccattcactattatgttggctgtgggtttgtcatacatagatggcttttattacattgaggtgtgtcccttgtatgctgattttgctgagagttttaatcataaagagatgctggattttttcgaatgcattttctgcatctattgagatgattatgtggtttttgtttttaattctgtttatgtggtgtattacatttattgacttgtgtatgttaaaccatccctatgtccctggtatgaaacccacttaatcacagtggattatctttttgatatgttgttggattcagttagctagtattttgttaagaattttagcatgtatgttcatcacggatattaatctgtagttttcttatttggttatgtcctttcttggctttggtattagggtgatgccagtttcatagaatgaattagggagggttccaccttttctatcttgtggaaggaatagtgtcaaaaggattggtaccaatccttctttgaatggctggtagaattctgctgtgaatctgtctggtcctgggcttttttgttgttggtaatttttaaattaccatttcaatattgctgcttgttattggcctgtttagggtatctaattcttcctgatttaagctaggagggttgtgtttttccaggaatttatccatttcttctaggttttcgaatttacatgcataaatgtgttcatagtagcctcaaatgatcttttgtatttctgtgatgtcagttgtaacatctcttgtttcatttctcattgaggttatttggattatctctctccttttcatggttaatcttgctaatggtctatcaattttatttatcttttcaaaaaactactttttgtttcatttatcttttgtattttttttaaactgttgtttcaatttcatttaattctgctctgatcttggttatttcctttcctctgctgggtttgggtttagtttgttcttatttctctagttctttgaggcgtaaccttagaatgtcagtttatgctcttttagtctttctgatgtaggtatttagggctatgaactttcctcttagcactgcctttgctgtatcccagaggttttgataggttgtgtcaccattgtccttcagtttgaaacattttttaatttctatcttgattttgtttttgacccaatgctcattcaggacaggttatttaatttccatgtatttgcatggttttgagggttccttttggagttgattttgttttattccactgtggtctgagagagtgcctgatataatttcaattttcttaaatttattgaggctcattttgtggcctgtcatatggtctatcttggagaaagttccgtgcactgttgaatagaatgtgtattctgcagttgttggatggaatcttctgtatatatttattaagtccatttgctccaagtgaatagtttaaatccattgtttctttgttgactttctgtcttgatgacctgtctagtgctgtcagtggactattgaagtcccacaatattattgtgttgctctctgtctcatattttaggtctattagtaattgttttataaatttggaagctccagtgttaggtgcatatatatttaggattgtgatatttttctgttggacaaggccttttaccattatataatatccgtctttgtctttttaaagtttgttttgtctgatataagaatagctaaccctgcttgcttttggtgtcaatttgcatgaaatgcctttttccaccctttaagttttagttatatgagtctgtctgtgttaggtgagtctcttgaaggcagcagatagttggttgttgagttcttatccattctgcagttctgtatcttttaagtggagcatttagaccatttacattcaatgttagtattgagatgtgaggtaccattccatttatcatgctatttgttgcctgtgtaccttgttgtttttgctttttaaattgtacttttgttttataggttctgtgagatttatggtttaaagaggttctgttttgatatgtttccagcatttgtttcaagatttagagctccttttagcagttcttgtagtggtggcttggtagtggcaaattctctcagcatttgtttgtctgaaaaagactatatatttccttagcatatgatgcttagttttactggatacaaaattcttgggtgataattgttttgcttgaggaggctaaagatagggtcccagtcccttctagcttgtagggtttctgctgagaaatctgctgttaatctgacaggttttcctttatagcttacctggtgcttttgtctcacagctcttgagattctttcctttgtcttaactttagataacctgatggcaatgtgcctaggcaatgatctttttgcaatgaatttcccaggtgttctttgagctgcttgtagttggatgtctaggtctctagcaaggctgggaatgttttcctcaattatttccccaaatatgttttccaaatgtttagattcctcttcttcctcaggaacaccaattattctcaggttttgttgtttaacaaaatcccaaacttcttggaggctttgttcatgttttcttattcctttttctttgtctttgttggattgggttaattcaaagaccttgtcttcaagctctgaatttcttctacttgttcagttctactgctgagagtttccagagcattttgcatttctataagtgtgtccaatgtttcctgaagttttgattgttttttctttatgctgtgtatttcctcaaatatttctcccttcacttcttgtatcattttttggatttccttgcactgggcctcgcctttctctggtgcctcttggattagcataataactaacctcctgaattctttttcaggtaaatcagggatttcttctcggtttggatccattgagctagtgtgattttttctggaggtgttaaaggaccttattttgtcatattaccagagttggttttctggtttcttctcatttgagtaggctctgtcagagggaaagggctgaaggctgttattcagattcttttgtcccacagtgtgttcccttgatgtagtactctcccccttttcctgtggatgtggcttcctgagagccaggctgcagtgattgttacctctcttctgggtctagacacccagcaagtctaccaggctctgggctgttactgggggttgtctgcacagagtcctgtgatgtgaactgtccatgagtctctcagccgtggataccagcacctgttctggtggaggtggcaggggggtgaaatggactctgtgagggttcttagctttggtggtttaatgttctatttttgtgctggttggcctactgccaggaggtggtgctttcaagagagcatcagctgtggtagtatggagaggcaccagcgtggggaagggggtgcctagaactcccaagagtacatgccctttgtcttcagctaccagagtgggtagggaagggcaatgaggtgggggcagggctaggcatgtctgagctcagaccctccttgggcgtgtcttgctgtggctgctgtgggggatgggggtgagattttcaggttaatggagttgtgtacctaggaggattatggctgcctctgctgagtcatgcaggttgtcagggaagtgggggagagctggcagtcacaggcctcacctagctcccatgcaatctgaagggcctgtctcactcccaccatccccctctaacagcacggagtcagtttccaggcagtgggcaaggagggctaagaacttgccccaggctacctgcctcccagctgaaaagggctttagttcttcccctgcctgtggagtctgcatgccagattcgcaccctcccctgagttctggccaggaggcttctgaacaagttcatattgttacaaagttcagctggagacttccttctccctgtggcattttcccagtgcctctggctgccctcctgagggatccctgtggtgccaggcaggaatttcctgcttggggaacccagtgggctcccagagcctttctcgcagcttcctctacccctgtatttcgctcggctctctaaattgactcagctccaggtaaggtcggaatcttctcccataagctagaccttcagtttccccagtagtaggggtgtgttcagggtcagaggatcccactgcaagtgggagatccctttcccacttcggcagtttgggcactcacagtatttggggtgtctcccagttcctgcaggagcaggtcacttccttcagagggtctgtgtgtcctctcgggattcctggtttattcctgcagtcattctggagctaaaattcatgatgcaagcctccatccgctgctctgtctgtccaagacagagctgcgatctagccctgcctcccatctgccatgatgatcgggaaccaatccaaactgtttttcaaagtggctataccattttacattccagcaatgtatgaagatttaattctctacatcctcactaatacttgttaatatctgtctttttttattatagccttccctgtaggtatgaagtgatattgtggtttcaatttgcatttccttagttattaatgatgttgagcatcttttcatgtgtttactggggctgttgggattatctgttctatttctttacccatttttaaattggtttgtttttttattgttgttgtaagtgttctttatatattctggatactattgtcttgtcagatatatgatttacatatattttctaccattttatgagttgtattttcacgttattgatagtggtttttgaggcacagaagtttttaatttttttttttttgtttttgagactgagtcttgctctgtcacccaggttggagtgcagtggcgcaatctctgctcactgcaagctccacttcccaggttcgcgccattctcctgcctcagcctcctgagtagctgggactacaggtgcctgccaccacacctgactaattttttgtatttttagtagagacggggtttcaccgcgttagccaggatggtctcaatctcctgacctcgtgatctgcccgccccggcctcccaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacaaatatttatgcttatgatttttaaattttttttatagttttagcttttttcatttagctcttttatccattttgagttaatttttgtattgcgctctcttaagtaatcaattcaattaaaaacaaaacaaaacctctgagttgggtcaaatcaaataggcacatgggtcaccagttttgcaagttctgagcaggggatttcatagtgctctctgctactcttctgtcaggcttacagtcttttttgagttattggggagtaacccaggccccaaggaagacagtttggaacaagacttaccgtagtagtaggtactgatgggagctgtcctagggcaggcaaatatgctggctcccctgatgagaaaggccatatgaagatgaatgtgcttgcaagccggcttcacagctgggtgaggccttaccaggtgggattgaaactgatcccaggttctgggggtttcaggcctggcatgctcacctatacatatccttccagagcccaagtgctgccctggtttctggagatctggatccccttgctagtttactataaccagctttgtgatcacaggccactcactgaaccactttgagctttcagtacttgctctgaagcttgacatcaataaccttgtgttcaaattttgatgatcacttgagtcccaccaatacatgattaaaaaaaaaagctagaatggtttgattatggcagcatcaagtagtgtttccccaaatgtttgccattgaaatgagagaaaatgtacttgtttggtcaaataactgacactcactaaatcaaatacaaacagatgtctttactgcaggacttttcagagcctttctgggaacacatagcctgaatctatagaagggggatgtgctatgcagcttccacagtgtttaactgtggaagagttattgtaaaaattgaattctttccatttcaaacactgcaaatgaaaccaccatcatggaatggagctggactttcatctgtgtgtgatgttgtgtgggtcacaatccacgttatccaacctgatacacagagttatgcctcctagagcttcacgctctgttgctgcctaaaaaagtccataaagttggcctaggttatggagagggactctggtcctgtaaggctttccagtcttcactccaggtgggtctgacattcagggctgcctgcattcctctgttgggcagcaatgaaactctatgaaaccctagagtttacttgacctgctttagaccattggggcttgatcatgtcagaggtagaaagccagggtgcctctagacttacgcaccagcattacttggagtactgaccactataaactggccagaactgtgaaactgagcgctggtgtttgggaatgagtcccaggttcaaggaagtaagaaagggacttgcaaggccactgtgcaaaatgacctttcttttttcatcagttcagggcatttgcttattattatgaggagtttgggatggggtaggtaataatcataatgaaggaaaaaataatacacagtaacaatttaattaatttatacttcattaataattttataatgtatcctttttgcattctatttaacttctaggttttagacattttaagacaaatgtttcattgttttgcattcctaaagttaagtgttgagagttatgtgatggatggtagggtcagaatgagtatcgggcataggagagaaagctctgtaactgcaacaagtagatgcaaagggagatcagatcataagctcttattctgcacatagtaaaaaatgatgtgcatggtcaagtgttcattatactacagcgtcactctggccagggagggtcagatgggtggtctctctggtctgtgttcctcctcctcaacctggaagcttttatggaatgagcaaactatcctcaaatactgtccccctcaaggactaaggagatccatccagccagtcttcctttgctgatctgatttcactctgctatggcacaaggcttttaaactttcaacaatgtagaaggctttgctggtagaaccactaaggagacccaggttccacacactgatttcctttgtgctgggatgcaaaggtgaaaccatacaatctctactcctgggaatatcagggggagactggacccaggtaattttaagtttaggctgagagcagtaagatctcagaaaaagacaggtacagatttgggagctcaaaggaggcaaagatcatttccagctaatgtgagaggtagaaagtctctgtaagacaaaaacaaacgtaggagttgaatatgctgcactggggaaaggatttaggtggcttcttctgagagctcctgaaggcaagctgcagttatgtgatgagataaagtgctggactaggatgtgtgaagtcttacattgtgggccctggggatagaaaatttaaagcaatttgacattctttctgctccagcaccatttcctttgaagttctgggggacctccccttagtgctttattttgatgatgagtgaaaaaactcatggctctaaatgtcatctgtacactaatgactccaaaatttacatctccatcccagacctgagctccagacatacactcacctgctgacttgacatctccccctgggtggctaatagacatttccatctgagtgcatcccacactgaactcttgatttcctttttcactttgattgctcccaactttttaccatctcaataaatatcaccaccacagatccagttgctgaatgaagaaaagttaggccattcttgattcctctgctcaacatctttgccagccctgcccccagtcccccagcacattatttcacctctatctccagaataagttccagctgccatgtctgttcttgccttctacagaccactccacacagcaggcagatgaatggcttaaaaaatgcaagtagggccaggtgtgatggctcacacttgtaatcccagctctttgggagacccagtcaggtgggtcacctgaggcccaaggtcaggagttcaagaccagcctggccaacatggtgaaaccccatctctactaaaaatacaaaaaattagctgagtgtggtggcgtgagcactagtaatcccagctattcaggaggctgagacaggagaaacgcttgaacctaggagggggaggctgcagtgagccaagatcacgccactgcactccagcctgggtgacagagtgagactccatctcaaaaacaaacaaacactcaagtaaaacagccactttcctctttaagcccccgcagtgacttatttcacttataatgaaatcaaattttttaccagccctctggaacctgactccgttctgctctccaatggtagctccttccagtctgcccagtctctgagctgcagccacagcagacttcccgccgatccccaccaccagcctcactcctgcctgggggcctttgcacatgtcactgcctcagggcctttgcacatgtcacttcctctgcctcaaaagctatttcctgattctttttgtggctggctctgaccttgctgtctggcacgccctctcttctccatctttgttaccacattttatcctgttttacttgctataaagtgaatccatatatgaaaccttcttgtgcagttgtttatttattgtttgtctcatctttcttcttttctatcactggaatggaagctccatgagagtgttgctcttttttcttcttgatctgttttgcttgatttgagttggcccctacattttccagttgatcagagggggtacccatttattctaagtctcatcatgagttcatagatttaaacatacttcatgcgtttcaaccaagtaaatatttgtttaatgaatgggacattgaataaatgcaagttaagaactttctataggctctcaggttttttttttcttttcagactttatagtaccagattttatatgaaaaatcattgtatgatttttttctagggttaattctactatttgagtattttcttagtactctggggttttattgaataaacaacataggccctgcttttatggatacttttatccatctgctactgaacacaacagttttaattagatcttgaattattttattatcaaaacctgctgttgcatcctctgcacctgtcacctagtaagagttcacaaaagtatttttaacatatttataatggaaaatttcaagcacatgcaaaagtagagagagttgtatagcaaactcacttttacccatcattcagcttcaacaattgtcaaaccaagaccaatctggctttaactaattccttatgttgaagcaaattcaagacatcctatcattttatcagtaaatatttcagagcatatctctaagagataagaattcttcagagtaaataaccgtaataccattatcacatctaagcaaatttataataatctctgaatatcatcaaatatgcagagagtgttcaaaatttcctgaatgtctctgtctttctctctttttttttaagtttatttgaatcaggctaagaagttccttaaactgcagtgggtttattatctctttttagtctcttttaatctatagttttccccctttctttttttttcttgaaatctgtttgtttaagaaaccatgttgtttgtcctatggagcgttccatagtctgagtttgctcgttgcattccagtggtggtgtttagcgtgttcctctgtcctctgcaatttctgtaaatgggaagtaaaaaagtttgataagattcaggcttatttatttggaaagaatacttcaacttcatattcatccatggaggcacatcttgtctgattcttctctctgtgatgttgatgttagggatgttgattctcattgtccagatccagtctttcattagggtttgcaaaatgttactattccaattctatcattctttctgcatatattaactgaaatattttataagaagaaaattgcccttatttagttatggtttgtataagaaaggcatataaatgcttgattctctgtcttgatcagttttcaaaataatgagttgttctctacattctccaattgatcagtggagtgtttaaatatcatcatgagctcatagatttaaacatacttgatgcatttcaatcaatggatatttgttgaatgaatgagaaattgaataaatgcaagtttagaattgtctctaggctttcaggtttttttttcctccactccagactttgtagtcccagattttataaggaaaaatgttgtatgattttgttctagggttaattctactgcttgatatgtccttagtaccctaggacttttactgaatgaacaacataagccttgcttttatggatacatttatccatctgctactaaacacaccattttcagttagatcttaaatatgttatcgaaacctgctgatgtgtttcccacctgggaaggtgttggtcactgatccacaggcaattgcacttacctagtcttagccccagcttctatactgtggctttgggccatcccctcccctctgggcctcagtttccccatatgaacatgtaggggtggcactatgtcattatgaaggctgtttccaatccttacattttggggagctctccttcttccatactgcatgtgacctctaagtaaaggccatgtaagcagcatcagagggggcaagcagagtatcagggtggtggggtggaaatgaggagtgagacccacaggccagggtgagagcctaccatgcacaatccaacaagcagctcaaaaggacccctcgctgtaatacacctatcattgcctgtgtggtttttctttaataactttctggagtttggtgggagcaggaggtgccaaccaggttaggaaagatttctgggattctctggtagtatccaaaggaggaaagactaggtgctggatacaagaagcagtttcaaagtatgagcctttaagcaggttgattggatatctgaactatccccaaccagccctgggcttccttttcagtcatctctaccacctgtcaatgttgcgctttctggaggctgaaacaaccttgccagctgccctgcccatctgagaattcagacatctagagtgccagagtctgctggcatctcccttttgtcaactgcagggttagattgcctgggaatcgatagccagaatccatgagccatctgatgagtagacctgctgctgagctgttgtctgcatatcaccctccaattacagggcccccatttccccgtctgtttcatcatgcaacccaagcacccaggtagaaggccttttgacctgttgctcccatggacctgctgaggtatcttaagatgatgaaatgtctctttcttctgcctcccacactagctgccaacagctaggagctgatgggctttgtgcttcttcaggaataagggcttggctgatgatagggtgtggtggcttatatggcatcatccacagctcttctcagtccctaggtggtagaaagaaagaagcagctggcaggaggctactatcctgcctccactccatcagactcacagttcttcttaatcactgccattgctaattcttactgagtgtggacagtggacaggccactctatgaaggaggagagatgctctttacctgcaaggggcttgcctgatggagagtcccagaaaatgtcttggcacctgtaggtaacgttagccctttctcctatttgaggcagttggggatggatgagtagatggtcagtcacatcagtggttggaaaccatcccaagagatggcttcctggtgtttatttggaagtgctgaaacaattggatatccataagcaggaaaaacaagattacctcacaccatatacaaatattaactccaaatggatcatagacctaaaaggaaaaacaaaaactataaaatttctaggaaaatgttttgaccttagggcaaagatttcttagatatgactccaaaagcacaatccataggtgaaacattggtaaattggattcgagaaaaatatttgtatatcatttatctgaaaagggatatatatatatatataacccttaaatgcattagtaaaaagtcaaacaactcaatttaaaaatgagcaaaaatatgcatggggatttcagcaaagaagatacacaaatgatttttatacacatgaaaatatgcccaacatcattagtcagtaaggaaatgcaaattaaaaacacaatgatatactactttacactcactagaatggatataattttaaattcaaaaatggaagtcttatacaatactgctgggaatgtaaaattgtacagctgctttggaaaacagtttggcagtttcttaagttaattataagtttaccatatgacccagcaattccactcctcagatttttactcaagagaatgaaaacatatgtccatgaagtgacttgcatgcagatattcacagcagcattattcataatagccaaaaggtggaaaccatccaaatgtttatcaactggtgaatggataaacaaaatgtggtatatccatacaatggaatattgttcatcagtaaaaaggaatgaaatactgacacacattacactatggatgaatgccaaaacattgtgctaagttattgaagccagatttttgaaaatgttgaatgagtcctagaaatgtccagaaatgacaaatccacagaaacagaaagtagataagtggttgcctagaattagggggtaggagcagttatggggcctgagggacatttacggggtggtagacatgctctaaaatttaattgtggtgagaactctacaaatttaccaagaatcattgaactcataaatttactcaaattcattgaataatttacaatgaattttatgatatgttaattatacctccataaaactgcttaagataaaaaagaaagaaagagaagtagattccagaatgtattttgccaaaggaaccatggacagggagagaaggggagagtgggctttggaccccgtgggacaagtctcagcctccagggaaggctgcaggccactggtgtgaggacctgccattcccttctgcaggagtggcagtcttgggcagcatcagcttacaatatcctgctcccaggtttgttctctctttctcacccacatatctgggaccattcctgctctctgaacccctcagccaccatgcctttgacttgcagtcacagacttgcccctctccctgctctgatgtcagctgtccctctcacccactctgtttttctgaagcctaggtcctctgatgagcatgccctgctttctagtgtacatcactgggccatggatggctgggcttagagttgttgggagatggtctcaaacctaggtaggaggaagacgtggtagaagcagcttactgaacagagaagggtggggtagcaggagctgaaggaacaacatgtgggacatgggtggaggggaaacataaagaccctgagatgcatacatggcacatcctggtgctacaggagggactagagccgacccatgaaggcccattccagggccacaacccaatgactggaagtaggaagctcaggagctgcagaggcatttgtggttgactttgctggattttgagaatcaagacacactttgctcccctcacatctcccataccagaaggttgatctttgccattggtttagttatttacttccatgtataaacagccctaattttggagcccttattatgtggaagactctatagaaagcatgtgatagcattgatttgtttaatcttcacaaaatcttttgaagtaggtgctattattaccactccattttgcagatgatggaactgcagcccagagagtaaagtcagttattcaaagtttgagattcaatcacagttatctcagttcctgcattcccccaggttcctgctcaagggtagatttgatggggtaagaggccaggctcttaaaggcccagtgtgagaagacttcaggccttcagacaagtgtatccactgtgcctggcagggggaggagtatggaaaggagtaagagaagaagctgatatctcctccctcagaagagagggatgggtcttcccaaggaggtgttctgagaccccaaggggcctgaggctgcctgtctgctggagggagaggaaccatgctgggcagggcaccccaagcccaaaccccagccccagatgccaagaaagaccagctgcatacccagatcctacattagtaatgtgcagacaggtagaagcctgggccagcaggtctgtccaccctcttgcgccctctgccctgaacactgcaaaactaccaccttctctggccacagcgaaatgggtgggatcttttgaaagaatgatctgtaagacctatgtgctgatggacaaatggacagagaaaggcattgccagcacaatctgtgaaagagagaggaagagggagtatgggagctggcacatgctgtgcccagagaaacctagtcatgcatctttcttagggatcatagcaaagagcggcctgggcctaaaaaattccagtgacaaaggaatctcaaaattccaaagaaattttaacatctctcatatgccttgatattcaacctgcactttttgtgcacgtactatgtgcctagcttcctggacagagaactttgcgtagaacttggcaggctcatgccctttgctgagtcctctttccttttctctggtttctataactgtagtaacctcattgggaggtcattgggataagagttcttgtgagcagacagcacaatgctccaatatccagcacccagcattacagtgttaagcccaaatagttctgggttaggagtgtatcagaaatcatggacatacgtaaaaacaagcaaaaaaaaaacaaaacaaacaaacaagcaaaaacccccaaaaaccaaagaaacactaaacagttacccatgatcgcatcttctcagaggattaatgcctctcttgggcttagacagtaataacccagaaggctagaatgagttgatcatggggcgttgagtctacagagtgatggtgacatatttctgggcctatgcctacatccaaatggataaccatgcctgcattcagtgggtgccatatgaggagacttctgccttcattcaaacaaaatatatgcccgtttatccaattgaggcccatacccttcctcaaaaaggggctcatgcctcaatttaaatggagcccatgcctccatccaactggttcatgtagagacttctgcctgctgttgctgccacagatcccctgaccccatcagtgcaaacactctgaaaggctctgctctaaaacctggtttgggagtaggcctccataagcacgtcacctccttgagcccaaccatcatcacatagtggagtcctgccgtcctgagctccctcgtggcagctctccttctctttctcttcagcttgattgttattccaaaggcctcgttatggaaattacaaaataatggttctgcaatttgtgagtgtgtggttgtatgtatgctaattatcattcctgggtaccctgtctcagaggcactgcagaggaatccagagacgtggctctctcttcactgtagctttgctgttctccccttccctgcctcccttcaccccagctatctccattctctaatgcatgggggcaactggagtgttgagtagacatggccatcccaagtccattttctgtgtccagcggggtacctggaacttaggagtgcccctggctggacgaagaggtgtgacagtgcatctctgtagcaagtgcactgttttaacagagatcctgtttgtttgaggtggctttagtcaataatgagggatgggctaatgttccacacttcttgggattgtcactgtagcaacgctgcctccctggcctgcgcacttctccctagctgttacttgtaagattgggaaagggagaaaggggagagaggaatctcctggggaagcgaggtattcctgcaaagcctggtccaggtgtgatgcactctgcagggcaaaatcatgggctcagaatgaggcttcacagaggaggtagagtgtgcccaagggcaagatttcagaagggaaaaagtagggccagagagaagggggaggggtgcaggaggagaaattctgccccaaaccaaaactcttatggttaaggacaaggttaatcagattcttttgaaagggaattgtttctggggtaagtgaaaccttcttaatgataaagggtgaattgctccagtcagattacccctggggacacttgggggtggggcaaaggtagcatcgtcagaggtccaagattgaatagtctgaggagagagtggtcctggaggagaggggggacagcaggtgtgagaggggttcagagactggggtggtggcagtgggacaatttgacatctttaggatttgagtgctgttgagaatgggtggaagtcatggcaggaagcttcaaaacacaccttccctgtactttgatcaggcttgggtgagctacttaacctctctgtagcttgggtcctgcatctgtgaaatggtataataatagcacctacctcatagtctagtgggagaatccaacatgacaatatggctaagcccttagcgcagtgcccacccagagcaagtccttgcccatgatgattattcactgttattattgtgcactgctattgtgttgttttgagagttgagtgatataattcctgtacagcctctagcacagtgcttggaacttaaccactgaatattcaccactgcctgttgcttttacattcagcctcttccagttcagacaggcatcctctattgcaaatctccatcctatctccatctagagacacgaggagaatcaggtgaaggaggggaggggaggtggaagaaggaggaggttagctcagggttctaccttaccttctcctctatcatcaccagagcatgtggagtctttgaggaatttcatagtcttggtacctttgaatatgttcctcacaagttctcagaatgtgtggcttaagtctttggggataattattttaagctactttagaaaaaaaacctgtgtattaaccatatgtatggagggtggagggtgtttatgtaaaaatattccagggttttcgagtagaatcagatttgctaaaggggcttacaaaactctcacgaggatggagagacaaaggttagcataggccactgaggacttttaggttggccactaattattagggagccagtagccagaagaccctggcagggatggtcactgcttctagtgctgaggcaagtagtacatagaaaaaacctggaggttactgcaaaatgtcatgtctgccaaaacccatgggctgctcgccactgctgcccaaggagcttctgctctcttcacctcctgtgtctggtaggagtgcttcttattggtggactgtaacccagacccctagaggctggtgttctgggaaatatggcttacatgtttccagcccctctgagcctgagaggagtataatggggctgatttgccagcggacaatccactcatgtggatgtgaccccttcaatacctaaatggcaatgatcatggatgcagagtcagggccaacatcaggagagcaagagggcacagaatgctcaccaatttgctgtgggcagaaaacacagagctgcatagcttctgcagggaaagaggagaagaagaggaggagggctgtgtatgcttccctgtgaggcagatggaacggcagcaggagtggggagatccaagcagaaggcccaggctgggaggcatgaaatgcaggctcttcccagcatgagtgattggcagggtaggcaggactcagaggcttacaggaaatgtggcttgtccccagaggaccctaaaactgggtcaggactgatagaagagactggggaagccatgttccgtgggagaactgcaggggcaccacggacagacatgagagacaaagaaccattgcagatatacagtcttataattaactcagttcaacaagtacttgaaatagccacatgggctgggcaggaccttggacacagaagtgtgcaaagataaactggttacaggctgtgctctcagaagagtttcttgagagaccaaatgatgatgacgatgataacgatgatgaagaactaactcttctgagtacttgccatgcaaatcactgtacatgcattatcacattcctaatttacagatgaggatcctgagacttagaggttagtgacttgcctgtggtcaccacataagtcttgagaggatctatacctgggcttccagactccacatcctgtagggacagtgctaaggggattctggaaggagacatgccaactggaaaatgaggaatactttcatggatagggtggaatgtgagctaagctgtagagaataggacacatttcaggtttagagatgggagagaaggacaccccagatagtgagattcatgtgagcaaaatattggaacagcataagtcacatagtagggaaaagtaaaaaagagctcttgaaagtctcacttgtctagtcccaagcttccgcttatttaatacaagtccacgagtattgtctaggtactggcaggctgattcatagagtactgggggcagggagcagttttgcaggggaggcaagcaggtgagcagacagtcatacccagcatgggacgttctgtagttgaggcatgtggaagtcaagagctggcacaaagcaggaagtgcttccgtgcgaggggcctgagcaattctgcacgtggatgggaactcctcaggcagccaggcagaggaagccagaaagccatgtccagctgtgttcaccgggagccagtcttccatttgcctggaattctagatggtatttgggaggctgggacagggagagactggaaaagtgagcagggcctgatgaccccattggagcagctgtagaaagtcatgtcagggcattgggctccattgtgaaggctggtgagccctcagggttttagacaggaaagggcactgtcagatctgtgttgtgggatctctggcaggtgtacagaggagaaagcagcaggggggaaattagggagctagtgacaagaggaaggcctggctgaggcaggtacagaaagagggagatttaacaatagctcagaacgtagagatgacaggacctggtgacagttggatgtgggaagggagggagggttagggaagcaacaggctttgagacatttgccttaggctgtccacaggaaaagtccaatagacaggttgaaaatacagaagagaggatgaaggcattagggcaaggctcagatcccagcagaaatggcatgaaatgagactgagggtgagagtaaggggagtgtatggaggggggattaatttctgtcaccaggagcaccttctcccaggctgaggaggtgcaggtaggagaaggtggtgatactcccacctgctgttctcctatttttctaactggagcttttagttatgtgcgtagtatgtagaagttagtgctacatatgttaattgaggcctgcatattaaaaataatagaggccaaatgagtccattgaatcctctgtccctctcactccatccccaagctgcccagaaacacagactagttcttgagcccctggtttacatgaggctccagtctcaccctggggccccctcccttcccaggagcaggtgatgatgacagttcagtaggtgtgtttgtggtggcaggatggtgaaatcgctactgaggcagtgggtagaatctttgttggagttggctctccctctgcctgccttttcaagaatagattttttttcttttctttagctcagggatatgccaagaaaaatgaaataaaagtaaaggaaagaaagaccaaagtgtgtttaattggaatagctttttgccatgtgaaaaagcgacagtttattgcaaaatatttatcttcattatggttggtatcattattgatggagatgccctgcacgctaatgggaaaatctctccaggaggcccaaatcctgatgagctgagtctccaccttacttctgacatgctgggtgagcacatcctttaatttctgggtgcctcagctcacccacccgtacagcctagaaaagacagtgctcatggttagattagcctcgtggagctggaagaagtctttgaggtcagggcatgagaagctccttgtggcaaggactgcaccttgctggctgttgtgtcatataggtcccttgcttaacggaggtgtgcgctgactggctgcgtgatggatgaatgacagagagcgagcctgtgttaaaggaatggcagatcgatgcatctaatctaaccattcatttcacagagaaggcaattgcagtccagagaaggtgagtcacactcatttgctgcagagctggctgaggttcagctccctcattcccaggggcctctccatggttatacccagcagctccacggtccttctattgtgagatattgtagaacatgaatgagaatgtacacttgcagttgtttttgctattcataataaaagaagcttacaaaagtcaaagtatcacttatcatgatggatgtttgataggcccagataagcagacgtaggagctgtaatgaacactaaaatcaagccttgtgtgtgttcaccaataaacagcaaaggtgagggaattactcttatttaccctccttatccccatttcacagatgagttctcgctgtggctcagagaggctacaacagaacttgcccgcaacctcacaggtagcaagggtttaggaactgattctggaacctgggtattcagagtcagtattcagggtgaatttcattgacccattgctgtcttctgcaacattctgggccactggctttaataataatgacccttatctgtgcagccacgagcagacctggcctagggctcacctgtgttctccaatggctgagttagttgattaacacaaagaggcaatgagagcaaccctgactttgaggaattcctaaagggaagctaagcgtgtcttcccaagtgtattacctggtctcagaagtttatagccacaccacataaactggtgcagtgagacatttggctgttctcttggaagagacatcaagagtcatttagaactcctgcatgcaggtttctggtcggtgtcaacacatggaaagcttctggagggctgaagcctttaatgagtggttgcttccttctcccaactggaatcacccaccttggagcccaggtttactgctctgagattgtaaagatgccaaggaatggagacagcctggttttttattgtgcctgcctcagatggaatctgcctctctggacaaagatagcatcacaaatgtttgatgcgggtgtctcttcttgtcctgaggacccgggcctctcagcattgcccagtgttcctcagcacacacaaagctcacagccatgaggcagctgggccttgccctccttgcctctgtctttcccaggtgactggcatcccctgccacatgtccatctcagcatattattaacacctccttctgtctcagactgcttctcttcccccagggagtgctgtgggtttgaaatgatggtctttaatcatttcttaagtgaccagccctgaaatcatttcttagtgccatacacacaaattaaatcataaatccacagtgggctctggaaagaactgaagtgcagcccctgattaagagctgaggggaggcctccccaggagaaaggcgtcagtgtgtgcctagaggaaaggccagggccctggagagaagaaagaagcttcctactaactccctttccacagaagggcctctttgcatttctgttgttctactccacacaaaagagatatgagaggatgcagacagatatgtggggggtggtaggagggcatccatgttagggttaggaagtccgggcagccccttccaggaccgagctgccttaagaatccagaatcagccaggcccaacaggatccttaatgacctctgacggtgggatggaggaggaccagaagagtgaggaattggtaggcacacctcaagagaaactcagaagtgggggtaggggagggtgttcctgaaacatgtccatgctccctacttatttcaagactcagttcgacatcgtgccccacttcaagacttcccagcttatttggaacactcagtctctctcctcacaaacacaaagtcttctgcttgattaggttggtgatgggtatatgacaatgacactagcaagctgctaaacatccttgactctttccaccaccatgcctttatgcatgacattttctcaccctggggtgcctaccttcattttgcctacctagtaaactatgaatgcttcaaagcctgcatcagttgtcatctccaccaggaccctcactctccaaactaatatagagaggagactgcctgttctctccccacccctctatatgcttctcttttcacactcacctgctgttttataattctcatttttaacatttggttcttccactgagttttgtattctttgagaatggggactccagcttactcttctctgtaaagtcagagtggccagctcagggcttgaattcaaggagtgatgttgctgaagctgtatagtcaagtggttggagcttcacagtgaaagagctgttctctattttttgcctccagcatgctttgcttatgtaagtcactcaacttctgaattgagaatctgagtttcttctgcaaaatgagaaaaataaaaccagtacctttactattgcaaaagcctacaaagaagataaatctgagagtgggttgttgggggaatgtgtcaaaaccctttagctcctgaaaaattccattagaaagtcaaggtgttggtattgcaattattatttgattcccaaatggtgagagtgcttccagaaatgtgctttgcttgatgaaccgatacatttttagcccccactgatgaatttgggaatcgaatacctgtcatcttgaaataattgacacatcttggtgaagcacttagattcctctgatgaaagtctggattcttactgaaaatgagaaggaagctgtgttacatgggagcaatattgttttatggacctttatcttagttattaacaaatgagtgttacatgtggaaatggtaaagggggaattcaataatgaagtttcataggattataatgattattagcctaatgatgatgaaatccaggtttcaatgcatgtggtttccttggcattcactgttctgtgccctttatgctgatgggcagcagcctggctgcatctgtccctaacatcccatcctgaagttatatgggaagtgggcataagtgtagtcggctcctctagcaaatctggattaggatatccatgcacaataatataattattattgtagtaattgttattgcaattagttgcccatatgtcatgcaaatagcaaaaaacttatattctagggagccgacacccactagaggtaggaagagttcgcatcagtgaatgctcactgcctgccctgctgctgagctgcccaagggtcctgtggaaaaagcagccaatctcaccagcatttacactctattcatttttctctgtgcaccagaagccactgtaaggatgaatttgcctttcagagcaggtctctgtagaatacccagcagccacatccatgcatcacgtttttacatctggtcaggaattcaggcaggcaggaactcagagggactgagagccagcatatgacatagaccatacttatttttttttctcttcctttagaggcaggaaaagtaggacaagatgccctaagtgagtagaaaagatattcatcttgtccctttcctaagcctctcgtctgaactcatgttgacttgaacatgtgactttttgagcctgagtacatatgcccatcgttacagaatgtccccacccccatagataacttaccatagtaaatagctggaaagggcatcagctgtgaagccagacagacctggtggtgaattatacctccatgacagagtagctgggaaatattgggcaaattgttttatctctgagcctcagtatcactgtcagtgaaatggaaatgctactatcttctcatatagtttcatcgaaaagaaatgttacgattacatttgtctgtaaggaacataaaaatgaaagataattgtgggttttaaaaatacagggttttttttctcatgtaaaataagtccgggttggatggcactccatggtgtgatgttggaaacccaggtgcattctacttcgttgctttgacattcttagcacacagttttcacctcatagttgaagatggctgcttgagttccaaccatcatgtctacttttcagccagcaaaaatgaggaaggatggaagaagagctaactttctcccagaagtcacataggatactacttctccttgtatccctagatcttagtgattcaagccaatactcatgcattatcaaagcttgatgggaatgtcccatatggtaggggaaaatgttgactttgaaaaatagaaaacattagcaaggtgatgacacattgtctatactcaacatattatcattttataatggaaaatattaactgctattaatacttttaattgagcagttatttcatgccagatattgtatcaaacatttatattttctatctcattcaatcatcaaaacaactctatgagacagggactaatttttacacacgaggaaactgaggcttaaaaaggttgtaggacttgctttccatggctctaagtagtagagtctgtaactgaagctggtactcctttctccaggaagttatgttggcatagttgatgtttaacataagtagttatacacaatagtttttgtttattccaggtaaatttacttggtataaaaatactccagccagtaagctatcaagtctctggagtcagcagcctgcattcaattcccaggtgtaccaccagcagtgggactttgaacaagctactggacttatttgagccttagttttttaatgtgcaaaattggaataattgtagcacttgtttcttggggctgttgtgagaataaaatgggattattctgagtaacatacctggcctgtgccacatgcttaaattcttattgttgctcttattaataaaacaattgttattaataccaacacaactttacaaccaattttaacacgtggtgggtagcttggcacatagaccttgccttggaagggtgaagtgagacacatcaggtgccgagggtaggagggcctggccatgcttctcataccagtctctcatttattaagaggcctttgctggcctgaccgtaaagcctgaaaggtgagagtgggcacaggagagcaggacccttcctgggcatgagagggagcaatgtcgtgttcacctgtccagctaggctcctgtcattccttcagctctgggttcgtgtcctgctgtttgctttggggaagtcctttctcaagttgctcagcagtgcctgctgctcctttgccccattcctccctctgagccttccctgagttcctcacctgctgctccttctctaggttcttcctgacgtgctgagccttcagttcaatggcttccctaagtgtgcattgagatctaagtgctaagtgtatccttaacacctctaatctctgctgcaagcttctcccctaattgtgtttcactgacaaacctgaaggcagttggtgatactgatgttcatccaggaaactgaaaataaggaggacatagtgcactctggaaattacctctcagcacctaggaataaatgatctcaggagagaatgtgactatccaacccttcgctgcctctgttgcagtgggaggcctcacccagatgatctgatttgcaacatccactggtccattcacatgatctccagggatccagtgcctatggctggctctgctcaggtgctcaaaaggagggtgtcctccctattccagaacctgcaagccccacttctctttccaaagtctgcatcagagttggtgaggtcctgagcaaaagtcgcaggtcagacaaaatgaattctgccaaatctctctgccttcagccttttggataaatctcatgcatatattctgccttgtcatagtaactcttacttggagaatcttttggaatgactataaccttatttcaatattggttattactcatggttgtttcactttttaagaattgactctagacttgcaaagtgctacatccactatcactgcaatttaggagctgagctctgactgaacaaacccccctggcaacattgtggcagagccagttagacctgactgattcctccatgaccttggacaggccactttcctctaaataatctgcttagggaggtccatgcccatgtctgcagtgccacactgggcagacaggcaaggacagggcagtgtagggggaagggtttctgccccttatctgtcaagacagctctgataatttaggctgagaatttcagcctcaaagcttttgctctgccattaaaagaagtaaaaattatttcttttgcttacttgtcccacttgaatgctgtgtaatatcattatagatttatgtgtttatgacttcgtgacctggggagaagctggaaattccactgagcccatttctactcctgggtttctgtaaaggtcacagcaaaattattttatcaagtacaccacagaaagggaaaatcttaatcttaaattatacatatgcagcacttgaccttctcttgagatgcagcacctcttagctacacttacttaaacagaatgcagctcttccctgatgcacacagagagaataattagatgcccttgcatcccagttggagaggaggctgtgcagtgggaccaactacaaagctgagaaggagaaagagttgaggcagttgggatgggggtgggggtgagctccacagagctgcagcaggctcatgcttatgatggggccatctgggcaggtggagcagacattggcaccatgacttgttctggttcacctgcacctctggccaagtcattgccttctctgggcctcatttttgccatcataggtctgtgatgtggcaattcaatcacaggtagtttgtgcctggaacattgtgttaaagtctcagcactctgctgtgggttgagtgggaatgagtgccgggattgattagcaatgtctgccacggcaggcatggagaggtagtgacagtatctgtgctgggtattggtggccccattctaaaaggtatttctaaggtcttttccagccctgtctgtctgtaatttgtgggctcaccaaactctggggtgaggaagcctggaaaggaaggaacaatagcaagcttccctaagagaagagttgtatttgcctcgtcagagtttggagagtaatgagatttgtgtgatacatctaaacacagttgcttgtgtgtgtgtgtttcctatttgctctgtgaaaagtagagagagcaagtgaaagcagtgcctgtcctcggtgtgaccactcagcagacctggctgacctatgtgtgccctcgtagccagcctgtgcgtctggggctctggaaaaagtgagaaactctgggtggcttcttgtcattgtccagcctttagatagaaacacagtgagaagtcatcttcatttatcttaagaacttggttataaattttttttaaacggaatccattaaggtctgtgtcagggaggaaagtgcttaaaaaataaggtttttctcaaaagaaaaacacttcggtttgaaaacgtgggaagcagcctgactgccagcatatgtcctgctcatcccctgcctggagctaccagattgatggtgtttttagaacactggcagccgggcactgagaagggtggagactgggccttgggaggggacagttggggattcccctgtccttgttgatgctgcagagacctaggcctagcacccaagaaggataaatgacctggggctctcagagtgaccaaagtgatgggaccctcccttctgttgggtgccaggggccccgtgaagcatctccctgttggttgagaatgaagtgcaaaggggatacctccctttaaggagtccatcttggctgctggtagggtgcttctgctctcttctaaagcacaggttcctccccgctgccctctagcatgggcttaccacttcctttacctccctgctctgccctctgagaactgatactgtttccctgtctcctgcttagctgtgacatcacatcttctcaaggagggcacagccctgactctggagtccaacaactttccctccctccctccctcccttccttccttccttctttccttctggcagagtctctctgtcaccctggctggagtgcagtggcacaatctcggctcactgcaacctccacttcccaggttcaagcgattctcctgcctcagcctcctgagtagctgggactacaggcatgcgccactactcctgactaattttttgtatttttagtagaaatgaagttttgacatgttgaccaggctgatctcgaactcctgggctcaagtgatcttcccgccttagcctcccaaagtcctgggattacaggcgggagccaccaaacctggcctggagtccaacatcttaagaattccacccccatttagctgcttgctgcctctgcattgggggctcctccagacccccttacacttctgattcctgcgtatctggaattcctcactccgtgtcaatggccttcttcttacccaatataaaggcagtgactagctgatatctatctcagagcacacagaaagtgctccccagatgtgtgttgagagaatgagagaatgtctataaaaggaaaagagctcatccttcaaaagagatttttagggtacactaacatgagtgaggaggtggagttggggacacagagacatgatggttcacagaaaggctggacttgactggggtccttctgtgccaactcccaggccactccccgcactccactgccctctctgccttgtcctgctgccagtggggcctcacttctcgccttcttgccacaccactcacactactcctacctactatttgaaaaaatcttccactatttgaaaaatcttttttagccagacacggtggcccacacctgtaatcccggcatttttggaggccaatatgggcagatcacttgaggtcaggagttcaagaccagcgtggccgacatgatgaaaccctgtctctactaaaaaatacaaaaataattagccaggcctggtggcacgtgcctgtagtcccaggtattcgggaagctgtggtgggagaatcacttgaaccctcaaggcagaggttgcagcaagctgagattacaccactgcactccaacctgggtaacagagtgagaccctgactcaaaaaaaaaaaaaaatcgttttccattcaaaaaagtataagttcactgcataaaaattggaaaatatagatcataaaagatttttaaaatgtgcataatctcatcactataagaaagtgaaatctttaagaacaatatttgttcccactatttgccaatatttttagatgtcactaaccacaggttttcaccatctttcttgatggggtcatgaatttccatttatggatgcactataatttattgatctgaccccttattttagggcttttaagctgtaattaattttttcttgctataaacaatattgccatgagtgccctcatagttaaatctttgagctatgtgtgattatttcatttgtataaattccatcaaaagaggagcttgagcaccattaggccatttgcctctctgggtcctacttctccatcaagccctgggaaagagggcaggccagcacacagcgacatcagccttgctggtgtctggctgctgtgaacctgctctgtcccactcccctccatgctgatcatttcaaggttgtaagagccttggagagtgaaggaccaggccctgccccttcccagtctctgcccactggtcccttacttccctgttagctgcattattgcctccttccccagagtccccccatgtccagtgtgtaggctccagaatgtcgggtgtctgtgggggcagatcgacatgtttatgctgtttctcctggggctgggccgtggacaggaggggcctgtcggctgcctcctccacaactcctcccatgtccttcccttgccattctattctgaggcaggcagggccaaggaataagttcagctgagcccctgcttcctgggtgacctaagaaaggcaagcaccttctccagcctcagtttccccctgtgtaaggaagtacagttgttcccagctaaaccttctccctcctgctttccctcttctctgctctctctgtcttcctcagtgctgcagcatcgtacctttcctgacccctctgttggcttaaagctaaggaaccagcccatggggctctcagcagctactggctgtccagttggcctgctatagaggagatgcaggtaatgctgcagcttcaggggcaggaatctctggtcagaggtctgttccctgtaccattccaaagtccagaaggctcttctggccactctgcagattcctgagtctgaagattggtttctctcccacatagacacaaatgttgttcctctagctttgtctgcaggccagcggtcaagggacagacttggggtgcagatgcagctgctgcaggaagagccaaatcagtcctagtctctgagtgagactctcaccttctctgctctggacacttcatactgccactcccaatattccccccaaagttatagggacagggagcccactgccaaagtattggatttctaaaagaggactccagaaagaggaaaatgtctagccctagaggatgaagtgtagagggcaggctttctggggtcagcaggacagcagggacacaagcggacaacaggttgcagtctttgactccttgcacccaaccccgtgcctggcatctagtaggggctcagtgcttatctgttgaatgaatgagcaatccccaatcaattgccagacacttctcttctagatagctcttgaatctatctacttctctctgttcccactaccctaatccattatcaccttttgtgggctgctgaatcttcctgtaaatgtccccactcctccagtccattcatttcccagcaaccagtgtgatcctttagaaacaaaatctgattctgtttcttcccaatttcaagcctatcaagtggcttccgtggacttcagggtaaagccatgggccgagtgggtgacatgagctcaggctgcccctccaagcgctcagcctcctcacttgcctatggatcccacccaccccacacaggaactgtgcctgagcctgagcactcagggcccctgaaggcactgtgctcaggtccttgactgagtcattttcattctccagggccttttcacaggctgctctctccacctggaagcttctctaccttctctcactaacttaccttacctctgcctgttatagggggcttatatcttctttatgccttcacttagatgtcgctttcccaaggctctcccagagtgggttaggtccctactgtggcccttctatgccacctcaatcccatccattggaatttccagctcaaagtctgtcttcctccaccaggatgtcaattccacgtggggaacatctttgtgtttttcctccattgatatatcacaatgcctagcacacctccaagtatattataggtggtcaataaatactttcaagtgaattgttgatgaaaacattcagcctggctccttgtggaaaacatcttgaggatatttattgaggagatactatattccaggaattttacatgtattacactgatcttcacaatagctatgggaaggaagtcaccttagcacccctttttacaaatggggggctgagggtcaaagtttaaataacttgcttaagatcacacagctagaacgtggaagtttttcagactccatgtttgcattcttccagatggcctagagcagtggtcctcagactagagctataccagaatcgcctggttggcttgataaaattcagattactgagtcacatctccagattttctggttcagtaggcctggaggaggatctgagattctgtgtttctatacgttcccaggtggcactgatgctatttgtcttagttcaagttgctgtaacaaatactgggtggcttaaacaacaaacatttatttctcacagttctgaatactaggaagtccaagatcaatgtgccagaagatccagggtctggtgagggcccacttcctggtttgcagatgaccatctgctcattgtacacttacagggcagaaagaaagctctctcgtatttcttcttattaggccattaatcccatttatgagggctccaccctcgtgacttaattactccacagagtcctcacctccaagtagtatcatattcggggccaggcacaatggctcatgcctgtagtgccagcactttgggaggccaaggggggcggatcacgaggtcgggagatcgagaccatcctggctaacacggtgaaaccccgtctctacttaaaaaacaaaagttagccaggtgtggtgacacatgcctgtagtcccagctactttggaggctgaggcaggagtatcgcttgaaccctggaggtggaggttgcagtgagctgagatcatgccactgcactccagcctgggccacagagcaagactctgtctacaaaaaaaaaaaaaaaaaaagaaaaaaaattacattcggaattaggcttcaacgtatgatttttttttctttgttttttttttttttttttttgaggggcaacttttagtccatagcactgctgatttggagaccaatttgagaacctggcctagatcactacaaaacacctgggcttgctttatggctatcctcactccctaatcactgaccttggaccaggattttaggatccaggcctggactctcttctgagagaaaccgatgcctagcacagcctcctacaaccagacaggaccctggctctgaaggtcttggctacgctctgggaacaggctgccatcaggacctcagtgtctgtccctctcccttgagacactgctcttctgtttgtcacccttcagtcctgaccagtgatctccccattttatcaaggaaaagcacccccaccctggcccacctctttaacaacttccatgcggatgcattctaggcttgctactgctactgctgtctgaacaacttaatagcacagtaagttacagtctcttctgtgtcatggtgcctgcagcattcatcaacttcagcaagtgtcatcatgagtgatacaagtgtatgacacagctaagtgtctcctctgcacaggccattacagctggcagcaggcccagggaggcaagaactggagactcatttggctccaagtgcccaggatgatgtagaagtaaatgcgctccagccctcctcccaccatggcccacatagatgcttcgtattcttggcaccttctacaactactctcaaagtttccccaggtaagctagggatggtcttggtgcaatcttttccctttgcctcatcctcccatcctccctctgtgccaacttttacacatcctttgaggccctgtgcacgaaccacctcctctaggcagccttccaacggcaacccactctccccttcctctaaagacctctgtcacagagcatctccacctctgctgtagaaattttattggtaaacacttcaccctgacctgctatgctcagctcagctccttggaattggaggttgtcattcatatttttgtgtcctctgcaagatttttaaatgtactggatgagaatttctttgattactaaagtcatgtatatgtaatacaaaacattgataaagtacagaaacataataataatgtcaccattcccagattttattttccattttgctgagtatgatatgtttgagtgtgtgtgtgtgtgtgtgtataaaatgaagttcatagtctcatactctatagttttagaccacacttttataatatttttccaagtcacaattttaactgctgtgcaatattccattatatgaatgttgcatgatttatttagtcaataccttatcatcagacttttaagttcctccctctccctttctctcttctttctttcttccctattataaataacactgtgatgaacatcaatgaacataaatcttttcccacacctgcttgctttttttttctagaataagtttttagaaataagatcgttgaatcaaagctttcaatattttgaagctcttaatacacatcaaataactctcccaggaaatgataagaatccacactttgaccgagcatgttggcttactccagtaatcccaacactttgggaagccgaggcggatggatcatttgtggtcaggtgctcagaacaagcctggccaacacggtaaaaccccgtctgtactaaaaatacaaaaattagttaggtggtagtggcgctttcctgtaatccctgctactcgggaggctgaggcaggagaattgcttgaccctgggaggcggaggttgcggtgagcagagatcacgccactgcactccagtctgggcaacagagtgagaccctgcctcaaaaaaaaaaaaaaaaaaaaaaaaaagggaatccacactttgtgtgggagtgctcattatctcacattctctaatattaatatcatatttgttgttgttattattatcatcacagcttttatcttttgtgtcttatcacagcagtccttcagtgaacactcactcaattagccgtagaatgtgtatgcctatgtgtaagtttgtgctaagcgctggggaaagggaaatacaaagatggcaacacctattatccatcttcagagagctttcaaactagtacattggatggatggatggatggatggacggatggatggatggatggatggatggaagaatggacagatggatgggtgcttgggaaatatttccttgccatcagttttctcaacacattgccatgaatataaggggaaatgggagctcccataaggctttgagtcccagtggaatgtcctggggctgttcaggaaaacccattctgggaaagcaaagactgcttttgagaatagacagaggaatcccagtgcagaaacctcatgccacttccttctagggagtttcaccaggcctgaaatttcagagctgggaacctatttgttcagccaccagtaatgtgaaagtaatggagacatttggccacagaagtgactttaaatagtggcccaatgtggggccacaggacctatggaaggagctatgcagagctgtttgcatgacccacaggaatttcttgcccaccaacaccacacctatcacacaattcttagcagctgctgagagaggcttttctgcctctcttacagaatgagaacaaagcgtaagataaaggaaggggaggttgtaggagcaatgaactctgggctgcgaacctccttcttcctggccagaagcatgtaccttgcctctctcccagttgccccatgaggcaggctgacttccctgagccagctgctgagctgcacctgccttgagaaaaaggcacccagttcttaagcaggggatgaatattcattggcatgaacctttgcaaactcatttggggaaaaaaatagatcagaagaagtaatcagattattaaaaagaaagagcaaggacagaaggtggcagtggagggaagaatcacatttaaaatgcaaggagagacttcctccctgcggtgtagctctgaccccctagaccatgcgctgagaatagttaagctctcccacatttatgctgcataaaaatgttgtttttgaggcctcatctgagagggggaagggcagaggtaacacgcaccctccacatctgaaaattataaaataatattttgaggtctccattttatcttcctttgatatcaagaaaaattgtgagagctaaagaggctctggtgagtgctgagtgacaggttaaagggctccaataaagattagatggtccactatctcctgaggaaattgcataaaagtggttattccctcttgcttctattaatttcctcttcctggctgcttggaaatgctttgtaacctgatgctgcagatggggatgagaagcgctttccattatctcaatcactgcactgtttatgagacacttaatctgtttctttataaagtaatagtactgtgggtgatggactcagtgtcactggaagtctgtgtgcagggacaggaggagaggagtgtctcgagagtatggtaagcagaaggtcatttgtcatatcactgaggtgctgagaagttgggtgggtgtttcaaggtgaccttctggataccagccagaggtgacatgcacctatcccttggcacttgaacagggaggcaaatgtgtgttttgtctgttgaatggaaaatatatacacgtttaggcatggggtgctcagatcttgtctcctccccttttctgaagttgggggtggggaaagagatgtgtggtgaggtcggggagaggggtgccatcaaaaagcctcggctatgcaagtttctaggccttctgtctgaactgcaatcacttacaatggaggaaagggaacccctttctcttaaggaaacaaggcaattgtaggctgcactggtgttagaaatgtccagccctccaagttaccttgtcccattgacaaaggtcttaatgcgaatacacagcaaggtgtcggcggctcttctctttctacccacctcctggaaatgtaatggaactctcccctgcaaagtccaaagctgggcactttatgacccaatttccgttcctacttctcctgttcttccacctcttttcttctccctttgtcttttcctcttcttctgaatttcatctcctaaccatcacagtaaactgtttaatcaccattgccaagaaatgacacttttttttttttaatgcgacacagtctcactctgtcacccaggctggagtgcagtggcgcgatcttggctcactgcaacctctgcgtcctgggttcaagcgattctcctgcctcagcatcctgagtagctgggattacaggcacatgccatgacgcccagctaatttttttttttttgtatttttagtagagacagggtttcaccatgttggccaggctggtctcaaacttctgatctcaggtgatccacccgcctcggcctcccaaagtgttgggattacaagtgtaagccaccacgcctggcctgaagtgacacttttaaccattgtttaaagcatgaattctatgagaaagtatagcataagtgtggttacaaattacaagctaaaaggttaataaatgaactcaggaatactacttcttttataaagtttcttgtgactctcatcttataaggagactctgcaaaaggtgtacatccatccacctggtcccctgtgtgcacacaagcatagcacagatcctgctgtatcagaagcagcattccattgtccacctccctcaccaggaagggagcttcctaatgttggctaccccatctgcaccctgctctattcccctagcctggtgcctggctagaagtcaatccacaataaatatttgttgaatgaggggctcccaactgcagcagtagtgctgaccgtaattctgtaaaggaactcctgagttttgaaatgatacgaaagcagagaactctgttatttaccttaagttgcctgaaagtgctgaaatgtgtttggttaggctaccgctgtatttaattattattgtttaaaattgtacagtctttatgcaggtgagcagtctccaggctgccagggtctccaccactctgcactgtgtgactcccggctgctttatattctcaagtgactgacctggctccaaaggccatttgcttttgcttctcatggcctgaatattcttcatcagaagccacccagaagctttatttatcaccccaagttaaagctgctttttctcaagtgacagcatagttttcttatttatttttctatgttaaatttctagtgaaaaaatattgttaacttttgtttctgattaatggcacctgatacaagataagttaaaagggctttgtggattagcctggcactttcacccttgttttaagcatgaattctatgagaaagtatagcacaacaatgtaaaagtttaataaattactgagcatatacccaaaagattataaatcattctactataaagacacatgcacacgtatgtttattgtagcactatttacaatagcaaagacttggaaccaacccaaatgcccatcaatgatagactggataaagaaaagtggcacatatacaccatggaataccttgcagccataaaaagaatgagttcatgccctttgcagggacatggatgaagctggaaaccatcattctcagcaaactaacacagaaacagaaaaccaaacaacatatgttctcactcataagtaggagttgaacaatgagaacacatggacacagggaggggaacatcacaccctggggcctgttggggggtgggggcaaggggaaggatagcattaggacaaatacctaatgcatgcagggcttaaaacctagatgatgggttgataggtgcagcaaaccacaatggcacatgtatccctatgtaacaaacctgcacgttctgcacatgtatcccacaacttaaagtaaaaaaaagaaaaaagaaaaaaaaatctttaataaatgaatttaggaatgctgcttcttatataaattaaggcatgcctagacagattttatgaaagtattaagttataaagtctgagtattaaggagattcatacattttgtaattatatgtaaaatatattttgtagatatgattcacccattatacataacagaaataatatatgtagaaacacattcttccattgggttccaggatttatttgcccactttgggacttgaaatttatattctgaccctgaattctaaaagtccctgcaaagaaaccttgcttttgttttttaaaggagtgggtaagttgggatggagaggagttagcattatttagcacacattgatgctagcgacatttcatatttgagtttattaatttctaataatctgtgggagttattgtgagaaatttacagttctttttcatacaccttttatgcagatgagcaaattgaggctctgagggatgatataacttgccagtgttcaccaagctaggagctggcagagccaagaattgaactcaggactgtctgaccatttccaaatgcttgtttctccggggagaatggaatcagaccccctcctggaacctctctcttcaaccactccccaagcttctctccctgatgtccagcttggacctcctcccctccacttcctcctctcatggacaccttggaattcagagactcagtcacccagagctactgtcctccatcagaaacctcagaggaggcactttccacatccccctgccacttgtggatatcaggacaattgtttatgctgttaacttattaaatgtaaagtgaggaggcttttacgtgctggaaagaaagggaaaacaccttgttcttgttggactggtacattaagaaaattacagcatggcaggggccaaatatgaatgcttgagtcatcacctctacccctcccccactctccagagacagagctcctgccgagtccaggcagcacaggcctgggatttgtctgtattcactggctgcagaactgaatggggccaggaaggctggggatttattaggaaaagagccaagtgtttctcacaggagatgaggagagatatggaaagaagaaaaggaaagagggagaaatacagagagagggaccgtaatgagtgggctgggaaagatggattagtaagccagagtctcctcggatacttttgccattcagagcttctccctttcatgtttgatgtgttagatctttaataaagactcaaacagtactttttttctttctacagagaagtttcttctgaatgtgctgagatgagtcaggaagtggtccctttttacatggttcgcaactgacattgtttccccaaacctgggaaacaacattcactccagtgtcttccccgatcccaggggatgctctgcaaagtaaggcttcttggtgaaaaaacatagcattttaaaaagttttaaaagttctcaacaaagaataagatgaacttttaaaatcagcatttcaaaatatctggccacagtacccttttgtcataggtgttaacaatccaaagaacgtggatcccatgggacacatttgggttgtgccattccagaacattgtgttttggagattccttcctgtccaaaatggcaccccacccagcacatgtctggagaaactgaaaccttttcctcaccttaagtgatcaatggagtgagataactttcacagcataggaaacaattctttcttcttgtcttagcagaaaagcagtggatatttttcaaatagtttatgcgtacatcatcactatcatttctcccactgtgtgatccttggtaacttttgtaacctctccgtgtcccagtttcctcattagcaaaatggagatagtaatagctaccccatagagtaatgcatggaaagcacttaacaagacaagttaacagatggtggctactgctattattaaagaatatgctgcactttccaggagggaacaatacatttgagattagctttctataagtagaaaccattataatggcacttcaattatatgatgatcacattgtattagatttatatgacttcattggatcaagagctccttgaaggcaggctctattcttgaattccctatgtcatgttttcagcaggaacagtaaatgtttgttgaatgaagtaatgaggtgtgtaagaaagccaaacaagttgaccagtcagtaggttttacccagtctcaaaggaggatgagccagagtaggtttcatggggacaggaagagtgggggctgagataataaggaagggccttggggaagtagggtaggcagaatcaatcttgtgagggatcaacaaggaagagaccagatgtctgggctcaaaagtctttacagatgagacaaagttaagacccgagggatagcttggagccagacttttcagagaatgactcattataggctgatcccacaggaaattaagaggatgtgctgcacatatgagggcccctccagtggagatcaggtagtatcaggtgttcccaaccttccccactgccatgtgcatgatagatgacaccaagtgtgtgacacgttccctggtgtgctgtctgcaaagtcatcctttccttgccccacccccggaagcatatcaaaatgcaattaaaggagaatgatgttgttaaggcattaaccttgaaatcaccctaatttagttttaaagaatcacttatgaatttcagccctttgccatcattcatagcaagagcttgttaatacatctcatagtgtgttcctcatgtgtgctgcaacatggcattgaaaaaccgtgggtccaacatgtcattgaaaaacctgggacccctttctaactgaggccataggatgagatgtctttagtgagtggctcagggaaaggccatggatgttaaccaggtagacagaagagggagtaaccatttatagagcacttatgtcccaggaactgagctacactttagatttgttttctcaattaaatctcttgacacacctggaagggaagaattattatccattttgttcaagtgagagaggtcattggtaccaagaagatatatttcacaaaggatttttgaagaattggaagtgttaaatatgggtttcctcaaccttagatctcccttggtacgagaggggcatctcaatgttctttttagagaggaagacactccttttccggttgtagggaagagtttctggctgccacacttccattaattatcacatggtctctttgtgttctagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagtaagtgtctagtaatggctctgggctggggagtttggttccctgatggtgcaagtggtgggtctggggcaaggaagagaagacatcatcctttgatcccagggcaaagcagaattgctggccatggtgctgaaacatacaactcctatgctcggagttcagaggccttgtccctacgtagcactgggtgaagattacattttttctttcttcccccttcttcccatataagaggaccttctcccaccccagcaagataacttctgttcatcagatgtcagactggagagttctttggatgcaaaatcatgatctattatcacttcctccaagaagtccctcctggtgcctatagctgagaatctcctatctctttgctgggtttcctgtatatttgtaaccagactcccctcagagtgctcatcattttattaattgttcagtcattctgtacttatctcagttaccaaatgaagactattgtgtgccaggaccatatattcatcttcttgtgtcccttcaaatgcccagcctgatgtagcatttgtgctcctgtcaaatgacaagaccagtggcctgaccacagaatgcatctccaaggcagaaattctagggaccggagctaatgcattggctacatcactctcccattatataatatagagggaagagcagtctccctgccaaaaacggggaaaggcagctacactctctggatagggatgtgagaaggggtgcatttctcccaatattctccccaataattgtggaaggaggcaatcactactgtccctgcacagtactttggataatttgctcctactcctctgagcattgtagccctgaaatgtggatgacctctcttttaagtatcccattgtatttgggagtcagtgctccaggttagcctctaatgtgttagaattttcttcttcattggataatgcttcctggctccctgtgagcagggacctttctttacacctgcttggaccaaatcccttccatccatccccatcacagaagaatatttcatttatactttctgtttgatgaacagaaaaagtgactggactcttagtagaagaattacttaattccagccttgtagtgtatgtaacctttactgagtaaagagggggaatgaaagtaccttctagatcaagttcctgagttcaatcaatgtgtatagatttgaactgaggaaaagctcatcctgttgtaaactgattttctacagacctctctctctgtgggttaatattaacaaaaatgattgtttctgctgaccagaagtcctgtttttctgttgtgctatctcctccactgatttctgaggttgccctgggggtcttcaataagcccaaaaagcattgtttaatgtacttctttagaaatcacttaaggatgctgaatcactgctccctggatgttcagaccaaagactagtctccatgattgccgaagtatatgcccagggactcacagtattcctcctgaaaacgctcctttccattccttctcattaacccctcaggtgcacctggaagtctggaggggcctcaggtttagtgtgcagccgttgactttaaatggattatatcagtagtcacattcattcactggcagtattggaaagtttataaagagttttagaaatttaaaatgtgtcatttgacaaggctataaaacatatagtgcactaagaattaatatttttaatgaatcctgttaatctcttggggctggcacacatgtagtcattgtatttttgtagtgctacaagtgttaatttatttcatgtaaacatttgcaatgcatgttaccttttgcagccctgtttaggcatttgtttcttttatttttaatctactgggagacccagggacccctccacccttgacctctgagatgcctctgtgtgtccagccttgtccttgaattttgtcagtggactgcacagggatgcaggtgcacctcaaggtgtcaaaggggctggtgtggtctccaaatgaagtcagaggagggtggcttagagagctctgtgttttgagtctgcagtcacatcactgctgctggtctctggacgactagctcccttcttccttcttttctctccccccttcacttctacccaggcctgcagctctagatcttcccagtacttgctcatatccaagaagatgcctcttccctcaaacctaggccaggtatggaatgaggtgggagcttaggggatagctagaggcaggtgacaagtgactcctcaccactccctgctcacgaaactccctgaataaagacagactaccaggacagtgggaatcaccttcagtgaggagttactgaagggctactgacagtaaggggagggggtcatatgaaaagacaatgggagggaacaaggggaaggtgcagccccaccagcagggaggggttgcgaaggttatggactgaggaaccagctctgagctttgggcttgctgtgcttctgctgaaaaagccgctgccttcctccctgtagtgctccctgaggcactgcccagaagccctcagtttacctggtgaatcctggcatccccaaactgcctcagtcttgagtgggttctgggaaagctcatagaatcattgatttcatttagtgggtggaagatgggctttggcacttcagagacaaaagtttcaaacttgattctgtctcttgccttctctgtgaccttggtctaaatccttggtctaagctttcttacattctgtcattttattctcacgacttcataataatgtatgcttttctgagttattatgaggattcagccaaatagtattgtagagtccttggcacagtgcctggttcatagtaaactctcaatcgatgttagaacttgctttggttacatccctggaaagtgtgaagattgcagcagatattgaagcttccagcatgagaggatgttggatatctgaaaataaaagtgatgttgttgggggagcccaggcttgacgccatcaccgagcatcacagcagaatccatgatatggtcccaaaccacacagtcgccttggcctaaagaacctgctgaaaacaaatgagaaggtgactgccctaccctgcgacctggtgtgcagtgggagaaggaaggaggcacaggcagagcttctgagaagctgccgagctcgctgtccctggatgagaggtgccaagaagctgggcaggagcaatggctcacaatactggctttcaattcccaggcagcagcggcctagcagctcctcacactgagacacacttccttccacaggagggccagatggcaagggagacatggtggggtcagccgggcagagggacagccaggaacacactcggaggtgaacagcaatgtgaaaccccgcaccatgttgcagggcttggcttctgttttaaataatttctagtttactgggggacgaaatggaaaggaggaatttatgaagcaggtgaaaacagataattatgccttataaaattgctgcctgtgaaaaactatacagaaggactggtgtgaaaataattaccttgttacattgctgaccacaaaaaccccttttctgtcactcacatggaagaaattttgatggatcacagaggcaagctagtgcttgccttgtttcttttatttcttcttcaaatgcaatgggcttccctctgcagttttgatcatagaaatggaatgaaaaaggggtcattgtgtcccttgagcccaccagccgaccccttagatgagggacacagtgcctgccagtctttcggggtttccctggaggccatccctgtcctccctcctgactgccactgagaggcagggaagcttagtggcaggggcaggggttttgagtttggctcctgacggtaagacctggggcaagttacttagccttttggaacacgagcttccttctggataaaattgggtatgctggaactcaaattacgaggttgtgagaattaaaagccagcaagcaaatgaagctccaggatgaaaactcaggtctgtctgactctaattccatgacctcagtgatgttgcaaaccatcgtggcgatgatggtgattggctgttattctcactcatgaatctaccttgcttagagaaggataagaatctgctcttccttctcccattcctgcatagtctggtttctctcctttaagttcatgtttcatcttttaaggtgctggcagttgtttccctcttttatcccaggcacgacagggcagtggtggggtgggggggtggtgtccctgtggcataaggatcatgtcccttggacagactgcccaggagtgggacattcccagggcctagaccctgatcttcccagggaagcagggtggatggagaagagtgcatagggtttagagggtagaaatggctttggtatgacagaaacagaatgacgtcctctgcaggtggcctctgcagccaggtttggtggccatagagcattgtgggtctgtaaggacatgagcttataagccctctggtcttgggcacaggatctgctgcatcatgctcaataagatccccactgatggtttcctttaggtcagtggttttaaaatgcagtccctggacaagcagcctccgtgtcacctaggaacttactaaaattaaaaattctcagccccaacccggagccactgaatgagaagctctggaggtggagcccagtgatcagagttttaacaagccctgcaagtaactctgaaggctgtgaaagtttggaaacattgctttagagttgggtcatattcctctgtcctttgctttatgacttctgaggagaaaggccattgggtgaattctcacagactggaaccacagggccttcccctccccatcaatgtcctgtgtgccaggctagaaagctgcagggaggggggctgtgaatatgtatgtgagagagaggaggggtggggtctgatgtgagtgtgaatgtacgagcgcatctgtgtttatttgagtggttcaagggagggtctcactacttctcagaataatccccacctgttctggctcaatttctatttcattttcactctttttttttgagatggagtctcactctgtcacccaggctggactgcagtggcgtgatctcagctcgctgcaacctccacctcccaggttcaagcgattctcctgcctcagcctcccgagtagctgggattacaggtgctcgccaccagacccggctaatttttgtatttttagtagagatggggtttcaccatgttggtcaggctggtctcgaactcctgaccttgtgatctgcccgcctcagcctcccaaagtgctgggattataggcgtgagccaccgcgcccagcccattttcactcttgagtggtcagagcagtgtgaagacctgcaaaggacatcgttagctggggctgggagcagtgaccagggagagaagcgaatggaaaccaggaagcacaacgtggctggagtgagctcagcgggggctgaaggagaaactgaaacagaaggaaagtgactgatgggcaccatttgcctgaattcagatagaggatccagagggtagccagtgtaaatgggtgatgggccccagctcacctaggaggaaatcagaccaagaggaaaactctgaggctgctgctgcagggaggagctcttcaggccaatagggcaataagcattccacatgagacaggaatctagtgttgtaaattggggactgcttgcttgtctgcatgtctacacaatgagggtgatttttttttaattttattattattatactttaagttttagggtacatgtgcacaacgtgcaggtttgttacatatacatgtgccatgttggtctgctgcacccattaacttgtcatttagcattaggtatatctcctaatgctatccctcccccctccccccaccccacaacagtccccagtgtgtgatattccccttcctgtgtccatgtgttctcactgttcaattccgacctctgagtgaggacatgcggtgtttggttttttgtccttgtgatagtttgctgagaatgatggtttccagtttcatccatgtccctacaaaggacatgaactcatcattttttacggctgcatagtattccatggtgtatatgtgccacattttcttaatccagtctatcattgatggacatttgggttggttccaagtctttgctattgtgaattttaaacagttttcaaaagtcgaccttttgacaagtgtttacttgggttaatctagggcttgcaaaatggtaaaagaaggctgctttgctccagctgagctttacccatcgctgaccagggctttagtgtaagtcaccctgtgtgttctatttgataggtaaagagactgatattaccccgatatgtaatccatgttgcccgttaaaaaatacatttgtgtttttgaaggggaggtagtctgtgttctccttgaggtgaacttcagacaaaggtcaaagatcaataagagtcagagggcaggcctagatttgggtccccgccccatgctggcccccgccccatgctggtagatggtctatacatctggatgcaaaagaaaggagtgtgactgcaagctggaagctatctataactgtcactgccacatcaggaagggtcagcgttgcctgtgtaaatgtgctttcacacttctgtaatctacaatttcttttcatagttgtttgacccaagtgagtataacctttttgaggaattgtatagctctaagttttaagctaaaagccaggcacacaagctaacatgtttgtttcagaatttcacaagagcatttggagtcacagattgttgacactctgagcactgccaccccaaatcctcccaatgttagccttctccctccagtaaccccgagaggcagaggcggtcatgccacttttattgttctgagcatttgtcatgacagctcgtgtcttgtgcagggcagcgtcactccattgccaacagcagtaacccatcgctgggggagaggccttctggacttcagattaggcactccttcctcactcctggccattggtcggtccttaaggaccaatgctcagcaggccagtgattttaatgcttaaggacaatgttcccatctttttaaaattatctccttgaggctaaacacttgttgctttaactgttccccaaatctcctgacccatgcccctgcccctctgccatttgtccaggctcctggctggccttttctgaatctctcacatttatcgataaggctcttaaaatatagcagccagaatgagacttgtgatcctcactccagagcaaggttcagtagaaaagtcatggattttccttgtgattgggatattgcaaccttgtgttcactttggttgcagtcactgaaactgtgagctcccaccacatgtggcagccactaaacagccagtgcttttgtttgtcccctcaggaaatgctgtctgtttgggtctcccctatgtgcacttatcagtacgatttcagacattttaccttgtggatttaggcacagtgcactttcacgtacagatcattttaaatactgatttttatcatctttcaaataagcagtgttagtataattgctaagagtgtgggctctggagcctgtgcccaggttcaagtcctgctctactactgaacagtgatgtggggcaagtgacaaagcttttctgtcttcatttcctattccataaaatggggataatattggaatctgcctcactgcactgttgtgggaattaaatgcaatatactatttaggttgggcacagtggctcacacctgtaatcccagcactttgggaggccaaggcaggcaaatcatgaggtcaggagttcgagaccagcctggccaatatggtgaaaccctgtctctactaaaaaaaaaaaaaaaaaaaaaaaaaaaaaaaatccaaaaattagccgggcgtggtggcatgttcctgtagtcccagctactcggaggctgaggcagaagaattgcttgaacctgggaggcagaggttgcagtgagccaagatcgtgtcactgcactccagcctggatgatagagcaagactctgtctcagatagataaataaataaataaataaataaataaataaataaataaataaaacaatatttggcatacaggaataattcaataaaagtaagctatttgattttattactattatcagagttgtctaccctactttgatgtaattttcaaagcagctaaaatccaagcacaggcactattatttagttaacatttcttccttcaatatacaagtatttgtatacttttagaagttactcttgtggaaatctaggtttactctatactctatactctttttcttcacaggctaataaatttttagagaaagaaagaatgttgactggcctgacttacacatagagaacacacacaagttcttgtcggtccttccttgaggctcacaaagcactgatttacttgtgaagttccagaaggaggggattaacgtgaagtgcatccatgtaatctactcccttctctattttaaaactcagaacaaagctgtcctctccatgactttagggtcccctcttgccaggaatgctcctttgtggtctcaggcaattgtcttggtgtcaaatttataggttctggtccaaggcagaactggcctggaatggatgccggaacttaattgttgccacagctcagcttcttcaatattctctgctccaattgttcacctctaaggcgaaggcagtcaggagtgagtggctgtgcgtcctctgtcctctgccagcctctcacctcctcccccaggcaggaggaggccttgctttgcgcaccctgagcattctcagctattcagagctattctggtaccagaatcatgcctgttcactggactggaagctctttgacgtgctgatttgattttttttttcttttaaatctgcttcatgaccttacagagcaggtgtgtccgatgcagtcaagtggtaagagccctactgtggaatcaggtaaaccagggttgactctcagctccactccttcctcacagtgtggccttgggtaggtcgcctaacttatctgaatctctatttttatgtcccccagaatgaggatattgtttattattgtgtccattgtgaattgtatgtaaaatgcctaactcagtgttagacacatgcacagtgctcaataaattgttgtctttgtttgggtttttatgaatcatgtttaagaagtgggttttgagtctctaagatatgcaattaaaaataagaaaacatggccaggcgcagtggctcacgcctgtaatcccaggactttgggaggccgaggcgggtggatcacgaggtcaagagattgagaccatcctggccaacatggtgaaaccccgtctctactaaaaatagaaaaattagccaggcatggtggcacacacctgtagtcccagctactcaggaggctgaggcaggataatcgcttgaacccaggaggcaaaggttacattgagccgagatcgtgccactgcactccaacctgggcaacagagcgagactctgtctcaaaacaaaaacaaaaacaaaaaaacattaaaagtataagtgcaaaggcttttagatcaaattctcctggagagccatcctaggttagctaaattctgaccccatcactcccctgtctctaccccatcacaatgtgattacaaatctgtgtacaacctgtgctaccatcttggtccctagcttctcacaggtggtccccagatggccttttggtcccctttgtcttccctcttccatccatgataatggcaccagatcctgatttcatttggccagagaccaagcccaaatttcacagtgggatctgagctgtgtctcactcctagacctcttgccagtgcctcgtggtggtcacttttcagagtcaccactgccagtcagtcctggaacctgtattgatccactggaccctctgttgatgaccactgacattgtcccaaagccaggttcagaatctaccctgaatcccattgcactggtgggcccctgtctgtacacccacctttcgtcagtatgcttctcaaagtctgtccctacatctgagcttgcagccttctaccctctccaaggaccagtatatttcctgacatgtcttggagactacctatactctccttcattctccaagtctccagctgccatattggaaatctggtaccagccaacctttcccaaaccaggaccatgactttccagattccctggtttggtaatacatgtggatgtcgcatggatgctaaagccagacccacacacatcactgatggcttcacttgggtgtgacaaagaccagggatcccagtgtctttgactctgatcaggtatttagagggaagccactttccacttggcataaaggtagattctgagtgatatccacaaagagcagaggctgcctggctagggatctctccataactggaagtgtacaaaaaggttctggtgatgcctgccaagagggtttctgaataatgtatgaagttaggtaaagtggacaggaatgagtcttatagtcagtatgagcaagtccatgctttctggattatgtgtgccatagtatgtgaaagccagcattttgtagtgatttattttgaaactgtgtgtttgctttttctgagaagctttccccacaattggctggaaaattccaagtctgagccagacacctgagaactgctatgatatgggattggctgtgggcttaaaatctggactttccaatgtataaataatcactgatgattttgaagacacagagcagtctgcagtctgaagtcaacctatagaaggcttatgattccctctaccctgtgccagagactacctccaccccattaaataaaaagtgttctggctctgaagccacatcaagaagggtggcttgtcttcaagaggctgaaggatagagaactagaggctagttgaacactaaggtcaatctgtccccccttcccattctggagactagtaggttgtggcaatggtactaataggaatggtgtgctggcccctccttggctgtgtcttagacttgcaggagatgcccaaggtggccttttaagcaactcctctgagtcacctcagaggtttgcctttccaggcttaccttggaaatggcaatgaagggtgctcagttgtgcaggttggagtgaacttgcatggcagctgtgtagtgagatgaagccaggtgcaggctgtctcttctggggcagaggtgcccagaaggtgagggctggggtggggtggggggcaatggtcagtgggaacccatggtcactgccatgccctgccagtactccatgagcaataatggaaagccactcagttctcacaaagagattgtcatctactggtcagcaaaggggaactgagcaccaggtaagaattggctctccctgtaagtgaaaggcaggctttgtgcccacacccggggacagggtctgcatgaggctccatgaggtcagccgtgcccatacccacacccgtctgcacaggtcaggttgtgaagcaccaagtcttcggagacagagaccatacaccattaccatgctgtgtgccatggtgctccactactcagtgatagctgattggaataagaacacatgtgcatacctctaacactaataactggcatttattaaagtgttgctacagtttaggccctgtgctaagcctctgacatggtttttctcagttaacctcagagattataagacaggtattacaactggttccaatttatagatgaaggatttgaggcccagaagggctaaatgacttgcccaagtttccaccttattgagcagcaaagcccgtatttccttctacgcctgacaaggttcaggtctccagctcttcaccctcagtgctagtctacttccctcgggaaggaggaggactattgcctctgatgtgacctggcacaaaattaatggtagaatcccagctaagatggggaaggatcacattttgttgattagaactagttatgtgctctccatgcaaggcggctgggaaaggtgtcttctgtgagacttgagaagagaacagaattgcacagggaggccctagcaacccctaccgagtatacagttccccatgggtgagtgtttgggcccattcagtgtttcattaatataaacaataatactgccacaaaaatgcatatccctatatttgtggaggaaattcacctagaaatagaattgctgggctacggggtgcatgcacttagaaccaatcaatattacaaagtgtttcccagaggccttggccagtgtacactcttcacagcagtgtgcatcaggcttctccacacactggcctgatgatgctatcaagacttttattttttgccaagttggctgacctcctagtcattttgattagtatttctctgattataaatgagtgtgtattttttatatgtttattgaccaatttagtcttctgggaattgtctgtttataacccttgcctttttctatatttaaaaattgatttctagatgacaattaattatatgtgacaccctgccctccagccctccatttatttttaactctgtggatacttgttttgtcatattgaggttttaaatttttgaactcaaatctgaccatctttttctttctggtttggagattggtgtcttgagcttttgactacattttatatatgtccttcccactctaaggcatgaaaacactctcttatactttctttcattttctttttctttcttttttttgttttcttgagtcagagtctcgctgtgttgcccaggctggggtgcagtggggcaatctaggttcactgcaacctccacctcccgggttcaagcaattctcccacctcagcctcctgagtagctgggctacaggtacgcatcaccatgcctggctaatttttgtatttttagtagaggtggggttttgccatgttggccagaccggtctcaaactcctagactcaagtgatccccctgtcttggcctcccaaagtgctgtagttacaggcgtgagccaccaagactgggcttttatactttcttttaattctctgtatggtgtttatgtttagttccttcttccatctggaactttattttgcataggatgtgatatcagtattcttttttatcttattaaaaataacatcccatgagctccacctgaattgtccacattttggtgagatgtttcttttattatatactaactgtttgtgtatgtttgtctttattctttctaattggtggttctgtctgttctggcaccagttctaaactgttctaaagatggtagctttctgatatgtctcaatgactggtgaactaagtctctgtatattattcattctcaaaaatagctatcccattcttaaacattgttttcttcaagatgaatcttacaaccagcttgacaaatgtcattaaacaatcctgtttaatcagggttggaattgcattggatatatagattactttggggatgattctcttctttatgatattctttattccatccaggcatgaggtattcaagtcttcttttacgttcttcggtaaagttttgtagtcatcttcacagaggtcttgtgagatttaatcctaggtattttatggttttgtggctattgtgaataaataattttttattatattttcaaacaggttatgattattaacagatgacagtgtagtggtgggaatagtgagctttcttctgctgggcatcttgtgttagtggacatctaacagaggctggccaacagggagggactgtagagggtgtttgtcaccagagatacactgaccaccaaggtttcattgcatgccgtgaattactgtgtctatgaaatgtcaaaatcaggactttctcttgggtgacctataacaccctggaaagtatacttacctttttcaatttcttttttgttctcttgaccttgaattgttgtcttaggaacgagggccttttctggatacctggagagaggcagcacatgtctcttttacagctgcgtaagccagtgcctggaagttatccatgaatatttaacccacagtcacttcccagctgttatcttgatgccagtctgatctgcggtctctagaaaaagatggaaaattatgacaactagaaaaaattgtgtcatctaggaagggggctcttaatcatttttgatggactgtggagatgcaggactcctccccgggcatccccatctctcaggaatggtggagagataggacttctgaccatacagtagcccagaggttccatcctatctgcatgcagcagggactcctccagtctggtccaggtggttgtcttcttgtaaaagaaacaccttagaagtcccatacccttccctcatcagtgcctagtatccaaaagttcagcagagtatgtgttgtgtggaactagccaggttctgcactcctgagagtggcttgcgaggagctgagatcctttacctgcaaggctttcatcgtatgtgacctccatgcctgatggactttggcccagtggctaccaaccagatctccagatgcaaagcaaattcctatccagatctgaatctccacacttgcatctgcatggagagaattactgagctctgggctgtatcaggatatgctaaatcaaacgagtagttttgggtggttcagggcctgagtgcatcaattagaaataatgtccagaacaaggaactctgtagaagttctgtcctgtaagacctattcctctgttgtgccaaagactgaagtgtgtgtcaatgtcttttcacttcaagaagactctaaccggcttgcttggactgttgcctccagtgacagcaaatgccttggagcctgtcctggcaggatgtggcctggtatggtgatctttcagcaggaagtgctctggggattcttcctctgagacactagatcagaggtgctgtgagcagggcttggcacaaggaccctacctaaaggcctgggagaacctatacaggaggtctgcttggggtctcaggggccctaggcaaggagatgtttttcctgcttcacagggccttcaggtcaagtgttctgcacaaagtctttttttttttttaattgtacaggtgtgcacttggtccctgtttcccttctagaaagtgaatagatggaaagggactcccagataactataccaggcagtcccttatgcatatgaagtacactaaggatcacagaatgctttaacctatgttatgccatttgattctcccataaagagggcagtgttccctccaagttcccatagcacaatgcctggccatctccaggctcagggggatagatctccactagctttgtcagtcagtggtttgtgtggctgttgtgcaggtgcctgtctcctttgcagaccttcagcttctcagggtagacatcggtgaacttttcataaacccacatacacagcacagcacacaggagggtctcaataaacacagatggattgatctgtcaaggatcaatgaatgattaggctgagagaagataagtgactgcttaaggtcacactttggcaaggctaagactcagccccagttttttctttgagtccagtgcatctttcctcactgtagaaagcttttgatgctgcatttcaggggtatgaaaggggtcttgaaagccatgtctttaagatgacatgacctatagttcttgacttggagcatttccaggggattttcaggggtggcagcatattgtacctttccactctttggccccaccttgagccacagctagaagattcaaccttctatccatctcccgcatggatagtaacctgagactagtcataaatacctccctactgaggtgcactgcctcccaggatccaggggcctcagccattctctaagggcttctgcagcctcaaggaaacctagactctcagacttgagctcaggctaggtagaggggctgtctcttttcccagaatgtataatctacttcctttcttccagacaattggctccattgaagcaggagaaacaataagtactttctacaaacactggttttggtaaaatgtgtagcactaggctctttgatgctcctgaaatccctctcagcagggtccctccttgttttgactaatcatttcttcttattactaactgttatgattaggagaattgcctgagtacaggcccagtgtttccaagaccctaatgagcaacacgtgcagactcgcttagcatagtcctggaatcatggttgttctgtttcctcagggaagctgctgagatgcctcagggacaggagctttttcctgcctctgtgaaatctttccccagcccccagaaaatgctttgcatcacagctgtgttgtacagcattaggtgcctctaccccaggtggaagagttgttaaggatgagatttggaacctgccagccctgcactcaagtcttggttccaccagtgcatgagttgggcaagtttctttatactctgagctagagttttctcatgattaaactgtagacaatagttcctacttcaaagagtgttggaaagataagattacattaagtaatccacaaaatacctaagacagtactttgcatacagtatttatcaataaaagaaaattcaaatttccatgttgacctccactgctttcagatgcacctagtatccaaaagttcaatttctctttcttggttccaaagacaattcaagggcaagtagaaatctgctccagggaaaggacccaaaattggtcatttgggcagtgatatgaacaagtttcatcaagtcagagccatgtccacaggaaggcaatgggacagggagcccttttggtcacctagaaggcaagcaccatgcccagcaccagtgctgggcatgcatacccatgtagcaaatatgcctccgctagtgactgtgtgaccacagacaagacattctgtcactctgggcctttgttttcttattgttaagttggggataataatgcctcatagaattttgagagaaaatagtgacatagtatctgtaaaaagactgttcgtgctgttcagagatgttacaaagtattcagaatctgcctcttctcatctcctctgctgatgtcattctggcccaagccaccatcacctctcccctagatgactgctgtgtcctcctgattggtctaccttcttccacctttatcctcttctagcctgtcctccacaaggcagcataagtctaagcatgccatttctctgctcagagccctccttacagtaacacctcatttacagtaaaattcctggcaggctgaaaccaggacttatgagtctgcctcccccactacctttctaatctttattatgacccctctacttcttgattgttatatggcaaccatgctgcttccttgatcttcctcaaagaaggaaccaagtacattcccacctcagggcctttgcacatgccggtcctttgggctggggaacactccctctagatatttgcattgcttctgtctcatcacactcaggtctctgtccagatggcctctgctctgagagagctcccctcaccacaccagcatgctgtctcccctcctccttctctgtgtatcatcagagccctatgactgctgatactattcatttatctacgtattgaaatgttttctgactccttcactagagaataagctccatgagggcagtgtctgtgtcactgtcttcacattcatcattaccatataacaatgagttaaaaattacagctgccaatagagaagccatcctaagtgactggcactgttctaaacctttacttacactgctcaattggtagtccattacaacactcctatgggttgctgtgatcatcatgcagattttaccagtgaatatgctgaggcttagataggctatgccaaaatccagaattcaactcagttctgtctgtatctgaagatctgtgacctcccatccttagtaatttgctactggggttcatttaaagctgatttcaaaggtggtataaaattttctctgataaggttgtgctcacatggctgttagaaaaagtagaccaacatgatttccctgagctttaatgccctctcctccttgccccagtgagatatcctacactttgaggacaggagcctcaaaggatgcctgagcttgcggtgagacaggcatcagccaaccttctagccagcacctgctgctttggaccctcagcacaattccctctcttgaagggacacctcagaatttcagacaccacttattccatattgagcaaaaccatgtcccatatgtctggtattcattgtcggcagattgcagacaatgcttggtctgtttttttctgaagatcctgagcccttccaagcttctgctattgagaggtggatgtctttggcatcctttaaattacttaccagtctgtccactttggtgccactagtttccacaggcccctggtaacttattcctcgtttcccatattgcctcagtaacctccctcccctatggtaaaacagggcaactcttgcaccactgacctctgttattgggatcttattatgatgcctgacatagaatctttagaagcacccccactgttggccagagaactcagtgaaagggacagagaacacataggcttatgccactctccaaggtcctgaaccaacatgctgcaaaatatcacagccctttcctctatgatgctggtcattcctgtctgatgtgctcctgttgagggaatgatggaaaaggaattactatcatacttaggaggagcaagagaaggagaggaagagagctgaacttaggctagagagtgtcataaccacaaatggtacttagaaagaataaaggtttggtgttgttttcttttgttttggcattgttttcaaataaccatttatcaagaagaaacaaccactgcacatgaagctgaattcatgtttatttgataatggtactacatccctgacagttgaaactttccctcttttggcttatgttatcctccaatccatcctgcttttagccgtgtgtgccatactttgggctaggtataataaccagcctgacttttttccctgcatatttcgcccccatagaagacctcttcaaacttctacagcccccatttccctgtctgcttctgcttcttgaattctgcttccccataacatctcaaagacccttttaccttctccagggcgccttccaatcactcagacatggttcctttaagtagctgtgtcacaataaccaatggagaaagaaacactctggtagaatccttattttgaaaattgaattctggaccatgctactttcccagtcactcacaccacagtctctcccaccatccatacgcctgatatcattttctggtcaccctctctaccacctcttcacctttattctatattgaagagtgctaaagttgatattgaagtacatattcaatattgaacttcatattgaagtaatttttccaaactacaatcttgaatcttctcagccatggagaacattacatttgttgctttcctgactgataatacctaggagtcttgagtatcaagtgtccttcctggcttattcccagaccccactgcaattctttcacctaaagagagaaagaaaagagggcacagtttgctgtgggagtaaaggaaaggtttcctttcccataggtcaggggaggacaatgaataccagataccaagtcaaagtcaggctacctctagggaggccaggaagcagagatacaggtacagacagaagtcacaagcccagtacctaataagaactggacccattctggagacacagccccatgctcaaggctaagtttctgccccttggtagaagtgcttgctggggctaggtggccaggaaggtgcagattggggcaggcagactccaaggtgtttctgtgacaggtaccagagatcatctctgaatctattgatttgcactggtcatgtcttttcccaagcatctgtaacaccttgcatctgtaccactttgatcctttactgtatgtgttcacagtttccagcactccttaggtatgggctcctacatcaggtttccccaacataggttccatgacctcacggctttcacagtctttagcataattctgaatgagaggtctctgctcaagaaagggtggctgaattaggtcagtcttaattacatgagcaggtgaagattcccgataatccaataatgacaatacaaatactactactaccactagcctctgatgttactcaatttctctgtggaccagctacagttaaactctttaggcatgtcatctcattaaattctctgacctaccatctttcagataaggaaactgagacttagaagttcactttctcaaggtcaaccaactagagaatatgttttaacttggttactgtgaacacttaggaggatcatcggttggtttcgggggactaagaaccccctcagagtctgaaaaatcatgtgttgcaacacgtgttcacttttctgggggaaaagctttgttgcttttatcagattctgtaagtggtcatgcacagagtagggagggccccacctctggcctgatgcagaggagcatgatcccagcctgaatgtggggttttccaggggagtgtttctcccaagttatagctccaaccttgtggacaaccactgtggttgccaccttcaccatcacccaatggggagggatcccaggacacagaccctggcttcagcaatgcacaatgagctagacccgacctgcttggcaccttgtaccagcctgaaatttactactaaattctgagaccagaaggttagccttattaagattcctgataaaggaattggctttgggggcttacctgtcttcagcagattttcactttgattactcaggagtgctcttatttccagcttaatgcctgcaaataaactcacccgctctctcccacacaccctgtctcaccattctttaaaaaatcatctggcccaaatcacattaagaagcaggagattctatcttaatatggtagcacttgggctggccctgtgggtctagaaggatcctgtttaactccagtgacaaccgtgctccatgcaggctaagccaacctctcaggcacatcctggaggacatcggagacccatcttcaaaactcatgaccaaccacactccctcctcacccaaacagaaaatcacagctcaacacttctcccatcctttaaaaggactgaatttccttagccctttaaacagaatgcattcatcagaagtaaccgtggcaacagatcagagaggcttcaaaaagcctgtctgtatgtaattaagaaaaatgaggaagagcatggagcttagacggggagaccacggtgctgagccctgccactgcattcactgagggcttttgcggaaggagatggcagattttctttctctgttctggcttccctctctgctcccccttgtaatgtttttgtttagtggtctcaattggcctccttcctggagatgttgctggggtcccagattctggatgaatactccctgcaagagtagggctccaagccaaggaggcaatgcctggatgggtagggaagtggcttagcatcttcctccagggaggtttatgcagacgccaaatctaccctggtcagactttcatttggccatagggagactgagcagtctacctgcaggaatatgcccatctcatcaggatgctacggcacagacacctggggccatcatcattttaaccacccagacatgaggccctggcttgccagccctggagcgggcctcatgggaataagagacagacagaacccagcattgttaggaggccatctgagccctggtgctttttttttcataacacttattcttatttaaaataatttcatttatttctctgtttccttctattctattagttttctctcactggaatataagctccataagagaataagcttgcctgtcttggtttttctgcctctcaagtgctgaaaagaatgccgggagtattagttacgggagtaaatgagtgaatgagtaaataatgaatggtcatttttttgtggcccagattctgttcacctccacaaatatgcactggcacttgctctgtgggaggaagaagacacacccctgccctcaaggaggcaggggaatgatacaccgcagggcatgtctggctctcctagccctctgagtccattctccagggaaggcccttaatgtctgtttctgctccttggaaggaagggattcagatttatgtactcctgcactcaacaaccatgaccttcacaagcccctgttcatgcgccacagatgcatttgctctgaaaagcacacatgaatgggaagggggcagtggctgctttatatgaagacgtttattaaaacaacatggaaaaaaacccttcccctggaatggggggtgggggtgggggaggaaactcactgcatttcctcctgagcagctgggagtaaatgaacagacatggagcagcatcgacaagggtgggtcttcccagctgtcagggaggccactagatgagagactgggcaaaactctccatccagctcttcatttgccacctttgcctcaccaaagcctctgccactcagagtaacaagcagtgggtcatcactgattactgctgctacttcaaggcctctccaaggcccctccatccacctacagcaaggcatcctgtctcacgctggagaggggtatatacatgggaccttttccatgcacactgagcaaaggtagaaaaccaggtgggagggcaaagtgctgtctggggatagtaattacagaaacagaccagacaactgcccctgtctaccaggaggctacagtgtggtgaggatgacaaagaggaagagactatcacaatgcaatgatggaatctgacttaggcacctggaaatgagctatggaagcccagatagggagatcatgactgctgggcctcagggaagggtcctagtggaatgggtgctagaccttgaagagtgagcaggagttcaagttgatacagagggaaaagaacttgtgacagagggaaaaacattgtgtagaggctcagagataagaagagagtttagtgtgcacaggaaatttcaggaacatttctattagccaaaatatgaggggtgaaggtcaactgccagggatgagatcaagaaaagcaagatcccacgggggcttgaatgacatggaaaggagggcaaccattttggataatcaggaagcaggggggaaattgtgcagaagaacgctatgactccatgtgcaatttagaactcatactctggcagaagagactatatcagagaaatgcagaagcaatgttggagaattaattaggaggcttttgcaatagggtaggaaaaatgatgaggcccagaattctgaggccatgaggatagagaggaaggaacatgtctaaggaaaagtagaggaagatggacagattgtgctaatggtccatgtgttaggtgatacagaagatgtggctcccagggcctgactggtgactacacaggtatcaaagaaggtaaggattgaattgtgttccctggatttgtcacatagaaagccaaaggaaaagcagtcatggcagagaagtggggaagtaatcagacttcagttggctgagcagggagagaggaaagacagtaagtgtaggctcttgtttgcaaaagcttggctgagccaagagtaaagaagagagggtgtgcaatgtagatagatgccaggtgatgatgttttggtttgaaaatggcaaagacttgtatgagtttacattgagaagctggagtcagtggggagagtgtagctgaagctcaaaggagagaggaaataattgaaggaggaaagtctcaatgggtgagagggatggatgatcactctcttggtcagtgcctgcctctgccccttcacccgaggctgctttctgagtgatagcctcaggatgtcccaaggatgcagtgagataaaaagattcaccccacacctagtataaagcaagcactcagtgaatgcctttactttgagatgagaaacaggggcccgcgggtgagtctaggctctctgctatagaagtgagactaacaagagttgcgttgactgctgagagcttgtggtatgagtcccatcagtcagaagcaaacagatgtgtccaagacaggcagtgaccaatatggatggtaatgaattgtgcagtgtgtgtcaaggttggcccagccctgtaagagcctacctgggacagtactgactgccttcccagcactagctatgtgattatttgaaaagagatggatgtttattcctgggcagatgggtggggaattcttgaatgctgtttgcaagacttcagtaaaaatgctccatgaattctgccctgtcacatgcgtgcatgaacgctgtgctttagctcaggcctaatgggctttatatggtacagtactgattttctttcaagttttaatagaacccgatttaatatttgctttctgctctagctgcttgctgttgactgattcaacacagaatccttccctggtgccccccgaccttattgttattccctcattttttgtgttggcatttgattcctgtctccagcatgaaccactttacacatgtcttcgttcagctggtgacagtcacgtgcatgaattctgaatgcattactatctgaagcggctgctccagcagacctgccattcgaaaggggggcttccgggcaggattcatttttatcagttagacactgaggagatgcaaggctcaggcttgggaacctgaggctatgatctgttctggttttgggcagcagattctccaacttaatctcaaaatgcccagcattgtggccgttaattcagcaatattttgctcttctgtgaagcaccaggatttccacagttttgcaacaaggcatttcagtttttgccagattgtgaaaagtagccataaacagagctttccagaggaaagaggctgccctctgtgagtcccagtgagcctgtctggtttgtaagagaaggtctgttcagagcagggctatagttgagaacgtgagctttggaatcccgcaggtatgggctttcacactggcttcagttcttacagagctatgcgatctatagccagcctcctttctaagctttacttcccctttctattaaattgagataattattttatcttcctggtaggggtctttggggggaataaataaggtaatgtatataaagcagctagcagaatgtctaaacacattcctgtgttttcttacgtcatggggcccaaagtgactacatgaacctcttccactcaattctgcttcttttctcatgtgccaaagctggtccaatgtaaatatacatctattcaggtgctctggaagcctgtccctacagagatgcatccctgctaccacgcacacaccagatagatcccaaatgtgtgagattttgtgcagaatttcagaatatgttagggtttttggaggggccactcatatccttctacccttgagttctacaccaattaagattagacaaagaatccagtaaatgttcaatatatatacattttattaaccctaaacctggctggaggatgtggcttgatcctgagagcaaaaggccttaaacccaggtcctggaaccgtctttcccttggcacacatgattgaaagaagaaaagcctcagtgaagatgactgaaatgggagctagggacaagttgtcatctctgttcacctattcttcttttaaaatgaattgaagcatagccatttggggttgaggaaggagtgggaggcgagcgcactgatgaggttgggaatgcaccagaggcagacaagagagctgccggacaaggaagcttatgtctagcctcactggaccttctttgtctccctgcaggcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccggtaagtctggaggcttctgtgctcctgtttggatgtgtggctggctctttgtctctaggcagggacacagctgcagccacacccatcctgcccgtgtactgtcaggcctctgcccaggagtgaaggtgtcaggtgatgggcatttgtgatcacatagagaaggcaggtgtagtgttgcgcttctgagaatgagctgcagactaggggattttcttgtgcccagcacaaaagcaaagaggtatatccaagccagaataggacctagtgctcttcatccagcctgagctcaacaaatcctgttggaaagatggatgaagagatggacagacaggtgtgtgagtggacaaacagaggattgtgtaaatggatggacagatggacagagggctaggtaggtggacagatggatggacagacagatggtgagtgagtggaggcactgaaagactttgagaacaggacgacaaatgatgctttatggaaacccaatgacagaaattttccagagatcatatgataaaatcaatattaccttcattttccaattaaatctatgtagttcaaaagtgtattctcctttatagcttgctctgatgaatgatatgctgctgttgagacctcagatagaatggcaatagatcgctcctgatagccagcacatccttgtgggatgcatagctcagaacacattttctttctctttatttctgaatcttacactcttctgatcttttctctttattacttttcacagctcttgcaagaatctgtttatttttatatcaatttaacgagtccattcatgcacttatttattcgttcatcattaagagacagtcatttagcatgtactgtgtgccacgctgtggattagacacagtgaaggatgcagtgatacttggacactattgttcctcccatgaaactcattaactgaagaatttagaggatatagatacaaagcacaaagctgcaaggtaaaatgctatatgcatgcagtaaataccaagggagttagagaaaaatgagcaatctctctcccggggttaccgtgcaaggctgcagaggggaagtgaacatcacatgcacaggcaatgggggtcataggcagtggaccgtgatgctatttggaattatagatttttctcaattaacaaattctaaaaggacagcttgttagtagaatagcaggagccaagcatctatctctgctctctcttcctctgtgtatctccccctccctgacctcctcttttctactccatccttttctactcacctccccaccctcagactcattctgcttcttttaaaaccaggcatcttaggcatctttgatggcatatgaatcttgagtttaagctgtcagaactgagaagaaaaaaggtgtcgtaggagagcatgtctgtccagatggctgtgttgctgctgtgtgtgggtgtgtgtgtgtgtgttcatgtggtgtgtttgtatgtatgtgtatggtcacgtgtttacatgcatacgtgtgtagtgagaaaataagagtggaaatgtagaagcctccagctggtgaccacagtgttggtgccgtagagacaaaggttgtgacattttgtcttacccaaagaaaggagaatggtaatttctgcattatgttaagcatgtaacatgggcagcctttgttagcagtatttcccttgaagagtttaggcagaaaactggctgaaatattttagtgtcccagcttttgggaatgacaatcctgccaggctgtcatgttacactgggcttggctgtcttttctctctctctaagcatgtgcgaacaaacctgccacttatatcggtttgcttttatttctgccctcccttctcttaccctgctattcccgaacctgcccatctgcttgtcttgccatctgcaccttcctagactgcagtggagctgggggaccaaggctcttgcaaggggccctgcattaccaacatgcaaaatattcatttgtatcctcacccttttgcacctccatgagcacacttctcatgtgctttgttccccctctggcaggccctttaatcttaatcatccccgattttgtagtcctagcctccattatcaccttccaatctatgattccctgtttggtaactctggaattctggtgtcagagagtttacactcgctgagagaaggatgcaatttcttcttggtagcacatggttattgtaaaacaaatatcaagttgaccagtggttcctaatctatgggctgtggactgaggaacagggtgccatcgcactgatttgatgaatctatgtgtaaatacaaattattttcaaccaacagatagtatttttttaaagatgagagccatcaaagtaaacattcaaacctgaacttctgtgagaacagtttagaaccatgaacagaagctatgcattttaccagaggtggacaagagactaaaaagtaggcatcataaaaactctaatgactcagatccattaagggctgaggtgggtggacccatgtgttaccaacaggtcatgacatgtctaaccttcccagaatacccctgagctggtccactctagctcacactgggtcagatctagctcagtcttcctcccctggcttcatggtatggtatgacccctctctgtgcctgtggccacctgtcctactgtttgagtcatgagtagctagatggcaggcaaagaatttgaccaagaggagtcctgggatcaatcattaagtcaacctgtgtttattgaatgcgtactctatgtctggaactgcccaaactgtgaagtggctggggactattgagtgggtcctgattgagaaatagatgagtaataattattatagttaacacctcatgtttgtgtttcttttgagttcacaaagaattttggaattgtgtggactcatttaatcctcataattacacaatgacttggggattattgttcctatttttctaataagaaagcagagacttaaagggatttggagaatctaggattagaaagagatcagcaggatgtcccttgtctgtgtctgccttgtggtgttctgtcctaaaagtggacagtacctctgggctccccatttcatagtctccaacaataggctcttcttgattccaagagctgtgatctaagaagagaccttggagatttttgctatcatttgttttttggtcattgggcacatggtagatacagtttttcactcagagacaagcttgtctgttgagttctgagattcagagagccttcatcttctcccatcatgaccccaattatgtatatagtcatgactattcaaggaccaggtatcacttggagagtttcaggactggatccttacccagtccaaaggcagtggcagagaactgacatctttgagcacctccaatgtgccaacccctaccaagtgttttgtttttgtttttgtttctgttctttttacagagaaggtgggtcagatgaagaaacttaggtcagagcagttttgaatttgctcagcatctcacagccaacaaaggattctaagaaacatcatttgcacctccctaggctgcagatatttctgagaaacatcatttcttggctgtgagatgttttgtggccattttatcctcagactgatgaaaaatcacattatagtggactgtgtaagtcgtaagctctctctaagctgttgccacattgctaggccattttagctgtcaaaaactgtccatcatctttggtcaggattggtcatgaattatgcaagctcagatttatgtgaggtcttcagggatacatccttgcactgaatacagctgccatgagtttaaaatagaccagatcaggtgcaactctctctgttccagtggccaagtgatctgcagagagattgttatcaccactaactcctgcagtcactctctggcatctggccccagattcagactgatggccggatcatctggctgtcagagagaattaagtgaatgacaaactttacttctctcttctgtcaaatagactcggagtgtcaaagttggaaaagaagacctcagaggaaatcttgggggtataaaagatgaatcagaccagcacatgagcttgggaccatctaagccagagaacaaactcaaagacccctaaggccaggcaggtaatggagaggagcaaagcagagccaggtacaaggcaatagagagtggtggggactgcagggaactttagaggcagccattgttcagctccagcaagagttgcatgcccagcactgcctgattttataagctgaaaatccagatttaaaatgttgacaactgattagaaaattttaaagcacttgagagccaaagaaatccaattctggatttagcctgttggcgatggtttgtaacctctgattcagagggtgaatctgattaacccaagtcttactgccaagcatgctctgttttccattctcattccaccacggggcagtcatcttcctcacctctgggctcatggtggcagagtgctgtggggtattcctggggttgcttcccctctctgctcctcacatgaatcatgcaagttcatttaactggcaagatccctcatttcttgcctataaaacaggtgtcatgatacctgcttcctagtactatagggacaagcaaatgagagagcagatagaaaatcactctgtaaactatgctatggactgagagattagcatcatttctgggaatatgtcttcagctagagagcaatttgccgtattttttctccctagactgtttccttccaagccttcacagtttctttgtttgggactgatgttatctgtatcagatacataacagatattggtttctccagtctgtgctgggaggggtaggcaccagaaacgaaagtagcaaagtctgtatcccagtgagctaatgatgaggtaggaagtggagcccagaacctaggtacctgccattggatgattctgatgctcagaggagcctctctatctttcctcattgtgtatttgaagaagcaacaattttcccctcacttgcatgatcttatcagcacaatttatatctgacatttatattacatgcagttcatgtatggcctgcgtgccacttccatgtggaatactatccatcatgcccacaacacagacacaacccattatttacttttcttttaaaaatgctgcactatttctgttaatagttacaagcccctatagtttgtccatttttaaggcacttttgaagttcttagacagttaaaatcactcagatacactaattttcttacaaaagaattacctagcccatcaattcctctgaatacatcacctaatttgcattattccttggttaaatatagtatttgcatgcataaagaataatctttgaatatgaaaaggaattttatgatattgcaatatattgagctctttggaggaaagatattatgtaaatctcaaaattaaatattaaaacaatattacactgctgcctgtaaaaatgtggagtgttaagatccatatgctgaagccagttcatttttaagggctgtgcttattggaaattagcaggcaaaatttgctccaacacagagaaaagattgagtgagaactttaaagactagaaggacttgaaagaaaactttcatcgaagttaataaagaaaagttaaaaaaaacttaagcaaataaaattttcactgttcttaattcaatttcatagtttgtttcattgctttcttctcattgttaattctagaaaattttgtttttattgtttcttaagctctggcattgggaaggaacttccaagtggcctcagaaaggccctggccatttgcaaacaatgatgtgttctccgttgagctcagagggtcggcagatggcactgcccctgaccaatgtcctggcttctatccttggcaacctcgcagtcctccaccagatggtgagctatgtggagagtcacactttctcacctaccaccagtttcctgagagagcagccgcacaatgccaggcacagagagccttgataaatatttgccagatggcttcagtccccacagatgagcattagtatgtaagtgtttggctggggagtggtgatgagaatgtgtcctggtgacccacaggtaacatcttaatatccctcccagattagtcatgtaatctggagtcttcctccactgtggctccttgcaggaaaacttagggaatgttgcttaggatgatgctacaagccctgatccactcagaggaacacagaagagactcaaccactctcaaagggattggtttgtttgggcattttaactttggaaatgtattcattcacttaacacattctttatgactgctcaccaagtactgcttgcaagtactggctcaagggtactgctttttaggggctcccatttattcgcctactcgtcaaatatttttcaaggcctttctgcatgccatatactgctctagacactgggaacacagcagcaaacataacagacaaaaatctgtgcctttgtggagcttgcattctagtcgacagcactcactgagactgggatcagaggcccagaaaagtcacaaagtaagcaggtgactgattgggaagtgacttgatggggtgcaggaccctcagctgggctcttggtaccaccctcttctgtggtgcccattcttacatttcaaaagttaggatggaaccacgtgtcgttgccagagagcatttcagtttgtggtggatgttgctatacagtgacaatgtgtttgatgggatattttattgttcaacagaccagtttgaatgaactccttgtggatggatatcacacgctgggacacacagtggttgggtatgggaattctccttccaggttgtgagcagtggcttgtgatgctgctaatagctccagaacagccttcactctgctaggagtaccagagtgcccacaggactcagggacctatttgcttgtttactccatcttggtccaggcactccaagtacatagcttcaggagtaaaaatggctactgacaatgagactggaggaaatttcttaccctgtaaggatctcatatccacatgagattgttataacccttattggagaggggacaccagttggattattagatagttgctgttcaccttgtgagctatcccataaagaggcatctcataaagaggcaaagaggatgggagggaggagggtgcaggtgatccatcctccatgctcctgtggcaagtcaagtcaactccatgaactgactggcatctccaggagagaacgccctgtatccatcctgttgactattgtgtccagataggcgtctagttgggtacctgaaatatagaaagcaatcaataaacgttcattgaatgaactagtaacttgttaaataaatacatgaatgaatgcttcagtctttcttaaagtaatctcaggcatcagcaaatggtgcagctttagctgtctctgtgatctttcctttatcaggcacctttgggtggggagctgtgattgcagttaccccttacattctcccagatgttggtaagacctcaggcttcctgtgtgcactgcacccccaaaccataaccatgttctgtgggagttgctcttctatgacctggcctgtcctacctcccccactggcagggtcccagctgcttgagcaattgcagggagggtggttgggatggcatcccagcactgttgtctgtccccctgcatgccagccccgcgcctatcattttcacagtaccatccatgttaaacaggcaggagcaccaggggtttctgaatgcagcaattaacaaaacagtaatcaagctaagtgtttaatttcagaaaattaacatcttctctgagcggatgtgaaagatggaggaaaaaggcacattgaatgttctgggtaaataaaggcaatgctggaccacaaatatttttcagtgcaaggtaaactctttgccaatccctcaggcctcgggatcagtttccttctggtagccaaactgcaggaaaacctttgctgtagaattgagccttaggattttaaagcgtgtgcgcttctttcctttcctttttttttttttttttttctcttttttgatggaagagcaaacgctttcaccattcagaacagcttgggggaacaacagcccagtcatgccccctaagagcgcatctgccctgtagaaacggtgacgtatgttgcccttctctgaattgtgcttgttaaagggacaatacagtgatttcttggatgtgcatttgttgtttatgtgcttaggctctatttctcttggcagactgagggctcccaagggaaaaggccatgtctttctcctcccagtaaaccctgcccctcagcaatgtgtcctctgctataaggtgtcctggctgaccttacaccatgtcacatgctggtgctgcctcctaaaccagcgggctggtctttgtttgcaggaaggggcttgcatgtagggaaggaagcttgctaggaggtgggtgtgcaggagactgggtccctagaaggacagtgaggtcctgctaccatctgtttcatcatctgatggcctggatgggagtgagtgcctaggatagaggattgggagggcaaggaaagtagctttgtgtgaggcatgctatgaagtttgaggcacagacaggcagccttgagactgtgtgatgaggtaccaccagtaaccatggaggcagggctctcagagtggcattgagcctggtgctgcctgaggaagcactgaaaaccatgttcccacaggaccacaggtcctcagggaggggcctggccatctggcttaataagcagtgttccttgaggggtcttgaaggcagctgacatggagaacaaagaaagcaaagcaggagaatgagagtatagtttgcgagtacagaggagacctccccaggggctcccagaagtattcagggactgcatcaacagaagacaggttcgattctgcacatgcataatttgtggagagtttgagtactcaaatcaggatattacttatgcagttggatattcaggcttctattttctctggaaggtgggaaataagattggttgctgagagtgaagggggaagtattggggttgaaagtttgaggagaatggaaaaggcttggcagtgctattgaagagaatgggaaatggaactacccaggtaaattcaatatttctggaaagtattgagagctcatttgaagttggtgatcacacgtttagaaagccacctctttttcctcttatgtggctttctcagcagtatatggttccgggacagcaggccctacaagaaacagatcacaaatatacctctggttgagttttgacagtcatatgctctgaaaagataaaggcaacatatgcctaaggttttgaggagtattgtgaattatgttattgcaaagatggagcctaagatggataataatggatatgaataaaggagaaggcagatgcattgggtggaagtaaaggccaagagtgccagatgaagccaaaaagagttgcagtgggctcatctgaggttgtggtgaggaagcagaatatttagacttgtgattttgaaaatcgagtgactttaggcaaagcagagtctaagtgtgccatggaaattggcaggcatggaagagttgtagaggccagggaaccgagattatattgtttaagtggacattgaactcacacacaggagggcaaggctcagggtagagaggaagacaaagactgaagctcatgcctccgatgaatgggggcgtgacggtgggagggagcatatggtggtcccaagacctggagagtggtggtctagccaaatggcatttttgcaaagggtgcaggagatggcgagtgatggtgtgaaagagacagtggggagcaaggatgacacaccccacttcctgaccctgaggtgtgctggatgcaaaatcataaactgtcatcaggtgagagggctgcaaggcaaaggtgtcctcaagggacagctgctcttccttaatgcaggcatggagtgaaggctctgagggaaggaggtgggtacaggggagtttcctgatttgtaagtggagggcccagggtgggggtgggctcagtagtcagtgggaaagtcagaatcaagaagaggcccacaactccatggggctggtgatgtccagaaaggggctaaagagtgggcatggcaggatggaagcccgcctgtgcagcctggtgggctgctctgaggaggaggggctctggaccttcaggccagaagactcagacctccaggcctggaggaggatggtcacagtgactgcaggtgcagctcccctgcccagcgttggtggcagtgatgtcagccttagggtggtggtggtgggtcctccagctgcattaggggtttggctgaatgtgtggggatgagagccaggtgtaacaggggcacacaacttgcggtggggtatctcctgtggcctctccactgctagtgtttggagtggactgccgttcatgatcaatcattaaacagaccaaagctgccagtgctctgctcttgtcctacacctgggaaaggctggcaggcctgaggggaggcagaggccagtgacatgccccagttgacatgtgagtaccaatggttgtgtcctcagcagccatcacagtgcttagatgcctgcctgaagagtatcctgctccacagacacctccacagcctcccatggttgcagggtcacagaatgcaggtttgctatagttttcacataaatggcacattctaagacatcttttgattcccccagcagggaggaggagctgtggaaaactgccaggttgcagtgacccaggaggcagaagtgccaccaggaacacactgcagcctgcctcctcctccaggcacagggctctgcacacttccaccataggtggggacccctgatctccctaagggcacaaggggtcccagaaggcagtgcccatccattagtgatgctgatgtaactcaatgtccccacccccatgcctggcctcctcaaggctctggaaatgcagagtgcatgagttgtggggagggagccctacactgatctcagggaaaggaggcccagctgtttctggttctgcactaacctctggggacttggggaagtcattttcccctctcttatcttcattgctctaatctataaattgtaagagttgaccaaaactgaatggcctcagatgccctgtcaaactttgacattctgatttctaggtttccagacaagcagttctcaaacttgagaatgtgtcagactcctgtgaaagacttgttaaaacacagattgctgggcccacacccagagtttctgattcactgagtctaggatgttgctctagattctgcctgtcttaccagttcccaggtgaggctgatatgggactacattttgagaacttacagggtcagatatatgatcccaataaagaatgccaccccaccctcaaacacatacacatcaaaggtaacatcagaagtgagggcctgtgctataaatccacattcccagatcagccaccaaccctcaacccccacctgtcaccccccacattcccctttggcacggaaccgaaacccttagtggatggaccagtgaaggaggagcctgtgactccctgccttggggtgtgagactgaaggccaggcatgaagccctctctttttatcccattcacatctaaaattcagccaggattctacaacagcacagagcagagctacacacccaaggaagtcctctgtccccaggtgactcccagggtaaggaggaagataggaagggaatgtcagagacatctcaaggcaaagcccagagtaaaagcaaacaagaaaccaatgtccacaatagaggaaaacaatgagaagaataattaattctgcttttgtatttatacccagtctccaaattaattgcttatttgtttaatctactttgaccagaagtgttactgcaccaaaaatatttaatgagtcaggtcttctaatgtaaaattcaagcatatttgggcaatgaaatgagttttcatctacagtgggagatccagctatctaagcaggaccttttcagcaaagttacctcctagaatagaaatgtcagagggaacacagttcatctgtgttgcaaattgttcttctttggtcatgagtactagtgggctggaagtctttagttgacatttaaatacaaactttggttttttgatatgggaagtgtttcatatatttaaaaaaaagatggccagccagcccaatccttcattcacaaccccatcactcatagcttctaggatctcacagaagtccctcgaggggacttctggagactgctcagcattgtttgggtctctctataaacttttcagagtctgggttggggagatagaaaatggactggcttcaaggccctagcagctctgattcacccagagcagctctgcattgttctgtttcacactttatacttcagggagaactttgtttggagaaaggatttcatagctttaaaaaatagaaaactgccaatattagggtaacgttacagctgaacaatcccagtgagatggggagggacccagcctgctaggtgtcttcatttacaccacagagaagaacttctatctctaatcccttgggactaccatattcaggcctattctatgttctttgtgagatgcagtctcaaccctgctgactcaaccctgccgagtcacaaccctggctcccttttccacctcatgctccttcaaaggccaatattcatgtttgttagaactaagggattttctgactccttttacctctgaggtctttagagaagagcccgcaatcattgcagtaagagtaaatttttgttgaacatttattatgtgctagcacagtgtgaagaggctaaaaacatggtccttgcctaaagactttattgcactgatggagagcagaggtgagcacctcggaaggtagatcacagtgcactgtgtcccaaagtggagatcacaccccaaggggctttgggttgggaggcaggaaagggcactctggtgggcatggtcaggcaaggataagcagtgtggggcagtgtgaggctccccctgtgccttcaaaggccggcaaggtcaagaaaagagatgcccacagggaatggaattagggctttttctagtggtgagccattgaaggtttttagcattggagtaacaaaggtaaaattgagtttagaaagattaatatggctacagagtagtttgaagtgaagaagttagaggtggacaagagagttaggatggtaagtacatgaggcacaatgagatacaggtgacgagacctgtggagaggcagtggcagggccatgggagcatcgggggctcctgggcctgagccacacattagatgggaaggctatgcttgttcactgtccagagtcactcggtctccttatccttagggacaagataccctatcacttactttctaggttgcttcaggttatctcaaaatgttcaagggaaaccagctctcttctggagcatttatcactccagcctctggggaacccagctctttgctagcttcccctttctccaagcccatttgtatctatcacatccaccatggcttggtcgacatatttatatatcctctcaaagatatttatcagataaatacctgaggctgtctctggatcccactttttacatttaccttggggaatgatgcccagtgattgatttgcatatgtgaacagcagtggacccagaaggatagtttggggtggttgccaagtccccagcctggcaggtgggatctggttgaaaggagcaagagaccacacagagaacatcttcaaaacatttgggaaattaataacataagaattaatattcctattttacagttgaaggacctgaggcccaaagaagacaaggccttgggttaaccttatcccaagatcacataataagcaaatggcagagccagaataggcacacacatctctctgcagcacctggagggccctgacaacagcccttctttatttctgctaactcctgctgctctgagctgggccctaggctccttactattccttaccttacccgttttcttcacagctatggtctgtgctatagatcacaggtagttagtccaaggatgatttggctgggaaacgctgttctagagagaatagaagaggttagtattaccatatgatccagcagttccaatcctaggttgattcccaagagaaatgcaaacatatgtccacacagaaacttgtgtatgaatgtttatagaagcattattcttcaacttgtgtatgaacgtttatagaggcattattcttcaacccaaatattcctcgactgaggagcatttctcccagacaaagcaatgccctatgagggtaaaagtggttaccaagccttaggttcacactgtgcaggctggggcagcagcatcactctggggggtcactgggagggcaccctccaacacacacactgtatggaagggccaaggaaaactactctaccctgtccacccatgagttattgtgttggggaggcagatggcctcctctttgtatgggtctccttgggaattttagatgtgaaagtacctctcactggaaacagcatttgccgtctagaagagttgctagagcatttgcccaagctaaggcagaggcagctcagctgtgacctacatcttcctagagctggcaagagatgtcctcaaacaaggctgtccccgtcacaatttccacccacacacacaacactgttttcccttttagataagatttgctgaactctgaaatctgagtttcataattttataacctctttaaacattttactccaatagatcaactgaagtctgagtgtatgtacgttaattttaacacagtaaactgttatatcatttgttaggtcccaaaactgattatggttaaaactgttgaaagaagtattttggcacaaaaatcaactaaaagattgtgaagtatttttaataagcattgtaatgtattaaaacttagtaattgtcctagaaaaaaagcatcaagtaaatcttgtatttttggaatctgagatgcttaattgttggaggaggatgcccctatcagataaggaaaacaaaatgagtaagaagaaacctttgaagataactgagtcggtaactaaattaaagtgtcaaggaatgtcataaacataaaatgcttggcccacgtgaacctgtgatatgacagtaaaactcctgcacatcagaactctaggatccagagtctgggttattaacttttgagatagagtcatgccaccatctcagacccagcctgagtctcctgggacttcacagttccctttgggaccgtttgtacaaatggagggctgtctggtggtctgccaggctgcatcttcgatactactggcagtgaccagtggtcagtgactagtttgggccaacatttgttccacgtcatctgtgagctctttcacaacttgcagctagggccatcctgtccctgtaatttattcacatctcctttgtcaattcaggcaagaacattctgtgctcttcctctgctgtatgtgatatactatcttggatctgtctgctttaaaagcaatttgagagtaagttttccccaaagtctttggtggcaaaaacagagacaaaggactcactcactcagcctgcctttgtttttctccatcccagagccccttgaccagtgatgttttaattctctttctgcttctgacacatttacaaggccttttattgttggctataactctcttcttcgacactctcattctgattctgtttgaaccctagttgatttttccttggagtctgatgacactcttctttgctctttgctctcctatttgggtgcctgtactctgttgggtcagcctcttcatttgctaagaaagggtgcagggcacctttgattccatttggatttactgggcactgcctctttagacctcacacatctttcttgaaacttcatcaggttctttccaagtaaccccaaactaagtctttctgcttacgttttctgaagaagggtccatatttgtttctttgctaaatttgaataatcttgtgaactctttattttcatttctttctctcagtagaatgtgtaatttattcaaaacctttatgtgtgtttgccaaaaagagactctttcagatgttcaagcaaactatcccttcatctgaggaatatagagaaaagacaattagccaggacttactgtgaaaaccattgtatatgggggcaaaaggggatacttctttgaattaatcttctcatccctctttaatctttagctttagttttgctagaagaagttggtgtttgagtgaataccagagctcattcttattattttctgttttgtccgaaagtttcatagcacataaaacaacagatcaagaggtgacatttgcccttggagagggaaaaaccaaattcatcactgcaggtgactgttgatggcagagcactgaacataagctgcccgtgattttcagggaggataagaaatgctttcttgctttctcccatgtgctaaatcccatcgtaataaaatgtaaaccatttagaatgacctgtgtgagaatacacagtcttccacagggcctgtaaccctcatgtcattgccatgaatctgagaaatacaggcagggatggccatcaccctctggcagctcttcccagacccgagtgctgctgactgctggggagtccataccatgtgtagtgacaggagcgtttctctccatggatttcactgtcagttgcctctggatcactctgccctgtgattgcctctttaccatctgaccccaactagactcctgcacagaagtgcagggctgtgactttcttacttgttcttctgtccccagtgcttagaacaggactggcacagtgtttggcaaatatcttgagtttttaatgatggctttccagagagtagaggcaaggagaagaaccaagcccggcaaaatcctcaggccattagcattgatctttccattttttaaatacatgatgtttcagctctcaagacagagggactctgaagtcctgtatgaaactgacgtgattcacaacatgtaaattgtgcctccgcagaggtctgcaagggcagcctgagagtcacagcgtgcagtggaaggaaagaactgtcaggagctatttgttcaccctgtctttgtggacccactgggatcctcaaatgatctggactgattccagaaaactgcctcgccttccctgaactgtctttatcctcccccatgactctgtcccgtgattgcaaggtgttgggaaagatgatcacaggccattcacatatttaaccatcaagccttgttgctaagtccaggactcagctcttactttcattttacctgacttagcaacagcatttaacgtattctgtcctcctgggagcaccttatttccacttggtttctaggcgatcacactctcctggtttttcttctgcttcattggtggcttttccttctcaggcctctttagtgttttctcctcatcttctgaatcttgaattttttctatctattgattctcttggtgatctctgcaagttccacttatttcaatatctgtgaaatattggtgactccacattggtctccaacatggaccttatgcacctatctggtactcagcatctgctctgggacaccttggacatctcaaatctaacaggtctgaagtggagcacctgggctctcctctcaaactgcttctagaaatgtctccctgttctcagttgatggcagccccattcttccagatgtttaggccaaaacccttgtagtcacttgactcttctgtttcttccacatcccatattcatggaaatattctaaatagattcagaatctgcctactgtgctgctcaggccaggtcttagcagccattgtttcccagctatattactacagcagtgctgtgattggcttcctgcttttacatggcccctgcattctatttggagcacagcagagagtgataatagtatcatataagtcagattacatcaccgtgccttgttgacagtcctcctatggccctccagcttgctcagggtagaagccaaactccttctagtgtccctcagggtcctgccccctgtggactcctctcttctgggtcccactgactccctgatgcccccagatcagcccctttgtcctggctgctccagatacccactcagctccctcccttccctccttcaaccctgtgctcctgcatctgcttctcaggcagccttccctgatcacacacctctcacctctggcatcctgtgtccctttcccctttccattttttcatgtacttaatatattttaacacagcttatgattcatttattagctctagtctctgctgaatccccccactagaaagtaagctctatgagggctagaaattttattttgttcactatggtgcctctagaacctaaaaagtgactggtacttgacagatgctcaataaatatgtttaattaattaattaacctgggttatagatactactaagttgcaggcaagaaaaaatacacttgacagcttaatcaagataaattatttccacttactaaaccaataggccaaatttaacaccgtaaaggttgagatacatgtacattctcatagtcaaagccaaaagccaactctacagacaaaagatgaggagcataccatggggaaacctaaaggttatatataactgccatttcaggactgaacagcagggacatgtttttgatccgaaggctattggtcatattaatagatatataatacacagatcatgatagatattagttttattctaatctttgctgctcaaatagtggaaagagaattggattcacttccaagccccaagcctaaggagaatttagggaacatggtctcatttggaaaagagccatcttgggtggcatgtaatggtcatgggagaaatatttgactatttttttttcagcaggaatagctcaaggaagatctaactagtttccttagatatttgacaagacattttgtgggagggggaacatcctttcttacttcagttggtagaaaggaaaacagtgggaagaagataactttcaaataaagatcggaagatatgtaaattggtgagacttacctaagtatagaacagcagctcctggaggcaagaagtctcccctctctgggggtacagcaggagcttggcagcaaattcccaacagggaagttgtagggggaatcaaaactacattaattcagaccctccatgaagcagacacaaagatgggattagatgtatgaaagatttactggggaaatgagatgggagtcagaggaggctgggaaagccatcagaccataagaaaggtctgatctctgtaaaggagagagggaaggaaggaggattgggtagggtaggaagagctttagcttgctgtgggggttataaggtagtgttggaaaggccactggggagtctctgattggaagttgcccatcagagtagtcccatatatcgcaggaatgggtctgccatggcatccctgctgctctcattcattggctgggagcagcctgtgggaatcagggcctctgtgtgaatatggtgatggactgcagagtgcaggaactggagctgttagttaattactcttcaaggagtaggaactctgagaggtgcatttcacagccaccacaaggtctctaatgggaacagggcatacctgccttcaaggtcccagaggacactctggctctgagtccttatcacacttctaactctttatggctttcctggactagcagcatcttcagaacaagtgctctgcatcctctccctgaggggctgcatgtagtagggactcactgagggtccaatgagtagtggagaaagcagcagccaccttgtgaccccgtagttgtgcagtgtaaattccaggtctttgagggcaatctgttaacttgaattgaggatagtaaatgtcactcagccacggtccccagagaaaccattgtaaagtggagtttgagtgaggaaaagaccttcatcactgcagaagtgccaggactaaacggaacagcccctgagcagagcacagattgaagcctcatccattacccacctcttcccctagaaagacagccctcatttattatttccagactgttttcattttgcttacaccatgtgaaaaatgttgaattgggaaataaataatattatttccaaacagagatttctgaatcaactttacagattttggaattatcttgttcccaaatgtttgatttgtttatcatttcttcatttatacttgtgaactccttattggaaattccctcatttggaaaactctgaccatacctctgttgttggtctgtgttcatgtctttttgagagatacctcctctcttccttttaaagtataataaaatctaacttgcagtatcaggaatagatgtttgctagaatgctcctttctgttgtagagtaattctacaccaactggttctactctctcattatcatctcttgccccaggttctcatctctgcaatagctcagcccacaactgcaagactgaggttccttcaacaccttcttctcaaaaacattacagtgttcctcctttccttcagtcttttcctttgattcctccaactgtctcttgttttggtcaagccttgccacctctgaaagtcccatgtccattccagctcctgtgcacacatgctttcctttcctaaatgctaccttctctctcctctgttatccaatctccattgattctgcaaaacccacaggaagttctgcaggtccagctcagctgatgataaagaaggagcagagttcaagccgaatgccatttttctccctacgtacctctggaagatggcccttcccctataattgagtgtctgttcagctaccctgtttctttctctctccacagccccctccaccgttcccatcatgcaccaagtcagtgccactatgaggagcatcaccttgtcatggccacagccggagcagcccaatggcatcatcctggactatgagatccggtactatgagaaggtgagccagctctacctgcaagcttgcaagacccaaggccagccactgttccatggatggttgctagctgaaggcacaaaggagataggctgctgaggtggggaggattctggtgacagaggccagaaggtccctgggagagttctccaggtctgccctgacaaagccttgttcaaagcccaggcactttctgtgccaactaaggagagaaacttccagtccaccatcctgcaatctggatagttcactggctgggaaggaccagtcccatttttccagtcacatgtttgatatactaatgcagatgccacaaaactgccaggggtccccgaaccttcagaggagtgtgtggtttggtagatcagtgtttttcaaagtgtttgtgtacctccaaaataaatttatttataaattatatgcatgtactactgcactaatatatttgtggaggataaaaaaacatgtaaagtgaacattcaaaaggatgagataaaaattaacagaaatataaatttatatattattttccttgactactcttgagcatctgcttctgaggatgacagtggggcatggggctgccaagaaaagggaaatggtgcctggtggagctggtccctggcctccctcttaccagggcaaaatgcagcatttgcaaaaatcttaggaaaatacagtgccttccgttttaacccaacacattatttgtaaaaccacattattcattcacttatttgttcagtaagtattgtcaactatttgacaggcactattctaggatatattagtgatcaaggagacaaagattcctgcctttgaggagcttactttccaacagagggaaacaggcaataaacagtgaacataacacgtaagaaaatcatatagtgtgttagaaaatcaacagcatagaggaaaaaagagaaaaaatagcaaggtaaatgggatcaggagggttaggcttgggaaagagcaggttgcataattaagtagaggggtagagataggcctcttggagaaggtaagatctgagtaaacctgaagaaagtaagatcgttgtgaagcagttatctggaggaggaaagggcaacagcctatgcaaaggtcctgaggcatgatcatgactggtgattcaacaagcaggaaggaaaccagcatgactggagtgatgcaagcaaatggggaagtaatagacagatgagagagattaccagaggaggtcatcatgttgggccttaaagactgggccgggtgcagtggctcacacctgcaatcctagcacgttgggaggctgaggcaggcagatcagtggcgctcaggagttcaagactagcctgaccaacataatgaaaccccatctctactaaaaatacaaaaaattagccaggagtggtggcaggctactcgggaggctgaggctagagaatcacttgaacccaggaggtggaggttgcagtgagcctagatcacaccactgcactccagtgtgggtgacagagcaagactttgtcaaaaaaaaaaaaaaaaaaaaaaagactggagcttttccactgagtgagatatggagctatagcaggttgaggagcggaggagggacaagatctaacttacattttggatggatcatttaagctgttccactgaaaacagagcctagtagatctacaattattaacgaggatgatggtgtaatcagggtaaaagcagagggctgttgaaatgtagttgatttccagatcagctaaaggcagagccaacaggatttccagcaagttggatttcgggcatgggaaggttttagcctgaaccactagaacgatgtagccggcactgactgagaaggtgatcactgtgggtagagcatatctgatgtgaggaaaggaacagaagttcagttcagtgtctaaaatgcttgtaaaatggccaagcagagatgtgagataggcagcaagagattcacatctggagttcaagggaggggaccgggtgaagatatccacctgggagttgtcagtatgtagatgataagaaagtcctgagcctgggtgaggtcttgcagtgggtcaatggaaataaggagaggaacagaaacagagacctatgggcctgcaacagggaggccatgctgaatagtgggacatgactgcactggcagcagaagccctcgtttccagtgccctgtgcagctaaccagccatggagctgtggtccaattacttaaccactctaggtcacagttttacatttatagaatggtagcagtttacctccctgaaagcggaggtctagatggatcaccaatcccagtctgtaaggaggtatgcccttcagccattagagctgaacttgcaagcaaggtggaggattaagcggcattctattctacttagagaatattgagttttataaggagttgattcagatacttcagtgaattggaaataatttaaaccagctgaattcataagcatctgttatatctgatccattttggatttagggctcttacttgctagatattttttgtcagttaatgaagtaaatgttgactttttaacatattttggaacaatgtgtttagactaactgaccacatggtctcattttgtcatcagagttggcctaacaagggtccacccagtcccccttcccacacatataagcttgtagctctattgaaataacacctcatctcagaaaaacaataataatttctccccagcgtgcacctattgtgtgccaggggttttataaacattatctactttcttcctcacatgccagtgtggtaaatgttagtatcattgctatgggtaaagaagtttttaaaaggaaaacaaagaagttaataaaacaaaaaccttgtccagagtcccacagctgggaagcgagcctgggtcctttgccctgcagcaggtggtggtgctgggaagggaaagaatatgttagagaccatatactcctcctcttcatctgccgtgctcagagcagtcacttcagtgggtagccagggcaggggtcaagggcttaatgacaggccgagcactgaagccacgaggctcatgcctgtataccttggctccttcctcccaaaccagcccaagctcctctactacctttccctttacagctttcccttgaaaactgtaattaacctcaactttttatgctgtaaaagcagcttattctcccattcaggctacctccctgcttcttagtaatttgtactaattattaacagacacacatacacagcagcccaatgcctgcagcagcttccacacctcagtgaagcatattattgtccccactccagaggagagaatgctttccttggaaacagagaaggttctttgggcaaatattggttaccatttggtatacgactgtggaatgctccttcacttacgaagtgcttgactacaaagtccattacattgctttgactattcctaagactaccaaagaaaaagatgttagcccatgagggccttttgaaacaatgatgataattcatcgtatgttgagtatctattatgtgccagatatacacagatatattagctctgatccttaaaggaaaaaaagtgtatacttgaaaatatatataaccaacttatagatgatggagctatgtcatagaaacattaaatgacttacccataacagcacaggtcattgctagggagtcacagaaccagaactttacacatttttatgatacttcggtggtggaaacttctgagcttgataggagagtggatgcaagcacctccgatgctgaggatctcaaaattagtgtggctcccaaaataagagattgtatcttaataaatccaaatacttgcaaacagaatgatctgcttacctgctccatgtggccttggaatcctggtctttagaagatgtaaacacaaatagaattcagcacagtagatgtcttggatttggtccaaagaagcaaaccccattatttcttcatcttgtgccatctcctcttcccccaaggaagtcccagcccctcatctaaaccaggagtcagcaagcttttcctgtaaagaaccagaaagtaattaatttaggcttacgggccatatggtttttgccccaactgctatagtcgactctgcctttgtagcgggaaagtagccataggcaatatgcaaattgatgggcacggctgggttccagtggaactttatcaaaacaggtagctggtccatgagggcagttttgtaacccctgaaaatcttccatgggtctcctgctccacataacccttggtttgcgcttaggacccctttcagtttcactctatgaatagaattgatgaggcttttgcttcctccaccagctcattaatagagagctcagatgccatcaagctgatgacactcctggagcctttcccatgttcatctccttccccattttaatacacttccattcatcattctctcttgtttactgtcgtgtagcacttttcactcctggtgtcagcgcttgtagacaaaccgtaggaggagcatctacatctgctctcagctgtcttaatgattaaatgtttatggttactcgctcttcataataactatataggctaggactggctggtttaggccttggtaatttctacctttcaaattttaggatcgttttctcatagagactctttcagaccttggcaatatcttgtgctcaatcaatttgttcaaataactggaccgaagtttactgtttatttattcatttggcattgagttgttgagcgcccaggtggtacaagcattgcgctgcatattggggtggggaaggagaaatgagggaaacatggtttctgccctcaacagctgcattctccatcctgcatcctctgtctcccacatacttataattagtcataagcaaccaataataataaaaaaaagcaactttgttcatggctcttactgatttgcctgaaattgattaatgattttgtggggaacaagaactaatattcattttaatcactgaacttcttcaagaatgtttggactataaagtgattatggagtaatgtttggtcctcacaatccaaataccaatgatgtattaaaacagtttttcaataacagctatccagtcactgcttcatatttatcagccagtgcctgatttcagcagattctattaaaaccagagaattcaggcagctgcttggattttgtagcaatgggattttattcttatttgcaaggtgacttggtgattttcacagtttcagatctcagatctccactgtgtcaaagtagaaatgatcaaagttctggatgacatcccttctatagtggacagcctttcttctgaatccctgagtgggggtggggaggatccccttgtgtttaaatagatcaaatagtgggtgggcagctcctctgcaggcagtctctcccagggcccagtagacatccccttcattagagtgagaatgggcctctttgtaactttcaactgtgtgtttgagctgacctgggacctgtggtccctcacaactgcttctgaatcatttatgggcatttctatgccacccacacttcagatatgccaattacttgcagtctcctgaactcctctaggccgtgcttttgcatgtttaattctgttctcactctccacattcatccatgtggctaatttatttcatcttttgtgactcaactcaggtcaccctttccctcagtcactctgcatctcctctgaagtctgggctggatggtcccctgctgtgcccccacaatcccctgaactgctctctgccaactcactcaatcaacactgctgtcatcttctatttatttaccagtccacccacagatgttacatccccagaggaaaggaaccatgcctttgtacctgcagcccatgtatagcacccagagatagtagtgtgtcataaatgtaactggctggccaaaagaaggaatgagtaaataaatacacatcaggtcatctttgacttcgcaaagtaggcttttatatattttaaacaatgggaatttcttatcactgtactgtattctttacatatatttacataaaatatattctttatatgggaatttcttatcactgtactgtatcctagctcagctctgtttcttctgtcattttaccgagaatacagtttacaatttgtaaagcatgcttcttgaaccattgtgcctagaactcatctcagtaccccagatctgcacaggggacacagggacttggatcattccctcctagtgatccaggctcttcattttcactaaagtccccatttttttctaggattcatggtgcagacaaagacaggcccaggcttcaagcttctgttcatgcatacctgcagataacccaggatctttgcaaagaaaagatatgctcctgtgaaaatgattagaggccatgctggtatacaagaaggtgctggggtgaggtgtgattcggaatgacagtgtgtagacagtccacagcccagactggtgaaagaagccttccaagagaagaggccttgggaaacataggcttaagcaatctggagggagtagaggagccctggagagaggcattttagacaaagaaaagagcctaagcaaatgtctgctggccaagatgtggtccccggatttaggggaatgtgagagattggaattgacttcattatgaaggacctgtgaatctatatttaagagttttgcctttgtatgatgatagtttttaagaaaagaagtgtggcgttgggtggggtggatggggaacatcaagaaagaaaggaggctgcaaaagtccaggcacaaatcatgtgtttaataagataagtagcaaggagaaaaagtcaccttttaagggcactcacgatgagaaaaagagtcatgcttctggaaaacagaagcaactctctgcacatcagaggacccaagtgtgcagatgacagggactgtagaggtcagcacagaaagtgctggagagagtgacagacaggagaatggggctcatccagagtaggtgggggggatgaggacacaggggctgctctgcagggagaaggcacatgcccgctctgaatgctggcggaaagtagctgggggatgcactctcagacacagggcaaggtgagggcagaagtaggtgtggagggcagtccagaatggcctctacctctccagcagagtggacacaaagccttttgcctgagcacttgaaggaactgaaggggagtgatgtagaacaggcactttggagagtgtctagggagatctgagtcaggagagaaaacagaacaactcagcagaagcaagacaaagagaggcaggcagggggcagatggatgttgcctagtttgcgtctgctgaggtcagagacttgaggggattttgcaaagctggatgtgctatgttatttcacctctgaacccttggggaggaggactagagaatgacaataagcttcctcgccagtccctgagcactcagtcatttccctgggccccttttttcagagtgtggccacctcatagtccagacctgaccctacattcccttggcccagatcagacttcttgtccccatccagagggatggcctggagctgatgacaacttctagcagatatgcaggaccaagaaatgatggggcctgaatactccagggtggagtgggctgggggtgtagccttcaggaatgggatagtgaccctttcccttgctttcttttaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacggtaagggtcggggagggcagtggcataatcacagggcaggcagtgtgggagaaaaagtagccccaaagatgctgcactagccaaaaatgctgatctccaactggattccagtggaattcccttcaaacggtttgcctcccagtagggccatgtagattttcctgatgtctggctcatttctctcccaacgcctggttggatttgcctctgaagggtctcttgccatgtgtgatcttgcatttcagcagtgagactcatacctgtctcatggagccagtgtgccctcttgcctaggtatccaggtccagatgcctctgtttcaccctcacgcccacttcactcctctgtgcttatggtctgaaagctgagctcatggcctagtttcatgagccaaggtcttcagggaggaaatggagagacaaaatgtgggatgtggcagtctcatgcacctgggatctcagaaatttgaagcaacttcacatgtgacccccagtacgtcctgctcggatgtctccagagagaatagccaaggtgtcctcaaggccagaaagtctatcaccataaatatacttctacctttgggttttattagttccctattatcactatctgccccactcctctgagaccacccccagcaatagttctgaaaaatctgatttcccagtagcctcagcattgtgctcaagtgatctatctgactgtgcctaccactttctctctcttagctagccatttaccatagtttatgtaattatttgtgtatctgcctacctacctatatatctatatttattattcacttatgagctgtttcctgatagttttccaaatgtcagtctattcctgactccccaaattgaaagctttccatttttccttcattaattaaattatccataaaacagtctgtccttatatagcattttattttaggccaatgctctcagtctgggtgtttgatagggtttgagattttatcttgatgcacattgtattttttaacaattttgaaattaattggaaacttttaaaatcagttgggttcttatacaaatcaggatgttgatgttcttgtgaaaaaattgtaagagaagccaatacttgtgggcactctggagtgaggaccttgccttaaagctgagaggcagctgtctgcatatggtacccaccacttccaatatctctaacctggatactttgatgtgaaacgtctggcccctgtaggactggagtttgcaatctattgtgagtttatttgaggtgaactttctctcatattttgaggatggtgagatggggtagagaggtgagccagttaattcaggttgataatgctactggtatgaaaagaacacagactgtcttctttttccttaagggctctgtcctccactttgcacctcacttactgtctagatttataggcactctggcatcaggacgtacacaggattaaaagcccaaaactcaaaatgctccgagtgctggtctcttggcaattctgctagacaaatcaagaagtaacaaatttctcccaagaaggctgtttcttttacatttggcagttaagttttgcaaacccaagaggggctggttgtaagagagttctggtaagtggccaaatttgggagtatttgtcttacgactgaggttcacacatgggtacggattatgttcactggggcagcaggcctgtctgcagagcgaaggtagtcagaaggttgatcgatgatagggtcattggggcagggaggacctgtggaatcctgcccagagtcaatggccacactttgggctggtaacctccacatagggcagacccactatggccctgggctgctcttagctacactgttctgatttttgacgtagctgcctaatttttaaaaaatcattcaagtttcatattacattatgaagtttttaatttataaagacattgttaaggatgcttcattggggttccctgtgtatttttctatcgccaactttatgttttaaatacatatattacagaaagtctcagctgagggcaactgaaaattttccttcagtctttaaaatcgacttccgtctttaaaattctagagaatgggaggcttcaagaaccaatatccttgttcttagaaatctttctcctccaacatggttgaaggacagttctcaaacattggggaacattagaatcacctggactgtttgttaaatatgcagataccctgctcttcacccagaggatctgattcagtagatctgaggaggggtctggaaacagtcatgtttaacagtcgggctcaggtaattctgatagctcatgggaaacctcactttaagaagtattgtcagtgggcatggtggctcacacctctaatcccagcactttgggaggccgagacaggtggatcacttgaggttaggagttcaagaccagcctggccaacatggtaaaaccccatctctactaaaaatacaaaaagtagccgggtgtggtggcatgtgcctgtaatcccagctactcgggaggctgagacattagaattgcttgaactcgggaggcggaggttacagtgagccaagattgtgccactgcactccaccctgggtgacagagcaagactgtctcaaaaaaaaaaaaaaaaaaaaagaagtattgtcattagggttgctagataaaaaataagatgaacagttaaatttgaatttcagacaaacaaaaattatgttttagtgtaagtatctcccaagcaatatttgaggcatacttatactaaaacctttttcattatttatcagaaattcaaatgtgattggcagtcctacattcgtatttgctatagctggcaactctaattgtaatagaacataaatagcttgacttctctatgcctaggtcctgaacattaggtaatagttctttaacaccagtgaaagcataaccaggacaataccaatactagccagctggcccaaattatttgtatagattaaagaaaagagatttggtatttaggacacctatgatagagcagacagggtgaaatgtgcttcatatgatttgatttttttcaacagacaggaagtgtgagggtcagaaggactaaatcgtgtgtccagtatcacaaagcttgcacatggtaacgccagggtttagatgagttctgtctgcctctatgacctgtaggcttcccattccactgcataattcagcatggttctaacatttggcagaagccttgatcattttcttcttgagcgggaactcagagtgctgggccattcatttctcaggcatttctttgtcctccacagtgcctggaggtagtgctggctgactgcggatactctttaagtatctgctcaatgaatctattgactctgtgccatttcataacttcatgctttagaagatatttcagcagtggttttcatttagataagtcccctttattggaatgtccttaacatggctgacagttcttcgagagaccttccaattgagggaatgtagattgggaatcatctctgctccaggaatgtcatcagctatagttcccagattctgtcacggctgttttgttttcattgtcctttgtttttggttgtttttgtttatttataacttaaaaattgctgtttgttttggttagacttacaactctgacacatagaaactatcctctacatatatgtatatttagatcatgtttttggtattgtgcactgagtatcagctgtatgcaaaaggcacatggggaggattctaatgcctctttctcacctagatgattacaagtcagagctgagggagcagctgcccctgattgctggctcggcagcggccggggtcgtgttcgttgtgtccttggtggccatctctatcgtctgtagcaggtaggtcctccactctcacttgctctccttggacccaggaagcccctctccatgtgccgtttcccaggctgcgtggatcagatagggtgtgaccattcacgaccacaatcatcactccatctcaatccaagagcagcctagaattctttagatatttatttagctgggaaaaaattcatatgagagctgggcaaggctatgagtaaacagcatccatcctcaaacctcattttaacgaagacttttagccccctcttacacacaatggcttttcagagtgacagttgcaaaattgcatttgactcactggagcatccagcctgtgcataacccatcctccagttaagagagctcaggctctcagcagccagcaagagggaggcaggctggcaggagagaagatgaggaggaaagggaaactctgagttctgcagaaaagctggccccgaaagccttgtgattttttaatactgctgctactgccttcagtggttagcccagattctgtcacgcaaagccctgtagttggctccctcccaagcagttctgcaatgtagcttaagtgctgatggacatcctcttcacctctgcccccatcagcactgccctctgaatggggtcccacagtcccgccaggcttctgcaagaccttggctggaaagcagaaccatctgcccacaggagtgagtggtggtcaacaagagctctaactgcagcaggagggctgaagtgagagttgcccagtccctaatcctgggagatgccccgggtgagcccctatctggcctggggcctagatggaggtacctggaacagactggtgggtgtgccctgtggctgagagagcccctctttttatccacaggaaacgggcttatagcaaagaggctgtgtacagcgataagctccagcattacagcacaggccgaggtaagtagaaagcagagacccggtgtctgacccccacaggccactgagtcaagtgggctagtgctcagagctctctttatagccagactggctggtcccagtggcaagttctctctcagcccccagtgccttggccacctttctgcaggtccccaggggcaacaggctaccctcccatctgccgtctacctgtcatgggtactcattggatgcctggtgggtagattattgtctgcactgataagcccatataggacacaaaatgcagggaaaagattgggtttagcaagtcaatgaatcctcaaatcagactcagtgggaaaagatggagttctctattaacatcttctgccttatcttatccaattgagcagctggggaatttgttaaccaaattcacagataagccatagaacatgaaggtagggaattaaaaagatagcagagcccaagaggccaaagtgctgggatatctcccaagtgttttcctttaagcagtacctttaaaagtttttctcactcattatcctctctcttttataaacctatatttataatatttttataactaaaatttcttttcaccaaggtgcaacataaagttccctgtcacactcattttctcatctgtataatgacaacattgcaggatctgagaaaggtctctctaggtcatttgggccaccttcctgcctccagaaagcagaattctcagatccttacagcagacacattctgtttctaaataattccttttgaattcgacagatgccctcagaaatctgtcccagcactgtgtgctatgctctgtcaaggcttcttctgtgagcctcatctcacctcaacccccttgttgcaaagtaaggctggtgcttcctgttttctcagcaattagcatggaaaacagacctcccaggtacctacacaccaaacctgtctccacaggggggttcttctgggggtgaacatggactcccaggccaaagttctcatggaccagactgcttcttctctaaggttacccaaggcgggaaagtgatgccaggatgttcacagcagcagctgcaccatgaaggagcttgtgttctaatgcagccaatgccgactcgggctgtacaaagggcacttcatagatgtggcttccaatctaagatcaagaccctgccaagggtttgcagaggcccaagcccctggcagctgggctgctgcccagggcacttattgctggagggagttgtgggttctgcactggctcgagcactgctgctttcccacggtgccccaggggagcccctaccatcagcagcccaagtgtgggggccctctaggccacaggcacagctcctgctatattcagagtcctgcttattcctctttctttctctccctgggccaccctgttactccattgtcactgatttcagagggatcaaccctgctgtgttctctttcctttcctatggccggactgtgtgccttgctgcataatctacaggatgcttctatttatgttggcctgtgcattagcccttccaggcagggccttaccttccccaactggaaaacagggactttgcttgtacctgtgattctcaagtgatggtgcactcaccagggtgcctccgtatttcctcaagggcgaccttcgtctccctgcttccctgcctctgcctcaggatcctgacattgcctccctgactcttgctcagggctggctctttttcatcatgagccactgtaaggtccatttcagatctggcatcctgtgaatgctgtggatgaaacatttagaggtggtcatgtcagtctgaaagtggagccaggaccataaggataaaaaattaggttcaaaaggaggaatctcacttcgaagtcaagagatatccaaagatgccttaggatgacttaggtgagagctccctttccaaaagcgtgcaagccaagccttggcttcactccttggctggggtatagaggttctccaaacattgggtggggtgaaactttgtgccctttcggctactgcaacctgagatctggctgttctcctgctctcgaggagtagctatgccaggccatcacatggtgcccatgtgcacaaaagcatgcttccaaaatgctcacagctaccttttgggggactctgttacctctcaggccaacagaggaagattttactggttcctgagatccatagaaaaaccaatcctcagtctgcagtaatagtggccttgctggaacaagggaggacagctgaaagaacattgttggccagctacatagtcgccattcctgggactcaggatggatgcagggttttttgtgggtctgggttcactcccttggcttccttggaagtctgtcctctttttaattcggtttgccttttataaatcttgtcatttccctctattcataactattctcttttgatccaaccttgggcacctggctcctctttgcacccaagttctctaaactcagtctcatgcattgaattgcatttgtgcgtttactcctgtgaatatccatttccctgactaaagctattactgttggagaatcatggtcaaaggaatgtagagctggcggatggctcagcacacatacaacagaaggggaaactgaaggctctgatggagggagggcctggccaaagagggggtaggggtagaagtaaggggttagggaactccctacattgggagttttattctggcagctctcttaaactcattgagtcttcacaaccactctaagagaaaggaactaatctaggagggttaagtgacttatctagggcacatgactaagtagcagaggcagactacacaccctctaagccggctgcagagcccatgctctttccacagcctgattatgaggagcagctccaggactaatcccagctgtctaagttggtgttttgtggctccccactctgaatcccactgcaggaggcagaaagattgataatgtctgatccgaatgtgtgcacataactatatctggaccatccacaggcatgaacttctgggggttgcagacagcaattggagctctgagatcttcctgaccagggagtaacagaaaaccagcagctccccagcttgttcattaatgcctgagagagcccctgcctttcttgcctgcaggcaaggcacaggacactacagagaggctggcagcccctcccctcccagaccttcctttcaaactgatgcaaaggctgaagaagaaatgacagaaatgtttgcaaacagaataccttctctagctagttgagacgtggcagatctagtaaatctgataacataatgtggcttctagggcactggtttaatgttcctcctcagaacctggagcacagtgaataggaatatagagaatttggatttgggtggaaagagactagctggaaagcaggttggaagagaagatgtgctgggtgtggtgccagatgctcttcatctgagcctatcatgcatgttcaagggtgggagggtggggatgtggctttccgagtcctggaagaggcagagaaacagtttgttctcatggtttttgtgggcccattctcagtaggtgctggctgactaacagttgcctggatgagatgatttaggtggtccaggtggccacctcgatgatctaggtgggcaagtataagtttgagaatctatcttgaaaaaagttccagttgattctacatttgggaaacgtagaatctaaaaggtgtttacaaagattaggttactacctactttgtagaggttgacacctccctgatttctgagttggctggaatgtgtaggggtagggagagtggaagataagagcttgttaaggggtttagggtcaagggctttcagaaagtggccctgacagactcacatccgtgtgcaggcaactgcagataacattacagcactactgttggtgaactttgggaaaagcacaaacaaatggggtatgtgcccaaagactttagattggcaaacaccctagttttcacatagggtaagagggcagagcacagagattacagaacaggagtctgaacttgatccctgccaaacacttggagagatgattaagcagatgagttctgggcattcacatttgaattcagtgatcactgggaacccccaaagtttcattaagaaaaaaaaatatgaggacctcgtctaatttaccagggttatacctttagtaaattcaagaggaattgcagatggagtgaatttttattttgaaaaaaatattttatggtctcctaagggaaagcatttttaagtggatactgagcttgtcttcctaccaaaagaaagtaggttagtgactctgtcagccaggaaggaagtccctggtgttattttagtccttgtcctattcaatctcttgtttgtttgattgttttttaaattcatgactcaggtgcaagcatagggaagcttatcgagtgtgtaggtaacatttggagagcataactaacaccacagaagatgaatcaaaattcagaactatccaacagctttgaatgctaatttgaaatctgcaagacaaaatgttagcaggataaatctggaatctcatgtttaggttaaaacaaaaataaagcagtgcaaataggagacctaacttgctgtttatttgtgtgaaaaaaatgagttagttgaccacattcttagtatcagtgatacatagctgacaaaaatccaagcaatgttattgatgcagtataatactgctaataaccaccagtattgcacacttactctgttaaacactttacataaattaactagtttcatccccctaacagccccatgaggtacattttgcatatgaagaaacaaagcctcagagagaacaagtaacctgttcagagtcttggaattagtgatttgcaaaacaaggtttaaaactcagatctgtctgactctgtggtctcgataagggttcagatcagaaaaggtgatatataaacagtgtcttgataagggttcagatcagaaaaggtgatatataaacagtgtcttctgtgtggtaagaacacatctagagtgatgttagttctgggatcccatttcgagaaggacattgtctgcaaagtagctgtccagaagagagcagcttgcttgtggagcagtggcaagttctgatctgctaccaaagagactcggaaatgccagtgttcagtgctgcagacacccaggcaggaacctggaagtcatcatccagcataatgccattatggcaaaagaaagatgttgttggcttcatgagattaaatggcaccatcaagtgcaatatcaaagtaggccagatttattcattgtaagtgcactgcttcctcactagagctgtccagcaaagagacagtctgccttgcagggaggtgtgagttctctgttcctattcaagcagagactagatagctgtcagtaaaggatgctagagagatttctgctttagacaggatattggacaaaattacacccagaagcatgtctagttccaagattccacacccagtttctggattctgggtggtgtctgtatttcagaactgcaagggacacagcatccagcccagaagaaatcacctcaggaaccaaagtgcaggtcaggtgtgtccctggaggagggagactggcaatttcggctccctcttctggagggtaaccagagcattagtcaatgaggagagtaaacgaagtcttattgggagaggaggaaagtctccttggtacaaaaggtggctgagtttacagcgggggcttattaaatgtcaaataaattttatgagctagattcacccatgtgtctgctgctggctgtaagccagagactcaagaaaccgtgttaactcttttggtcctgagatcatcagctcctgccctttgcttcccaacagctcctcagtgatccagaatcattgggccttgctgggaaggaccagcctgtccccgtcattgatacccacaaagcagagagatgttaagctttttttctgaaatagtttctttttttttttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttggtagagacggggtttcaccgttttagccgggatggtctcgatctcctgacctcgtgatccgcccgcctcggcctcccaaagtgctgggattacaggcgtgagccaccgcgcccggcctgaaatagtttctttaagaggaagcagctatggtctactttccttctttgggagacagatgttcagtaataactggtttttggggcagatcccaaaaatgtggtaaaacccccaaacacaaagtgtcaggaaggtcctcctcccacccactgcttttccagcctgcattgtcctccctgaggttcctgtcctgggttcttcctcaagcactggctgggcacccatgacccctgctctcatggaaaaagacaaccacccagtgtcctggtcttagccctcagaggtcggtggggcagactatttctagtgcccgtcagccttcgctagttggtttactccaagaaactgcccagtcttcagccttcctgctaccacccgtgtgcctcccaaacccacaactccagctccactcttctgactctgtcttcagtccgagttttctgaccagcttctaagcacctgcatatttcatttgtacatccaacgtctaaaaccacatgtgccagcacctcttacaataggatttctttccaaaagcccttcacctggttaatagtgccatgtgattctagaggtcttggcattgacttggattcatcttgtccctccctaattccccacatctgactgctcatcaactgcaaccacatcttcctttgaaatttgtcttgtctcttctgctgttcttgttgcagtactccggttgaaaactgttatcttacacctgaattagtattacataacaacctcatagctatttttccaacctccagccccttccccacagcactgcatgcaaatgctgcagcttgccagcaagatgagccccccgatgccccactttcagtacatctgtcccctgctgatggaaccattgtcagctctgtgtgtctcatgacatcaatcctaatgcctctgtttggtaaccaaggccttcccatgcttctgactatcactgattccctccacattcaagctggtatcactctccccactcatgcactgccaggcctcagttagctgtggctcacgacactccaggctcctctttttccagtgcaatacgatgtgcacttgtcctttcaggctcaagctgagttctgatgttttcaggattctgaccctgaagactggcacccatagcctctgccttttctggtctctgcagcacttgcaacccatttccagatgtgggctcctgatccaagactatccagcactgttctccagttatttcatatcttaattgcctaaagaaacttgtgaactttgttttgccgatagtttccacagttcttagcacagtgctggtttggagtcctgattagtgttgaggaaaagggttgatcaacatactgaggcagaagattggatgaagtccctgtatgtaaagatctccaaacacataaaaccccttgtgcttaaatatctggaccaattttaggggagtcacaaaaatgacatcgtctgccttgaatccagaatgaagaacaaaaagccacactttctcattggtctgttcaaacctgctgggacacaaaaatattaatgactaaatacagcctaatgcactacctctgaaaccatactgtggaattctaggcatcctccaccagctgggaagtgccaggtttgtactggcacccctggagccatgtgggtattcgtgatctccactaagatgtccacggtattgattttgtacttcctgaatgcacaggaggcctggatagaagcattcactcctctccctccagctttcaatccccaaatatcacctactgtttaaaatgaccctttccagccctcttctgctcttccctgagaccctggctcttataaagggtctccccgacttttcagatacactctacatgtctacaacatccccagagacatgtcccagccttttcacttttgagagcatcctgatctactgatggaaggtctctgacaatgctcagaagtttcttctgcttcaagaactactccattccatgcaacaaggttctggacagtggctaaatcatttctccccaaacctaatatatttaaaggcttggttcatgtttaagattttataattctcctgagactatggtcctttaaggctgtagttaatctcaactatagcataagtgaactttgaggtcaaagaacacacatgactgcaaagtagatctttaatcaaaattaataaattaatagaacataaaattaaagatttttctctcttttgaggtactaataaacagcagtttaaatccatacataacatttttgtgccaaaggtatgtaacctatgatgacaataattggaaactataaaatataaatatgttaacaatatttatattaggaataatgataatataaagcattgtacggattactataaaatgctttacattataggtatatattacatctgatattattattactgccactaataatatttccccaacactcacaaatctgagaacgttttctgagccctgtctccaaatgtttggctgtgcctgactctgtagctgacttgaattccttgttcactgtctgatgattcattgcactaaacaccattttcctgataattaaaaactgctcactggcaagtgggagcaggaacatgctgatgtaggatttatgcagaaacacaaaatgagccaaaagacaaatgacctgttctgcctagctaaaggcttttttttcccctcatcatcttctaagatttggaaaggctagctatactgcaggagggaggtctaggaagatgcgtcattctgagatgaggcggatacaggggagcccttacgtgcttggttgagagtgctcaaccaagtcactctcccgatttagaacacagactgccgccccacacagaggagcaacaccaaggccaccttcccagcccaccctatcagaccttaggggaaagtcattgagtttgagccatttgttagaccaatgattcactttttcagtttcccttcttcaatgtgacaatgctttcctcaatttcaggggaaacgagtactgagtctaattgttgcatagatgcagccattaagatgttctaaattgacgttgcatcactactccaggcagccttcttggcttctggggaaaggtctcagtgacaccaatgcccatggccccagaacagcagctgtgacatcacatatatgtgtgcacacacacacacatacttcttaattctacaagctagcaaagcagcacacctctcttcgtcagtaaagtgcacccatcttcacagtgcagactttgttccgtttatgtgcacttatttgcgcattactggcccaaaagaatcctggcaccattaagagataagccctttcccttctgggaatagctccttccttgaactgattggggccaatatctgtaaaactcattaactcagaatcctttcccattcatccttatgtatgtctttacttgcaaaccattcattaccgcatattctagattgtttaattaatttccatggaagagttcctgtaggacagcttagcatacatcgttcaaaagcctttgatctaaaataacaaggtagttattttcgaagtaactaatataaccctaagcggcttacaacccccactgcccaccctccgcttgcttcctcttcctacctccccaaacacttcctagaacaatttactgatgatataacaagtctatcagtcagtgagtcatcactgtacatcaggcactgtgctaggtatgtcgtcagcaatatgttctttaatctcacagccactttgggagggagatgttaccgccctcataggcagaggagaaaaccatgctaagaggtgtgtgccgacttgtcacattacacggggctagtaaaaggtttgggggccctgacctcacctgtgggtcccagcatctgggctgtttacgtcctctcaccacagcacagaatttgggagaagtcatagcttgttaacgctgacctgctgtcccttttgcattctgagtgcatctgttgctgccagtcgcacatcagctgacttccacctgtggcatcagtgtttctttgcctgactgctttccctggccctggagcctcccctgcccacccgtacaacaggccaagcagcccctgaccaattgtgtggaaatatcacagctcccttgaccccagagtgggacaactctgaagcatgtgctaacctagacattgcttagatgtgaatctcaggggaattaggcctgctcaatgacccacagtggtcagtggcttgagaatgcgcctcttataggctgccttcctttccctatcttacttcccttctcatctcaggtacttcttgggatcaccacccagataagccacttactttcaaaaatcttgcctctagggctgcttctgggggaacccaaggtaagacagggtggcctggagatgctgacctgggttctctatatgcttccaatctggtttgactgttcttactcttcacttgttctttataacaagtcaaaaaggactggcacccccatctccatttttctctttgtccactgttattaaagcagaagtctcttcctacacacgcacatccctgatatccatcctggggactagaatattctacataaaggtgaggatctctcaatttcctttgtccaaatttcagtctatatattctcaagtcagtgtcctcccaaagctttcaaggagacttctagaatggtgtgaacaaccctaaaacaagtgactgggaataactcatctttcagaaaaaaactgttctgggcagggcacctggccctccttatcttaaaaaataatcccctcaggccaggcgtggtgactcacacctgtaatcccagcactttgggaggccggggagggggggtggatcatgaggtcgggagttcaagaccagcctggccaagatggtggaaccccatttgtactggaaatacaaaaattagctaggcgtggtggtgcatgcctataatcccagctactcaggaggctgcggcagaagaatcgcttgaacccaggaggtgaaggttgcagtgagccgagatcacaccacaccactgcactccagcctgggcaacagagcaagactgtctcaaaaaaaaaaaaaaaaaaaaattctcctcaatggtttgctgtatcttctgtcttcctttggattacactctagtctaatttccagtccttgcctgaattggtgaccaagcaacaccagtttaggagagctatagagccatcagaagttttttggatggaaaatgtcaaaactagagctgggggtcaccagggaacaagctgtagtggcaaggggtggggaacatgaagaggggggaggtgctaaaatggagctcatgaaacctgaggcctaacctcagccttgggccctagtcactgcacctggagcagtgtggcttttttaggcctgccttcccctgctgacctgactgtttcttgaatgagacagcagtacctggcagagaaagcccctactcttcccaaggctgtgatatcagaccttgtcatttgaccttcgaagccccagcctttccaccacccaccaccatgtaaacaattcctgtactttgcttaatgacgtatcaaacatgttgaaaaattacattgtgaatgaatgcattggtttcttgggttccatttcctttttttttgttccctctcctctactttttgaatgtattttttctgcagtgacaattctctactttgtccccatgcacacctatttatcttgccaccgtatatatcagtgacaaggtctatattcctttatgtatttctcattcaccattttatttgtttttcatacttcagtgtgtccgaaggcatgaagagtcaatcaccatttttctttcataccacctcattttttctatgtagactttgctcttttctctattagtattttctaagcttttctcttcacattttctcttctggtgtaccgtcttggcacttccatctccagatttttctaacagcaatttctctctttgtaaaaaaatccatcctcttccctcttacagccctgcaccacagccgtcagttataaccttaacagtggcctccactcaggaaagttgtcaagttgataaatattgatatctaccctaccattttaccaccacttttctgctaatgcatttggttggcatcagtcagcttccttgccttctgtgagcacccggtgtgggaactggtcccgatctgtcacttataagtaatctgttccacatttcaccaagagctcaaaaaaagaagaaaatatggaggagaagtagaggacagagaatcagtctagaatgacccagaaggaagggagatgaggaggcccagcaagaggaggagaggcagagaaaagttgcagcctggtgtgtaggagagctcctcccaggaatgcccttagtgctggggacatcagcagtgctgaatgacaaccatgtcctctttgggatgttaaccctgcttatctcctccaacaaggctccccagggatgaagatctacattgaccccttcacttacgaggatcccaacgaagctgtccgggagtttgccaaggagattgatgtatcttttgtgaaaattgaagaggtcatcggagcaggtatggctcttccctgtcttgtttctgttctcctggtgtccaaacatcttctttccaccaccctagatggtctctttcagtatgaaaagccccattaggaggagagcttctatcttctttctcctcagaagatgagtctgaactatctacatgtgtatctaggacagagagaaaacatcacttgggatctttggggaccttgaccatggtggccaagcttgtctgttgttgcagaaaagtcagctgcagttttatagattcagaaataactctggaaatggaccaccaaatgcagataaggtacttagttgagaaggctttgaaagaaatctacatttgtagtattccacttactaacaatgatatctcaatgggttaaagtcaagatatcttgccatactgtaagttctccatttcctatgtacatgaatttgaagacagaccatgatgaatagaagagagaccactgtttccagaagaaagtcaacctatcaccttcttttttttgtttgttttctttgtttgtttgttttacaaaaaatctatggtacagctggtaacaacacaagacgaatttcactctcaagaaatgtgtgtgccctcatccatcttcctgcactggaatagaaacccagcccagtgtaaaactcactgcctgagatgctctcaggaaatcatacctaagactgatctagaattttcatcttcctttaatgggttagtagctgagtcaatttggcaatggacctagacttattaatgtaaatgagataaaacatctcaaaaatcactaaaagaaatctcattcctgcgtcttatgaacctttttaaaagatgtgttaaatttgttttattttcttctgcaacattcttcgtcttttcttcctcttcaattcttgttagccattgtccaagctctcttcactaatatgctgtcatcttttttaggttcctagatctagaagtgctttattcatatcattattgggaaagccatggaattgcctctctcaataatattttaactcaataaaatatgtttagtcaaagtcttacagctacttcatatattatctttagggggaatgtcaccatctttctgttcactgctctcttaatgcactcaggggtcaaaaagccatctgtgaaattggaagtcacatttgagagtctgtcccattaggccgccatcttcctgctctggtttccctcttgaatagcttcgtcctcacacttctttcagcataagtgtggtgggtgctgggaaatgacacaccacctgctcccgccaacccctcaggagtttcagctgggtcaccagactcagatccacttgagtttatgcatatttcccattgacttttacattaagaatgttgctgaaccacgactttcacttctgtgcagataattttctcttcccctttagatgctgacatatttaaggatcatgccttggaaggctgggtaccagataaattggataactcttaagggctcagatttctccagtaaacatcaaagagtgttggggaggcgggctttcagtcctgtactctgtttgctcgtgttattaattgttgttatggcttgtggtaatggtgctagtgactttaatgttgttatttatgtcatgtgcttagagcgatgtgttctggactgtatttcatcccagagagcacacatcagccccacccccacctgcttttgtcagaggaggagtaaagagctttctcactttatgaccctactggatagttacaatttggggtgagttcaccagctgctggatgcctgtaaaaggacaattgatagttctgccccatccttcacctccatttgtgtgtagcatttgccagtgctgccatgttgtgcattctgctcagagaaggttcagtcttctccatgactcatgtgatattggggagaaatgatgcatttagtagtttctatgatgcccagtagcatgacataaagacctctgcccagttactctgcccagttaccattctgtagcagagacccatctccttgtaattcagaatatcccagagcgaatccttgtggatgttaacttactatgcataacttcatgcaattttaacagaagacactcctgcagagaaccaatttttctccaggtccttttctcctctaccatcactctcatttccctcataccctgccccactgaggctgactcttcagtgctaaaagagctggtgtgaaggtcaaattgttttaaaagtaaggaatttgttaaggtaagatttatgccatgtaactggcaatgtttctcttagccacttgaaatacttgaagcagggggaaaacttgggttgcaacatggcaacaaaacatgaaaagaagagtcggaagtcctttattcttcctttatttttttctctctccctccctacttcctctctccctcctcttcttccctcaggcttttactgaatacttcttatatgctggatgtggagttccagaggcgaataaacagactcagaggtctgacagatttagtgggaaaaactcaggccagtaacagttaattattccacaccatccacacaggcatgtattatgcaaagagcagcatccagcttgctgttcttggaggggctgagcatatcaggaaggctctgcaaagaatgacctttggcctgagccttcaaggataaacactagtagaaaaagtaagtttttatgaggcgtatgagagaatgagatagtgacagaagaggaaaactaaatgatttaagaaggataatgaacatgaccttccagcagtggacatgctatgctggacagcctgcagtagcttgcaagagccaattatgcacatctgtttctagccccatgtttagtgacaccatgttggtagcttgacatcagccatagtagaagtatttacatcatgggaatgggcaaatgctacaaatcctgagcctgccctctgtttgttctttcgtttcttttctcttttcttttcttttgctttcttttcttttcttttcttttcttttcttttcttttcttttctttcttttctttctttctttctttctttctttctttctttctttctttctttctttctctttctctctctctcttcctttctttcttcttgacatcaatcatagtgggagtatttacactatgggaactggaaaatgctacaaatcatgagccccttctttccttcctcccttccttcctccctccctcccttcctccctccctcccttcctccctccctccctttcttccttccttccttccttccttccttccttccttccttccttccttcctggagagctggtagttgaacacttataagcacacccccaccctccagactatgtaaagttatttcaaagaggttgcagaagaactaccctgcaccagctaaatatagagccagaggagaaggctatgtttgttgcaggagggattaagtttagagttcagaaagatctttattcattaaacattgtttctgtgcatgtgactgggggtgatgctggaaaaatatactcaatgcctaacaagtcctgccatgcaggggttattgtctaaagcacacacattcaatgccactcagtgagaggaaggcagtgattgagagctcagatgagggcccggagaatgtgtagccctggagatgggagagaaggcttgatggcaggagaggactcagggaagagggaacaaagtggcctctgaggttgtgaaggctttggatggactgacattgtgtgtcacatcctgagaacaaggggaaagaaagttgctggagagggattgcctgtgggtaagtactgaacactaaatctggagaatcaggccaagatctagagatccagaggctgctatatgaattttatcccatagaaaataggtttcatagcagggtgggtgaaaggaccaaggttctagcaagctgaatcctataaatgctgtgcttggattggactggaagagggggatgggaaacaatcgctaaaaccttggaggtgggaagacaagttatgaggttttgtttagatgttacagagaggctttgagatggttgatgctaggatcaaggctgcatttaagtgactaagcttatccaaactggggtatacccaaatgaatgtgatgaatggagtgactagtgagcttggtgcctggaggtgatggggagtcatagcatggaggctgtgatcagaaatgaggggcatcaggttaagggagagtaaggctgcctggcacccaggttgtggggagtggcagttgtgcatgtgagtgaagacccacggagggaaagttcagaaattgtgaggctgaaaagttgcatcagctgccaaagtttctcctaaagttgttgcaaatgttgatcaaagaaataaaaatataataattgtgagccaggtgtgatgccacccaagaagacaataataaatcattaattattaagtaattatttgtttaatgttcgtctttcctcacaaggctcaaagttctatgggagcaagggaatgtatgtgttttgttggtctggtacctggcctagtgcatggcacttaaatgctcaattaaatatttgttgtatatggcgaatgaaagtaggtccttggagggagaacatggcagttaaaaatctggagaactaggtagtgtttgggagaatgaagagagactggacaggtggcatgagatcatgagtcatttgatgctctgaaagtggcccagtagagtgaaggaaagctgactcttcctcttctcactgcagataatgagagtaattgaagtatcttcacagagggcagcaggttaccttggtatcttcagagagtaccagtttattgttaccatgagtctgactaataggcatcatgtcataggtcaactccaatgcattggttaattctggtcagtttgatcagtagacttgcccagaacatgaatcagggctctacagcttgaatggcactcctgggtgcagtgtgaaacctgtataactgtatgcaacagcctaagcatgactgtcagtgtatgactacataggtaaaggtgtcactagaagttgttggcagaagaagacatgccatttgtattttcatgaataaatatgtctcctctgactctagcagctagtgattcaacatttccaggaatggatgatcatctggaagaaggaagcttgcagtgaaagggctgtgtgagaatagttgggatgagggaatgtgtgatatgtgtggatggggatggagtcatctgtgaggccaacaaaggcccgggtttccttggggatgatttggcagaaaggtcacttgcaagtttgacagtcctggggtcattcagagtgcagatggacagcatgagggtagctccacattgaatagaagttacggcaagaagcatttctaggagaagaaatcatagacatgtctccaggaacatagtcaaagtagctagcatctcttgaacactcaccgtgtgtctgacaatactctacatctttcacaagcatcgtcttatttaagtctcttattgctctgtgagttagagcatatatatctgtatgcatgtatattttcttgtaactggtaaggaaatcaacattcagaggatagcttgccgaaggctgtgctgccagttaagtttatgatagagctagaatttaaacccagctagagctgatccagatctggagaatgtaaccctcacatgaatgtaaccctagggctgttgcgtatagttacagagtggccagctgccactcttgttgctatggaaaagagcagctcagtatacagaggcattgcttccgatggcattttggaatacccattgcttctctctagcagttttgaatactcaagcctcgttgttgggaattatgataccatcctagaattcattattactctattgtgatgctacaaagactgtcccacatgccctggagagagcatggtcctcatagaataccctggtcctgtcttctggttttcttcttctaagtgtgatcagttatcagcgttaagaaggacaacaaggactgagatatttagcatctttaattataagtgcttgcttatgaaaataagctaattacatataaaatgtagatgtatgtatgtgtgtgaagatatatacactcatatgtgatatataggtatgcagttgtttaacaactataaaaagctacaagaaaagagaaaaccattttccctcactctctggatattaggtattgtgaataccgtggctgtcaagcaggttccatctcatgtgccaactcagtggcctggtaatgagtatctgaggaactctgatgaaagggtgaagatggttgtgatcaactaataatgtctatcctctgtgcagggtcaggaagtggtggagtgtgtaccatggttctgctctccctggtttagccgtaactcatttatcttgcacaagctagtgtgttaaaacttgcttgaaatcatgctttaaaacctagtttaaatgtattctttaaaaattccatttctggtgtaagcttgaattagtaactagaagctctgctttcctttttttccccccaaggcagtttttgacttcaaaatgctgcttttttaaaaaaagtgcaattgtgtgtagatttgagctgtgcataaccagaagctactgcttgaaatacctgctggcaggtgaatgtttcgttttcaaaaattgagaattcttttcttctgattttacatacaatagttgaggcatttaatgctgctgaagcactttttctctcttcctcattttgtcaaggaaggtaggaaagaggaattggcaaggagctgaaacttgcagggaataatttcagcagctatctgggatgaaatgcataggaattggttaaattaccctcagctgacagccttgagggccaggttctcaaatagatgaagcaggcattagaatcacctggaggctgctaaaacccaggtcacaggccccacctactgagcttctgatgctgtgggtctaggtgggttttgggaaagtgcattttctaacaagttcctaggtgatactgatgctactggtcaagaaccacagttcgagaaccactgctgagcacattggccactagactgacctacacctggatctgggtcctaaccaaatagatgtctggctataggagaggacccaatgtcagacacaaagatgtgtgccaatcaaagtccagtgggaccaaaattaggctggccacatttactgtcagtaaagaatctgtgtgaaaagaatcaaccacaaccactccccagcacagtcgtttcctttaagcgtctgtcttaaatataacgttaattcttgaattgctggaaatattttctaggtattatgaatttttattaaaaatgaaaacgttatggccatgatttggagctcaagtaaaacgaagctctttagagttcagatgatggcgaatcgaagtaccacagacatcaagtcctggccctaattacaggaaaattatcaaaatgcaaaaatagtttcttgtagatactatattaaactgaagtcaaagatcacaggcgacagcaatttcttagattgtaagtgacacagggtcttgatttcctgtttgttattaataatagcaatacgcccatcgactcctgcctctctataaggctgtaggttgtggtgtgctcaagggccagaaacccagactttagcatcctaggcttacctgaagacaccctccatgctcaggcacctggcagggaaacttcaccatgtcccctggcaaaaagctctgatgtgtcttagatcagtcaccataagtctcaaaaggctgcagaaacctacttttcctctcttttctcttccagtgagactcccctactctgcactccccctcccaactacctacttctgttttgtctttttaaaacaggcctggcatggtggctcatgcctgtaatctcagcactttgggattctgaggcaggcagatcacctgaggtcaggagttcgagaccagcctggccaacatggagaaaccctgtctctactaaaaataaaaaaattagataaaagtggtggcacaagcctgtaatcccagctacttgggaggctgaggcaggagaatctcttgaacgtgggaagtggaggtagcagtgaaccgagatcacatcactgtactacagcctgggcaacagagcgagactgtctaaaaaaataaataaataaaggccaggagtgatggttcacacctgtaatcccagcattttgggagcccaaggtgggcagatcacgaggtcaggagttcaagaccagcctggccaacataatgaaccactgtctctactaaaaatacaaaaattagccgggcgttgtggtgggcgccagtaatcccagctacttgggaggctgaggcaggagaattgcttgaacccgaaaggccgagattgcagtgagtcgagatcacgccactgcaatccagcctgggcgacatagcaagactctgtctcaaaaaaaaatagaataataaataaataaccacccacaagtgtttcgaacagtttgtagtttacaaagcactttctcctagacttctctcaacacactgttggtaaggcaagacaattggtcacttctttttattatataacaaggagaaagctaagttctggagaaatgaagggcccgccaacatccaatgtctcaggtgttgtttgcgtgtagacatggagcttcttcctccactcactaccaattttcctcccaactgtactcaggggcctacttaattacaggggcgaacataatctcctggtgaggattagatattaagtggcattctttgcagttggtgctttgaaaacctcctggcttggagaatatgaagacacttctttgccagacaggaaaggaattcttttacagaatttccattctttaagtcactgcagagcagatttctgagagcagtgacaccatgaccacgaaggtaaccaaccacaaagtccaccatgccctacccaaagaaggcatgtttatattttataatttttaaaaactgtatgatgagtttttagacttgaagaccagtcacaaagattaaaaattaaataacgtttcccaattaggaaagtagtttgattcatactgtcctatacatcttcattgatttcttccttccttcttttcttctttctctcctctcacatctataaagtccatactatgtgccaggacctgtgctgtatgaggcaggctatatgtgtgctttgctttcaaaagtattcagaagtacagagagaaatttcaggaatgccatggcttttggcagttcactaattcatttgaaaagagcttggatggtttaagcctatggttttcagcctgagcggcatgtcagtatcaccgggcagccaggcctggcttcatggacctgtgactggtgcattttcacagggccggatgttcagaaggacatgcacttggtttaatgctctgctgttacagtattgaaattctcaatagtttttgaacaaggagtcctgcacttttactttgcaccgtgctctgcaaattatgtaaccaatcctttgggcagcttttaaatatgtcaatgtgcaggctgtatccaaaccaattcatcagaatctctgaagtgaggcccaggcctctggactctgtaagtctcttcaggtgattccattgggcagccaactttgagaaccactgaggtagaacagaagttctcaactggagtctttttgtgtgttgtgggggacatcaaattcacctggagcacttttccaaactccacacactgataggtagaaactgataaatacactgatttccaaatattctgatgccacccaactcccaggcaggaggcttatgtgaaagacatctgcctgttaaacagtatcacttcttttgttctcacatggatattgagttgctatgacagtcactatatatgacttgttgggacctgcacatttggggcatgatggtccctgaactataacttcatatctatgtagctttattccccatgtccctgccaactgaaacatagctatctagaggcagtatggcaggaaaagatgggtatggaccacagccctggctgtaactcccagctgtgtgattgggacatgttttccttgtgcctcagtttccttattatttaaatggccatagtaatacctacctcacaggagtgttgtgaagattgaataagtcacacaaagtgcctagcacagttcctggcacatagtaggtggttaataaatacacatttgtgtgctgtctcctccacaaagaaatattaacacacctttaccctcaactatcaactctggcttttttctaaaagaaaatagagcccattattatgacaacaaggaagaaatactaaccaatattcttccattagtatacttaccaaatatgtaatttgtgttcattcagctcatagttatatatatatagcatatatatgctacgtatctacatgcatacatatatgctacatatatacatgcatacatatatctagacatatatacatacatccacatatacacacacatatgtgacaggtctgtattgtctagtacttttctttaaattttactcattttaattactaaataagttaagctattgtagtgtttgtctatagaagatgatgctgcagtaaatatatttttaacatacaaattcaaatagtagtacttctatttctggataaagcagagataagaatcttcagcagtttgtaacccaagagtgagcaaggcaaaagccaaacatataataataaatatgatacaacaacttttactggcatgtctgctatgtgccaagcaccacagtggagtggatgtgcaagctacaaacaggaatgagacttggtctgacctccagcagttcaccaaaagagtatatgattcaatgtgaaaagcagtgttgcagccaggtgcagtggtgcacacctgtggtcccatctactcaggaggctgaggcaagatgatcgcttagcccaggagctcgagtatagcatgagcaacatagtgagaccctgtctcaaaaaacaaaacaaaaaaaaaggagtggaagggaggaaggaaggaagggagggagggacagagggagaaaaagggaggaaggatggaaggaaggaaaaagaacagcccccccaaaacacatagtgttgtaaatgatatttatctgagtattaggtccatgttgaaatcttcctaatggtgcttaaccagcctctactccagccccaggttctatcaagttctgttgactctggagaagttttgcataacagtcctttcacacagcttccttccaatcttttttgcagcaagaaaacaaaaggaactcccaaatgaatcacaggagcaatgttaacttgtctttctaatatggcaagtaatttatctgattgctcagtttgctccatcattttcttccagaagtggaaagtgagagagaaagttttctcagcagaaagccatgtttcttctgctgcacttacaagtagacactgaactgcttcacatgaaagaattggaagtaaccaagccaaattaaattataaaataacttttgaaagcatgttaaacaggattcaacagatttttttttttttttaggcagctatgaaataatgtcaccataattgtttctactcttggtgactttactgtgaaaatgtttcaacgctgtggcatgcatggaggtgtgcagctcatgcctgtttggagaaataacttgctattcagctgccaaaagtgcagttagctgacagcctccagctgcagcaccttcagggtcggccccggctttcctgcagaggcccagctcttcccagcagcccccagccaatgactgagcatggcagggatgtgagggctgggctgcttttgcaatgggaactctgctctggctctccctttgggttagctgggatttcatcaggtctgcatggtgatcttgggctgtctccgcccaatcctgcttcctctcacttttgtctttcacaagtgaacctcttcccttcctaactcctcagtgtctgttttctggggcacccaataaacacaaatgctctcccagcagtgtaggaacataaacagtatacatctcattcagagggccaaagtacctgaacatgtctcctatcccctgaatgttcttgcaccagtatctgctaaaaatgaatcatgatcctgccaaagtgaaactgaccatttcatttcaattattcagctggcacacaatggaaaaattaagtgtggggaaaaacaaactcacatatattctgaaattccacttaaaacaaactcacatatattctgaaattccactttagttacccaaactatttctaagtaccaaggtaaggaatgtactttagtaatccttttgtgtttgccatgaactggttacagccaaaacaatatagttacaatgagagaagactgttttaatttccgccactttaatcacaattccacttggggcaccattgttctccattagatgacttccctcttgagtccacagactgagaaggaagaggatattaatggcatttttgctgttgcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcagggtaagagcaactcaggggtttgatgatgcacttggatgcaggtgaatgatggctggggagaggggttccatgagcacaacctaccaatcaggaatcgcctgatccagtgtgaatgggcattggagatgttagcagagatttgttgctaaaagaagagaacaaaacagggcttgtgggatcctcaggaggaggatggcatggagtagggcgttgacaaatgcttattggatgaataaaatgaatagagagggacaaagaatggccattggcatctgcatgaatcacagagattgaagagacttttggctgctgcacagccctgtgtgattcatgcagacatccgcggccatatctgcctttcatcagcacagccaccctcccagactgctctctgcatttacaggttcagaagtaaaacaggttgccattttctgatgcctgggccacctgccctctgaggaggcacttctgagtagggaaggggaagactgcatcacaagcatccacgggtatttctgtgattggcgaagattcccaaccaacttgcagcagaagtggggagttgctgaaggcctttggctgggagacctgtaaaagatcattgtcagaatatgcccaaagtagagccaggcccacaatgaaaccattttcatttctgtagggtatcactgagcacctagaggaagggtgaatgagaatggccatgatgctgatatctggggagtggaagctgatagcttcagccaggaagcagaagctgagagcagagggtccagtgggcagcatcaaagaatgggcagagccttctgagcaaggacttcagagtgatacccagtagctggctacacacattaccaaagcaaccaaacaatagctgtggctacagattaaagggtcagtcattgaaacattgctgggatcactgctctggccaggccctattctggatgctgtgcctatagagataaaggaaaccttgctctaatgctacgtaacaaatcatccccaagacctcagtggcttagcacaacaacaatttattttgctcatgaatctgcaatttgggccaggtttgggagggacacctctgatccatgtggagtcagttgcagtagctcaagggctgaggcttagaattgtctgaagcctctttcattcatatattaggtggtcagtgccatctttctaggtggcctgcttggacttccttagagcaagctgggtctcaagaaaaagcatcccaagagaggaatgaggaatctgtattacttttgtgacccagcctaggaaggcacatagtgtcacttccaacgtagtgacaggcccagatacaaggggagaaaacaggccccacattttgatgaagggacatcaactcaatgtcttcttaaacatgatagatgggagatcttgttgtgttcatcttagacagtataacctgccatcaatgtagtccctactcctgctagtacccaaagcttctagtaatcatttgcctatcttatactttttttccccataagttaagtacagatgtagtaagtgaagaagttcttaaatcttcctggagaatctagggaaggcttcaaagaggaggaagaatttatctgagattagagaatgaggaatttgccagacaagcgagaagcaggtaggtaggctgatggaacagcgaaacagtgtatatgaaggccgaagtaaatgtggacctatttggtaatttatcagctgctgcatggtagctccagcactcagaaacagagcttaggggctgtagtgtggaagggtagctgggggacttgtctagaagcacactactgaagctacctttgtacaacaggaacatgctttttgcccagtctgggtcactaggaagtagtggcttttgtttttctgagggtgcaggggtggagaacaactgatgtagattactgagcccatgtactttccctaggacagcctccttgagggtatggggttatgctttgtatttggaaactccaatacctaacacagtgcacacctggtaaatgctagttgactaaaagattatttctcaaacaaaaatgctagggagtggcacgagagctctagtcatcctgtgtgtacattatctctcactgtccttgctgccacacctgtcatgtcagtgcaatcattgtctatgctttcctggggacattcatttattatcagagatctcatgaagacagttgaataaacaaagttgaatgaagttgagttgaataaacaaagttgaataaacttgaataaaaggcaatgtgagaaggaaaagcattttctggaaccactgtcaagacccttttgggagtcatttatttcctaccagtcacctgattgtacttcagagagagtcactgcttgatttggggactgtgatcacactcccccgctggagtgtgcaggggaacagggagattcattctcatgagcctgcggaaaatcaaaaccccacactgctgctcttcctagggcctgttttctttttatttatttatttatttatttatttaagttttagggtacatgtgcacattgtgcaggttagatacatatgtatacatgtgccatgctggtgcactgcacccactaactcgtcatctagcattaggtatatctcccaatgctatccctcccccatctccccaccccaccacagtccccagagtgtgatattccccttcctgtgtccatgtgatctcattgttcaattcccacctatgagtgagaatatgcggtgtttggttttttgttctcccgatagtttactgagaatgatgatttccaatttcatccatgtccctacaaaggacatgaactcatcattttttatggctgcatagtattccgtggtgtatatgtgccacattttcttaatccagtctatcattgttggacatttgggttggttccaagtctttgctattgtgaatagtgccacaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcatccactttttgatggggttgtttgtttttttcttgtaaatttgtttgagttcattgtagattctggatattagccctttgtcagatgagtaggttgcgaaaattttctcccattttgtaggttgcctagggcctgttttcatttggggctcaggtcacggaggcatgttggacaccagcatttctcatgttgatgagctgagcttgcaggggaagaaaacctgggggcatgagaggagcacgggaaaacagaggagcaggcatggtaagaaaggagtggtgggagcaggcagtgccaggaggagagggggaaatgaagcgtttctgactcctcacactgcatggaggcaggtaatctataaatctaatttcagccttactaccgaaccctggagcatagcaacattaattgacatatctgctgcttgataaaatcgaaaaataggtcatcagttcagttctacagggtccatcttctgggaagtaggataattttaggatcactactcagagaagaaaggaaaaggattagtcttcaatttctggaactgtttcctcccctccaacttctcctttcccactggtcatagcgtctttggagagtggctacggttctagccctgaatcagcatctgagagataccattatgcttcaaccacacattcagtagatggttcattattatcaattttctaaaaattattgtgccatggattatatagcatacaaatccataattaaatttttccttcttgatactcaaattcaagggattcaacctggtggctcttccgtaatattagaaacaattcggctgggcgcggtggctcacgcctgtaatcccagctctcagggaggaaagaggctggaggatagcttgagcccaggagtttgagacctgcctgggccatatagcgagaccccgttctccagaaaaaggaaaaaaaaaaaaaagacaaaaaaaataataataagcgaaacaattcctgaagctgtgaccagtatcccatggtttagttaacatggttcttgacatgcgccataaggccttcttgcctaaagcttggctttgtggttgctgctggttctttcacagataatcataactggaagactcttgaaagtcgctgagtaatgtcaaacggggacatttctcatcagagaagctcattcatgggctgcagctagaagatagcaacccagaagtcaggaagagaacaccagattggaagtcctgagaccaaggttctgctttggcttctgctgtgagtcaccctgtggcctggagcaaacctgttaactcaattttccaatttataaactaaaggcattgagctagatgagcttgaaaggtccctttcagttagaaaaaatctatgattcattttgttcaaacaaatcaaataagagtttcatttcctgaagtggattcgtcaatgaaagttgaaatacctaaatccttcctgtctaatataagggccagcaagtggcttcggtgcatttgcagaaaagcaatttcagcagaaagcacttcatgaagggaggaaagtttaaatcacctcacctagacctgtatttcttctctgtactatgtttttactatgtgctcagcatggagccaggttctttcccaaagtcaccaagaaataagttagtttttttttttcttatcttgttcatctttgaatgctgctgttcatatctctggaagttctttttggagaattatgccaatcaactgagcatgtaacagttaaacatgccagaaaaatcttaatatgtttttatctttaaatttcaccaaggttacgaattcagcagacatgaccctacatatcttgatatgtggttctcttgaagattctaaagaaaatgtattgcccattgcagagtcagcatattccaatggcaaaagcacaggataggagttagaagacccagataagagtagcatcactaatccatcatggttcttctccctgcaaagcttatgcacagcctttttctccacacagcgtttgaggccaccattaccagttgatcggagatgggttgtcagtggagaagtgatttaccattctgaactttgattactgttataactcaaacccacaccgtgatttaaggctgatcacatacattttctggacctcctttatcttgtctgtgaaaacaatataatattgcctgtcttgcctactgcacaggactggttttaaggatctaaacatattctgtaagtattatgtgccattcaaaagtcaagtgatggatgctaccaacatttgtgactaattgagccaaagtttaggcctgcatcattaggtcccaaccatctcctacaattacaggtgcctatctgttacctgctgagctcagcatgtgctgagtagtgggctccccaaggacaatgatcccaggatgtttcacacacacacccaggaagccatgaaaacccagagttctggtcccaggtgtcctcagtctctctcaccacactcatctgaggtacaggggaactgacttgtgagccgttacttaggctctgctgatgttagcagggatcattgctaccgtcttaggatacacaaggcactgagctagggcctttcatatgtgttatctcatttagtctcaccagaaccctatgaagaacggacactatgttcttattttacagatgtggaaataactgctctggaggttaaataacttgcccaagcccacacaaccactaagctgcagagcctggatccaaatcaggtctgctggctccaaagcctggacctttcctcatttcttggtcttttttgaccccagaaactataaaatttataatctaaattttaaaacaaatcagataataaagaagttctaagaagacttaaatgacttaaagcaaaaatgtagacacattgctgcatgcactttcaacattactgttctcaaagttgtttaagccaccccagtgctctccccaaatgccatcttttttagggagacattctgtatgtgtagacactgttgcctatacttacagagaggaaataatagactgaattgaaaaaatacaatccatgtgacttgtggctgagatacacctctgtaatatatagaaattgcatgacaactttttgaagaagcaaatccccagagacctacttggagaaaatgcttcgtgctagcaacagcctgcctaacttcttgagaaggtgttgattgaagtgtattagtgagaaggaagatctgcatcactcactgcacatccagctcacagatgggcaacgtgctgaaaaccagtcagagtttccaaaaagtagctctaaactttctttttgagttgcttagaagaatctattatggagaaagcatacattcaatctcctgggcaggtttggaggtggttaaagttagagttagaaatagcctggaacttgaagtgtgtcaaacacaatatgtttgggggcccttctactggcagacatctttaggagggagaaagtcaatttgctctattccttcaattgatcaaggagcataacccccagaacatggatccaggcttgcaatcttgcatgaggaacagagtttccaacaattcatgcaatcattgttagactttttgattgttgttgttgttgctcctaagtagagtatttttataacaggtcttttatttttccttgcttatttttgcatagaaaatgcttttgcaggagcatatgcatgtgagtgcattgtgtaacatctcgcatacagtagatgctcaatgatgggagctcctctcattgtctatgctttctgcatttcacataaggactctgggatgcaggtggtggttgccttgcagagtgcctatgtttagcagtaaacatagactagaccccaggtgtcctgcttccatctctcctccagtcagagcattctaatgactaggctgtgctctacttatagaacataattctcagccctttggggagcatttggggctagattagatgggaaaatatgttcttggcagtatagcttagggtctactgatttaactggtgtgtgcaaagtcaagacccaggagccttggggagataggaggaagacactgttttattcactgaagagtctgttgtctaaccagagggagggcatccacccaagaaactctgagcccacaaatgataggagagaggacagcactgcaggttgccatgaagaggagcagcaacagctcccattcactaggagagttccctgtgccagacgctgtgcatgaggttcccctgacccactgtccctatgaggtaggtgtggttataccagtctaagggctgaaagccctgggattacccagagaaggtgctttacatgcttgattttggaaagaggaaaagatgtattcatcattcattcaacttgtgtttattgagattttctatctaccttaaagtttacagcactgataatactatggtgaccaaaaaggacagagttcttgtcctccaagagtataaaatcaagcagcagagacagacagacagaaagacacacacacacacgattaaaacttgtgatatgtgctaagaagactaagagtatgcactaaacatttgtcatgagaaagtgctaatcatattttgggggggagttaaagggatgtcctctctaagaaagtgacatttaagcggagaactgaagggcaagtagatgtcgattgttggagggaaaacagagggaatagcacatgttgagggccctaaggcaggaagagtttgtcttggaaaagaagaaagggtgccagtcactgtggctttagtacattagtgatgggtatggtggcctaaggtaaggcagtagctgatcccaggcggtctcatggactgtgctaaggagtttggagattttccttaatgcaatgggaggctattagatatttttaagccagggactgacatggcctgatttatgtcttaaaaagatggctctggctggagagaatggattggggggcgggcaaggaggctgttgtaggtgatggatgatggcgacttggttggactggcggcagtggagatggaaagaagtgaatgggtttgagatgtaatttggagacaaaattgacagggcttggcaaggagaagagaacaaaacattcaaggagaagaatgggggatgggagtgggaagagaggaggacacagtgagtggcttggcctggagcagacagaagctgacaagcagcagggccacaacatctctccctctgcttaaccattgaagcccgtcttgatcccaatgccctctatgtcttattacagcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttggtgagtccttcttggcattctcaagtagaagcatggcatgagttaaaggggactctacatggctgggaactgtgacagggcacactgggagggaatggaacctgaactgagctctccactgaaagaccaagatgccaggaggaccatccagctgggagaagccatagcagctggttgttcaagcaagaaagcaagcatttgggcttggactgtgaggaagggtcagtgtctattatgaagctatagtgttccttgggaagaggaaattttggaacagatgatttgagggaatccaagcaggtagacactggtaccagaggcatctgtcagcagagagcagaccccaggcatgcatgaggccttcagtctgcagctgggttgggaactgtgtcactaggtagactcttgatccccttctctcttctctctatattgcttccaaatagctctaagtaccgtcaacacgatgagtactcttaaacttgtatttcctgctcagcctccccctctacattctgagcagctctaattatctatatccaactgcctagttcacacaatttcatttagaactttaacaagccgaaaatagagcttgggatttactctccaatatcctctccctagtccctccatctcagtagttggcaccacttaactaaagaatgaaacctaggaatgatgtttgatttctttctgtgtccatttattttcaatccctcagcggcccccatagggtaccaaaaaatctatccctctttccatctctactgcccccaccctattccaaagcaccattccctttcacctggattgttacagtggcttcctaactggtgtccctttccttttgtctccttacatccatttcaacagcacccaaagtgactgatctacctactaacctgtctatctgtctatcctctttaaacctgcaaaagtaatgcataattattacaaaaatcaaaacaatgcagagaagtaaaaggaaacgccaattagaatggcaatcattaaaaagtcaggaaacaacagatgctggtgaggctgtggagaaataggaatgcttttacactgctgctgggagtgtaaattagttcaaccattgtggaagacagtgtggtgattcctcacatatctagaaccagaaataccatttgaccgagcaatcctttactgggtatatacccaaaggattaaaaatcattctactataaagacacatgcacatgtatgttttttgcagcactattctcaatagcaaagacttggaaccaacccaaatgcccatcaatgatagactggataaagaaaatggcacatatacaccatggaatactatgcagccatataaaagaatgagttcgtgtcctttgcagggacatgcatgaagctggaaaccatcattcttagaaaactaacacaggaacggaaaaccaaacactacatgttctcactcataagtgggagtcgaacaatgagaacacatggacacagggagacatcacacatggacacatgtgacacatgtgaacatcacacactggggtttgtcagcagatgaggagcaaggggagggagagcattaggacaaattcctaatgcattcagggcttaaaacctagatgatgggttaatgggtgcaacaaaccaccagggcacatgtatacctatgaaacaaacctgcatattctgtgtgtgtatcccagaacttaaagtaaaatttaaaaaaaagaataaaaaataaactaaaattcccctgaggcagggattggtaaactttttctcaaacggccatctagtaaatattctaggctttgccggctaagaggcaaaatgaaagataccatgtagataattatataaccatttagaatgtaactaaccccttaaaaagttataaatatcattcttagctcatgaactatcaaaaaagggaccagccaggtttagctttcagaccatagtttacctgcacctgccctgacgcattaattttcaacaattaggtgtgccttctttgacatttttctttttggtcaaaaatttgaaaatttttattctacaaaatttggatcatattatgcctattcctctgtgatctggggtgtcttttgggcatcattgccgccaagattacttttatgaaagttagcaaacattcacactctaccaggagtgtatggggccgggcttcagcatcctcaccaggcctggaggtgatccaccctcacaaagggttgctgcttcaacaatgaaaaatgatgcctcatttttaaatttcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttagccaggctggtctcgaactcctggcctcaagtgatttgcccgcctcggcctcccaaagtgttgggattataggcatgagccaccatgcccagcctctttcagtttaaaatgtataattgaattattgttgactatagttaccctgttttgctatcaaatactaggttttattctttttttttttttttttttttgggtatttaaaccataccccctaccaccaccccctaccaccacccttcccaacctctggtaaccatccttctactctctatctccatgagttcaattgttttaatttttagatcccacaaataagtgagaacatttaatgtttatctttctgtacctggcttatttcacttagcataatgaccttcaattgcatccgtgttgctgcaaatgacaggatctcattattttttatggctgaatagtactccattgtgtataagtaccatcattttgttttaatttacattttcaactgactgctagtgacattgatatcttttcacatggtgcagggatttgtgttttctattgtttgtacgtgtccttatctatttttctatcgggttgtttgttgatttctgagaaacttatagaaagtctttttatattacagacattactcctttgcctgccatgtgtgatacaatttatcttttcccccatctgttattcctttatactgtttatgataccctctggcttataaagtggttaacattcatgtaatagctatgtcttcttgggttacctggtttattttaaaagttatgttcactccaaggctataaaatatttcctggtttcctgggctattttattgggaagggggtttgttttatatttgaatatttagtacctgtgaaatgtatttatttttcccacattttattttgaaaaatttcaagcacacagagaacttgatagaatttggcagagaacagtcatatgcctaccacctagattctggaattaatatcttggtacatttgctttatcatgtaactatccgtctatccatccctctgcccatccatcacaccatctattgttttgatgtatttccaagtgatttgcagacatcattacatatcacccctagccattttagcatacatgtctctaacatgtatttgtttatggttcttttttaaggtaaagtgtgcatagagtaaaactcacaagtctcaagtgtacatttatagagtttttaaaaatgcgtgcaactgtgtaacccaaactttcatcaagatacagaacattgccatcaaaccaggaatccccctaacctcatccctccccattgcatcctcacccacatccatacccagaggcaaccactgttctaatttttttgaccatcaattggttttataacttcatataagtggaatcatacagcatgtgcttttttgcatctggttgctttcacttgcattatatttaagagaaccgttcatgttgtgtgtgaagcaggagtttgttccttttattgctgagtaatattccatggtttatttgtccattcacttgttgatagacaccaggaatattccggaattcatttttgactatgtattgggaagtatattctcacactgttttgttcaggtgaacaattatgccagcactacttattaaatatattattcattttttattgaatcatatgtcatccttgacatattaagttcattatatgaaactatgttttgattctcaattctgctcttttaatctatttattcttatgctcaaccgtgttgtcctgattataataatgttagcaaaagttttcctgtctgtattctgattatagtaattttattaaaagtcttactgtaggttgggcatggtggcctgtgcctgtaatcccagcactttgggaggccgaggtgggtggatcacctgaggtcacgagttcgagaccagcctgaccaacgtggtgacaccccgcctctactaaatccaaaaaattagctaggtttggtgactcatgcctgtaatcccagctacttgggaggctaaggcaggagaattgcttaaacctgggaggcagatgttgcagagagccaagattgcgccattgcactccagcctgggcaacaagaggggagccccatctcaaaaaaaaagtgtcttactgtctgggtaaagcaagttatccttcattatccttcttttaagaaaaaaaaaagcttccttgactgttctcaaatatcttttctttcaagtgcaatttaaaatcttcctgtccagtttcaaaacatgcacatatacatgtatactcacatgtggattttgactgaaattctactctgtctttaggaagattaacatttcaatgatcctaagtcacctaaataatgatgtcagccaaatatacaatttacatatacacgacattaaaagtttctttggtaaaagatttcccacgttatttttctgtacacattatttggattacttgctgtgataagtgtctttgtagatgatagagcttatatgtttctaggcctaagagttctcaggattctacacagtgatatggccacctgtctcactatattttactatcatttctccacactttgccttttattcaaaatagaaaaaattatttttgattattaagcaaatattttttctaaaaatacaaacaatttattcaagtgacaaatatttattgagtatctactatgtgtcaacattaggccacaagctggggggacataatcatgatcaaaaggagacattgttactgctctcagttaagtgaggactggggacattaatcaaacacatgcccaaatgagtgcataattaccagctgaaataagggccgctatgttttgcgagagcatgcataaaacaataaataacaaaattgcctaactgtgtctaggagggcttgcagaggaagagatggtgctacagcagagacttaaagaacagtcactgttttagtcagcctgggctcccatagcaagctaccacaccctggatggcttaaacagcggtcatttatttcttgtcatctgtaggcttgggagtccaagatcaaggtgctaactagggatggttggattcttattgagggctctattcctggttatgtcctcagatgccttttgttggcatgtgcacagaaagagagatcttgcctcttcctcttttgaaagcacatcaatcccatcttggggactccaccttcatgacataaactaactgcagtcacctcccagaggctccaccttcaaatatcacccaattggggattattaggacttaaacatatgaatttgggggacacataaacattcaatctacagcattctgccccaactaaatgtggcaggtcggacttcagaggcagagaggcagcatatacaaaggccctgtggcaagagggaagatggagtggaactgagaagggacccctgtttagggcatttggagatttagggaggaagcatccaaggaggcctgtagcagtccatcatgtaggatcttccccaaacgctgtgataggagttgcagccttagagcaatgggaaacctttcatgacgtgtgtgtgtgtgtgtgtgtgtgtgtgtgtgtgtgtgtgtgtgtgtgtgttgtgcacacagagagatgcacacgtgtggcccgaaagtgatggatttgaattttagaaaaatagcctggcttttccttagccttttccttccaatatctttccttgccttctttagaaataactttcttggatttcttcctgttttctttcaccaaaaagccattaagcagactcaaccagggtagatgttctaaacaagggaggcaagccctagcagagatcaggacccatgtgtgaatgggctgctggctcagcaagattgagagacaagctatatacagggagatttaaaaataaatttgaaataatggaaactgtgggaacagaggtataaatatggaaagcataaaagctagaatgaattgtatgctgtggaatcaaaattggaggtattagtgtgaaccggtggttttaaatatatagaaatggagaaataaatataggctgagagtggctttgaagcagtaacatctacatagcaaggagtacagctggctctcagatcttggattccatatactcccctaaaagcaaccaggactcattagagacatggccccttccaaggcctggagagggaaaatgtgagatgagaccaacacatcttttttttgtgccagaaaatgagaaagtactcaaagaataatgggaacatacaacaaaaacaacatccagcttgaagggcctccaaatctggataatttgagcctcacaatatataataatagtaacaagttataatctactgaataagatgggggctattgagtccacactaatatgcatataaatgaacaaatagaaacaagagaaagctcttccctgtagaggaaagaatgatgatgttagaaactcactatttggcaaccatcagattaatagctaattcagataagaaacataaatggatgcttaaacttaaggtgaacatcaggagagaaacaggattttacatatcttcaaagtttctccccccaaaatatttatttattacaaagagggagaaagtaactttacagagaagtttggcaaatgccatctgaatcaagtgattaaagtcaacatcagcaataataggacaggtaaatattctgtgcaacttagaggatgcaatgaaaagtacataatacttgcaatactctgttcaaaatttataacttgggtctcatcatgagaaaacatcagactacctaaaactgaggtacattctattgaatgtgtggcctatgcgcttcaaaaaatgttagggtcgtgaaagtcaaggagacagagaaactgctccagattgaggggcatgatactgggtataccatgtgatccttaacaggacatctctaggacaattgttgggctggaatagggtgcctaagggaagagtgtacaggcattcattgtagtattcttgcaacttttatagatatttgaagttgtctcaaaataaaatatatatatttttaaatttaccttgactgcagcatggaggatgggtgggagaggcactagtagagacaggaagatgcatcaggaggctacggggcaatgggcctgggatgcagcaaatgaatcccagaagttctagtggggtgatgcagaaggacttgacagcagatgccacttacaggtgaaagtgacagatggcggaggatgactccaagtatccagcctgtgcctctggatgggtgatggctccattctctgagagtgaggatgctggagagaaattggttgaaggagtagaagagttgggaatagattgtgggtttggttcagaatagttattctcaaattctcaattctcaaattctcaaatgttgttgagtatcagatttacctggagagttaatacagagcacagaggcacagactcattgaagtagaatagtctggaccttttcattgttactaaaattttccatatgattttgatacttagaaaattctgagagacacttgtttaaacattttgacttttatatgtctataggatatcacagtagagctgctgaatagggagctgaatatgtgggtttggggcatagaggagaagtccaaatgaagatgcacatttaggagtcatcgttggcatacaaacagaaacaaaacagtgcgtgcaaatgtacttcatttgggaaaggatagaatgggaaaagagcctggttctggacatgaaggagcccagtttgccaatacagatgtacataagataggaacagtagctgtccaattgtcccttcctcctgacagtcaattaagaaataagaatttgccataaacccaacctcctcacttttggatgaggaatccacagcccagagtggtcaagtgagttactcaagccacacagcgtgctattgcagcggcagctttggcccttccatctcgttctccagactctgagtccaatgctcaggacactgtgattccctctctggccccacagtgtgccagactccctgctcaactttggtcatttgtgatgttctagaaagcctgtttctctggctttacttttccctcttttcctctcaaaggcccagcaaaggattctctgtagagtccaaatcagccgtcatctttgccactggctctactggcccttggatgaggcacagagacgcggtggtattgcatccctctccaccccatgtacaggcagagatgggcagacacttaacttttacttattcttgattttcagctttacttctttgcatttacttttttcatagttactctagaactaacataataatatgtaacatatgcatatataatatatacgtcttaatttttcctagtctactttgagttcatattgtaccactttacataaaatgtagagaccacataatcatatcatatagatccatttaaccatccactcccactgctctttatgttatcattgttatatatgttccatctacatacatttatagtcccaaagacaatgttacaatttttgctttaaacagccatgtgtattttaaagaaatcaagaggaaaatgttttacattgcctcaaaatagttatcatttctcttgttcttcctttattcctgaagatccaggtttccctctggcatcattccttcagtctgaagaactacctttaacattttttgtagtgcaggtctctggcaatgcatttcttagttttctttatcagagaaatgtctatattttgcatttattactgaaatatatttttgctagatatacacttctggtttatagtttgggttttctttcatcactttaacattgttgtttcattgtcttgtggttgccatggcttctgatgagaaatcccacagttacttgaatcattgttctcctacatatatataagtatgcacacacacatatatattcatattcgtatacgcattgtgtcatatttctctggctgcttccaagattttctcattatctttagtttttaccttggctatgatatgcctgagcatacttttttccccaaatttatcctgtttgaggttccctatgctttataagatctgtaaatgtctgtctttcagtgtatttgcaaagttttcagccatattcttcaaatatcatttttgttcttttttcctccttctggtagggctgcagttatctagagggagaagttttgaaaatgttccacaggttcctgaggctctgttcattattttccctgattttttcttctctttttcaggtctactttcaaactcattgattttatcatttgccatctttgttttgtttctgagcccttccggtgacttttttctaataattgtatgttttagagctatattttctaattaatccttttttatagttttcagaatctcagctgatattttatctttttatcattcataagcatatttttctttacctcattgaccatagctaccatagcagctttaaaatctttgataatgttaacatctgggtggtcctgggattagcatcttatttgttttttcccatgaaaatgggagacatttctctggctctttatacatctagaagtttgggattataaacatgaacgttatgatgtggtgattggattctgctacactgaaccagagtgttggtatttttggtttagcaggaaattaacttggttagactcaatctgtaaactctgtcatgtttgcagtgggcaacagctctttatggttttcaatccgtcttatacatgcgtgtttcgggggtcagctagaaaattgggaaaactttatacacagaatttggtattacctttcccttgttatcttgtttctagggattctccctcaactctccagcagccctaattgtgctgaattcgttcccttggttcctccagtcagaaagacagtggggttttctattggggtttgagccactgagcagactatggctgcccttagggaaaaactacagaagataaaaccttgtgctgttcagtttccagaaacttcagttcatttttcctgtattttctttttccttctcttgtgtttttcttcctttgttgtttgctagagtccatttgttagaaacatactggacaccaaaagtggaacattcagcttatccccctaatcagcagttctataagacagtacttaagacctctctactccatcttaattcccctattttatgcagttctttcaagatctttttaacatcaccatcttctaatacatctggttttactttgtaagtgaagacctcgttaatagctattaaagttttctagtttttcctaccaggtcctcaaacttcatctctcactctgccttaattctccaccttgttttcccccaggtgttccttctgttttagatcgctatttctagccccaggagcatttccttcccaagaagctcctgaaataatgaacagatcgaattttctcctttgcgctttcttatgattggaataaatccactaaactaaggaatagttctgaactgctactaatattcctgctctttaagagaaacagacaaatgagctaggctggactctgaacacttgcatggtttacgcaactttgtttttggcaggtatatttctgaatgtcgttatgtgtgttcaaataaacattcccatgcttctgttatagactagttcttgatgtttgacctcacaggtcaccttctcattattactggttctgtctaatgttaccaagagaaaagagggcatacacataccaggaaaggtgtcacatctttgattaacttattgcatttggagctcacgtacacactcacaaacttgatctttaccttttatcagctgacattggtgggcagagctccaacaggatcccacaaatctctggatagcagctttatgctggttaaatcaaaagctctatttcagcatggctttctttctcttctgatcagtaggaagaggcccatccagtccctctgtgagcataattttcccttcttagtattcagtcaagttccttctgctaaagtagtgtcaactttcccatccttcagagcccccaggctgtctctccaagaagcctccagctttgctcgagccttctgcacagccgtgctctctgcaggcctccctgtattatcatgaattgcattaagtcttcaaggcgcctctgatctccctcagccccttcccctttgactcctcttgcagctccttcctcttgtctcaaactcccggttcctctcacactctgtgtttctgccacttctgagattccctttcttccaagcccgccagttcctcctcctccttactttctctcttctcatgtcagctgatgttctctgccctgctgctgtttccttctgggaactgcaaacagaaccattccttggccatctgccccctcctctcaggccatttgccccctgtgctcttgtccttcctggatcattgtccctttgtcagctcttcctcacatgctgccctggtggttgctgcccctctttcccacattaactgcttagatccacttggggacagctcagctcttccatttcctctagaatctgctccatctgcatcagactcatttctggtactgctctagggcaccaggcatgaagggtccagcctcccctcatgggacaagggacagcctttctacaagggtaatctctgtaagcacctggtgccatggcccatcctgaacctgctggaggaagccaggcctgtcactcatgtgcgctccagaggtctttgttctgtgacgaatttcagtcatcccaggtcatggtgtaggcagcaccctcatctcaccaccaccaaccccacacacacccattatccattattcccatgaattattgtctcagctgcagcctccatcctcgctgtgcttccaggagagagcatgcatttcagccacaatcgcttccatgctgaaatctgtagggcccttcctttcacaaaattcggccttcattcatgatattgtactgcccaattgatccctgtgttcagcaatgtcgcctgagaaaggggcaaaaagaccatttctagaactttctttcccagcatggtgtggtgaaatagttctttggcatggtacgaggaatgcagggtttggatcacactatgctttatgaacttgggcctagttctcttcatccataaaatggggtttgtatgattttgttagatttgtaaaaacccatctgataaactggtgaacatgctaggacaagttccgtcctggtcacagcttatatgagtgttgtggatgctaccataagtgcttccccatctctcagaatccctatcccatggcaagagatggcagatgtacagttttctttttttcttttttcttttttttttttaagacagagttttgctcttgttgcccaggctggagtgcaatggtgcaatctcggctcaccgcaacctccacctcctgggttcaagtgattctcctgcctcagcctcccgagtagctgggattacaggcatgcgcctccatacccagctaattttgtatttttagtagagacagggtttctccatgttggtcaggctggtctcaaactcccgacctcaggtaatccgcctgccttagcctcccaagctgctgggattacaggcatgagccaccacgcccggcccagatgtacattttaaagctaactagcgaaaaggatcctataactttctcactttccagtcactctataacagaaaacaataaggcagacagccaccagaaatccagaaaagctgatattcgcgaaggaaaattgaggacctcgtggcaggatcaccatgggaaaattctgaggaaaccctgtcaagagagaacaggggaaaagaaactaaaatgactgtgtccattgaaacctgtggttctcatgcttccctggggaccagagtttcctggagggcttgtaaagacacagactgctaggccccacccaagagtttctgattcatggatctgaggtggagccttggaatctgcatgtcacgtgagttcccagatgatgccgatcctgctagtcctggaggccacttgaaaaacctcttcattgaaaccgtttcagggagcatgaattttatttcacaaacttgcattgtaagaaatgtcaattaccgtatttctcaaaaatccaagtaaatctgacaccaaatccccatcctgtcaggctggaaaagaaagtatattttcagtcatcttagaacttctccttctccaagcccagggaagcatgaaggccccagaccacacttgggctccagcatcttttcacggggtggcaacacctgtgctgtgactcaacttcccagatgcccacccagccatcacgttgtctgagaccgaggagacagcgagggcacagggccagtaggtgccgccagcacaaagctccacaccagcatctacctctaggtcctgggaccctcattctgatgctgctacatctgcccccataacaacccatttcccagagtctgaacccctcccctcatccatcaactcttttgtggaaaagaaaaagcaaaaacctatcaaatcagccctggagatcctgaggattggtatgaaggagttggagacaggtggataaaaattaccctcagtcttgagccgggcacggtggctcatgcctgtaataccagcactttgggaggccaaagtgggcagatctcttgaggtcaggagtttgagaccagcctggccaacatgatgaaacctcatctctactaaaaataaaaaaattagccaagtgtactggcactcgcctgtaatcgcagctacttgagaggttgagacatgagaattgcttgaacccaggagatagaggttgcagtgagccgagatcatgccactgcactccaacctgggccacagagtgacactctgtctcagggaaaaaaaaaaaaaaaaaaaaaatcaccctcagtcctgagatttttctacaccactgaaacaaaaatatgcaaattaacacctcaatcatttccattgttatgcatctatcagtgaaccagatgccctgttaactggggtgaatctcaacaaagaggactttcttgcatcactttggttgcaaagccccatcttttctaagtaaatcactgttcaaggaaagaaggcagttcggtgtgcctgatgggggtcacctgtgtctggaattaaaaggtcttttctcggcagggaacttgctagggtgtctttcaaagaggggatccataagagaaaaggtcaagaggatgccaaaaccttagccttaggggccattcccttcctcctgccaggccctagacctgacctgcacaggagatgtgggtgccacaaacagcccgagaccttcttggctttgacacagccaagatgagtagcagacctgccaccactgtccctggtagcagcagggcactgagggcagtgctgaggataggcatcaccgtgtccacactgcccagacattgccgctccaccagggaccagcagtgctatgcagagtcctcatgggtagaaaatggttagggttaggggaactctgtgatgaggacaaaaagactgtgaacttcccctaaagcctgcaatgaataactcccatcagtaccacacacacacacacacacacacacacacacacacacacacacgcacacggggagagagagagagagagatgtgtgtagtgtagttatgcacatgttgttacgcaaagcatagttagagatacacagtgaaattcagagcgatgtacacacagaactatacgcaatcacccagggctacccagaaacatacaagtacaggcacaaacattccgagtaggcaccaggtaatagctggacttttttctctcattacccctgagcagtgagtttgactgcaacagtactctgtttcagatttttttaataatgcacttagtacattataaaatgtgcaaagaaagcagaaaattatctccaagataatcctttctgcaagattttcaggaaaaagctgtctgcactttgctgcaccactgtaagaagttgcttctcagtcgggtcgatccatctgcctgatagattttggctaaggctatgaccttcatctgtcagaacgggcaaggtttactggctttctgtccagtgaccccaggtccagctttacttctccccatagctcctggcagtatttacatttaaatcatagttttcttctcttctgattcatggcctgcctcatgaggcagttttcaaattatgatttcttactcatctttcaatcattgagcttgggtagcagggctgtctcttgggtgggtaggaaagtggagagggatgaagacaagcaaagacaagacagagagaccctttaattgaagccaggataaaactgagtcctggtcccctggaaattctgctctaacattaattaagctgagagtaaaataattcaaatgccactctatccccttttccaccactcaaataattcttcttcaggcagatttggctcctccttgctctgatatctctccctgggtcactttgttaccaatgctcagttagggatatcaggccctgactgaaattcccttttgaaaaagactcagcataattattcttagtaatgcctgtatattattagcatgggtgggatcagtatggaatttcagagcctgagccagcatgtacccagggactggaacaaggagtgggtcaggtttctcagaaaacacatctctccattctgggccccacaggggtgtgatatgcaaagccctcttcctcaatatgcctgtcatcatgtgggaggggccagccacctgggtgcaggcccatgcagtgcctctactggctgttctcctagccaatacatatttttaaagcagctaatatgtgcataacactgcagttaacaaaacaggtagttcctgagctcctccagtttccttcctagcaaaaaaagacagacattaaacaactaattatgcaagtaattatataattgcaattgttaggtgctatggcggagaagcatatatcaagcgtgtatcacaagaccctgaagaaggaacacctgtgttgaagcccaaggacgaaaaggggttaattagggtaagagcatggccagtgcctccctcatgggaatgatcccagagctggacacagactctgcttgctcagcaaggacagagtgtggaggagaggagggagttggaggagcctgagctcaagcacaggtgggggaagagttgccctcccacagaaaaggcccaagagatactgaaagaaactgaggtagacgtaagcctcagcagaacagaggaggctagaaagtacttgatgtgcttactggatagtgaacaggaggcctacttggctagtgtttggaaaagagtgtgaaaggtgtgttagctctggaagggccctgggatcagttgaattgtatccctcccaaaaagatacactggagtccttacctctggcacctgtgaatgtgaccttatttggaaataggcttttgcagatgtaatcaagttaagaatgatgtcataatgcattaggattaagtctaagtccaatcactggagtcattaaagaagggggattagacaaagacacacaaggagaagatggccatgtgatggcagaggcagaggttgggtgatgccaaggaatgtcaaggtttgctggcaaacaccagaaactagaaggagcaagtcaggattctcccctggaggtttcagagagagaatagccctgcgaaagccttgatttcagacttgcagcataagattttagaaaaatgtaaaaaacaaaaaatctttataactcttggttgttatgttcactgagttggcaatgtaattttgcagaagcattgccttccaagagctgtgaccacaagatgttaaataacagggactcctccggtttctaaagccctgatcagccttgatactgtaggagtctgcaaatctgtccagttctgtaagagtcctgtgcattgttacagaaattgataaggaaggcggggatcttgtcccatgcacccagactaatagggctccagaatgttgtagtgtttgccttatgggccctacacagagcagaattccctcacaaagaaggcctctggatctagcacatctgtgtaggcaaaatgtttatccaggtaagggtaactaggcccttcaattcagctctccaagagtacacaggcaagagtttttttctaaagaccctggtagctcaaaaccagcactatcaaggctaatcacattatacttcctatgggaatgctgaattcaacaatctgaaggtagtcaagaaactcatccagtataggctacagatgtctagggaaaagagagagtgagtccaagtcaaagcaagggggaaagagagcagctgagtgaggaagggaaagacaagggcatggccaatcaaaggctgctctgcggatgctcaccccgcaggcattctagctgcagggggaatatgcaggaatgatttcagaaatgaagattttattttaatcctcccacaaaagcattcaagtaagctctttctctgtgagaaagctagagagtaagaaacaggaaaggaaggttctcagcgaaaagatccatgtcgacttctaatattgctcacttagagaatacatgccatctgggcatttgataaaaagaaaaaagggcgtagagaaaagctcaaagccatggattctgcttgtgagtgcaaggtgctcgcctttcctcatggccagctctttcctttgttggaggcctttttttttttttttttcctggtcagcaatgactttttcaaagtgacctgtcaagtcttcctttctttattccctgtggccaaggagccaagcagtgggcaaagaggagagaagaggagaggacccaggtgacaagggcaaggctggtattttattcattaattgtctgagtgttatctataaaatgcgaactcacagcccacttgtgcctgaggctgaccccagcatactcacaacttgctactccaagccagagaggacaagaatacctgccttgtcttcatagattttcatactgtctcttagaggtgcatgttttgggcacaaaatccagggctttctggcccatgacttagtcaggagtggtcatgggtctctcactttagccctgtcattttgaaaaccttttcctttggaaaggaatttggcccgttccagggactattgaagacaacagaaaaccaaagagctaagcaattaagtttatgtgcttctaaattgacatccccaataaaatgatatgaaatggctttgtagctggatattctaccctgagaaattagaagggcaaaagtttggccaagaaggggatggggagtgggtggaaaatattttaatatcactttaagatagcatgtgttcttcccaattttcttcccattgcataggctatggttctattatccaaaaataatgattatttaccttactattctatactagttctctgtactagaaaattattttagtaagcaaattaggcaccatcacttaaacctcattattcatttttgttgttgtttatttgttttgacttttggtatccattaccgtactagtaatcattatcttcaataataaacacaatgaactcattctttccttgttctatttttcaatgtttttatcacatttccaatcatttagcatagtaagtcccaggagctctaatgacagacaatctaacgcacaggacttaacaggagataattctgaatggtggccccctcagcagttgaggctgaattttgatccagaaaacatgattttagttctggttctaccagttgttaacttggagtcagttactatacctctctgaggcttcattccattatctgtcaaaggggatactatattacgcctcatgtacatcacatgactactgtaacgatggaaggagacatattgttttgaaattctttaagtaaacccctaatgtcctaaaaatgtaacaaaataaaaaatattacaaaagctgatgaattagaatcactagtaaatggttctagatcttagtaaaatacttttacttgatttaggggggaaattatttcaagaatacatgacattctaaatataattattaatagcaatgagcagaactatttcttttcagctaataatgcaagtggtgggatcctaatataaaatttcaccaatgtgatgcaaagagcacaagcttggatagccaaaaatttaagatcaaaatttaaaccctggctctgctcctaacatattattgtagtaacctaagtgaggtatttacttcatgagcctcagttctctaatatggggataagaacttacattttagtagaagtatgaagattggatcataataaatatgtacagtgcccagcagaacagttgatgcctagtggatgcttgaaaaaatgtccatttgctctcatcttctctgagatgcctcataaaatgggaatggggatccagcgtgttctgttccatgcctgtttctccaatgcaaacgcaatatgtgattggtaaatgggggagtgatgccagtattgtgtggaagtcccgcggttctcatatgatcttttctaggatatttatattttgaagcaaataggggcacgctttcttccaattaaagagaaagccttagcacaatgagaagaccttaagaaacaagttgaacactggagagggcctttctttcatgcaaatagtggccggcttcgtggtttccagagccactgtgtttttcactctgttttctgataaaacagggagtaaacatgaggaaatggaacacattttcctttgtgttaaattttaattttatgacaaaacagtctacacattggattggatttttaatttggatgaaactgatctctgtgagatgtgaatgccctcctggacctatgtctccaagaggaagcacaaaaatccagagtttaagcttgcaaaggatcagtgaaccaatacactgggtacaaatgcaaattataatttacctgtgctgctatttttatgaagattgctgtgttttttgttagatgttgaatggtctcctccaaatgcattttctccccataggctctgttattttattgtgcaatttcgcagagtatgaggttttactaaaatatgtatatgaaattatagcagaaatgcctgtattaggaaattacagtccagtcaatcacattcagaaatcatgtactacacttaggcataagaaatagttgaaacatcagtaagcctaatcatgtgagaccatttgacatcaaaattaagacacattagaacatatacttgaatcaaaggaaaggaaaaatgtaggctcacccattatatatgagtctgtccacatgggagatgtggccagtcctcttctctccacatcctagagttttataggaatgggccagggcactgctgggtactggggaaaccttgcagggctccagaccaccaccttgcttcaaccacagcagctcctctcttacctattttagatattatgcttttaccaaggtttcctttcaaacaagttttgccaacatgagttcagtatttgaaaagtataggccatcaaacctgatgataatgggttgtttaatgtggtcaacattcctgtccccaatcatactttttctaagcttagaagagagtttacaaaccatgtccaatactggcttttaaagaagagtgagagacactttattgtattttagaagttccaaagctaggagattgtccatattgcattttatttattatccgtatttgaagccatgatagagatgtcttggcgcactcctcattggcttctctataaaaacaacttcaaaaagaaatgtcattgtttggtcagataactcttttagatacctgatcaattaacaagaggatttttaaaaactttatttgaataaaatttcaaaaaattgtttgatgaataagtctacaccatggatcaaaatattaacattgttaaaaccaatccctactgaaataaatgccctctggaaccttcagtctaggatcaagtattgcatttagttgtcatgtctctttaatctcctttaatctaaaatatagttatgtgccatataatgatgttttggtcagcgacaaaccacatatacaatgctgctcccatattatattactgtatttttactataccttttctgtgtttagatatgttcagatacacaaatattattgtgttacaattaccaacagtattcttcatagtaccatgctatacaggtttgtagcctaggtgtgtagtgagctatcccatttaggttagagcacatacactctaagatatttgcacaacaacgaaatcatctaacaacacgtttctcagaatgtatctccattgttaagcaatgcatgactggatttccactgattttctttgccttttatgacattgacttgtttaagaatacaagtcaccttttttcattaataagacattcctcatttggcatattttctgatatttctcataattagattcagattctacattcttggctataatcctacataaatgttgtgtccttcctaggctattatattttgaaacacctgatgtccatctgttccttattggtattattacttttgatcacctggtcaaggttttgtccaatttctccaatgtatagttatgtacagtatatattacatatttttctcttgtgactaattagcaatctacaggaaaataatgttaggccatgcaaatatcctgctcctcataaaaattcacctcactgccccccaatttcagcatccattgatgagtcttatctgaactagtctttattatcacaacgggaaaataatgtttttcagctccagccaccatataccagtgagcacttgtcattgaaaagaagatattttggatggtagttccataatccagtcaaatgttcctttgttctgcttagaaacccaacctaatgacattttgaacattacattctctttgatttttacctgagaagctttggaatgacctttggccaagaacattaagattctcatgtgtttccaggccgctgctccctgttctagtctaaggcctttcagacctagcttattccatcactctctgctctgcctgcacctttgatttatatctgtctgggatttacttgaggggaggggagagcacgttgaggggggaagcagacaagctcctctctgctccactgatttgctggctgtttaatttctgtttctgtcttcacacctactctgctgcagagctaggatgccctgcccccacctccacctgtcctcgtttcacccaccctttgccacaggcagtaaaatacagccctgaagggcccagaaagatgcaaggcgtaatccaaaagatgtatctcccaatccttgggagatactaaaatattcctgtaggatgcagaacctccagggtcaacaaggcccgatgggaaggcttttgcttgccactgacagatgtcacagagcttaggcccttccctgggcttctcctgacttgtggttaaggattctcttctgagccatctgagttcctgtgatgccatcaaaatgagtaagttctctaaccttgggagaccatggcattagagaaaatggaaattgtttgcgaggctcgcagttcattagcctcatataaaatgaatttggaaccctctgaaaagaggagtttgggggcttcagctgaaggtactgctatgactctcaagattccataaaactctggaactgaagccccacagttcttggcagagctttcagactgtggcaagtttaggaaggccacacctcaggtgagtggggatgatgatagtggccaccaagagccacagggaaagggtccagtcccaggttggaggaggggaaactgaggtgactctgcctcccactctgacaagcccagctgcccttgggacagccatactgtaaaccgtaggcccaagcaggacaggcagggaagcaaagaccagggttctagacccaccaggctgggtgaaagttaggtctgggaatgtgggagcaactccaagggctggttttctaaggaatgggaaaatggaaagtaaatcttaaagtagatcaaacaataaagagattagtcagtggggaaagaacaggtaagatgcaagcagcatttgctaaagcctaaatctagctggggaaccccagcttacccccaagtggggtttctgtagtgcaggcctaggcaggccaacggcatcagtggcctcaagaatgaggattggggacagctgtgggcagcttggcccatggtccagcctacactacggcttgcatgctgctcttgcaacctgtgccctgtctcatggcagtttcctcccacatcctgctcagtagctcttcaaagcctttgccacactcctcatgtccctgccctaccgcggcactcttctgtcccagcagctggcctggcttcctcttttatcacagtacctctgagctttcatgtgctgctcagtaacagtttgtggaatgaattaagaaattcacgaacgagtgacagacatgcccctggagatctgagatatcaaggagaatggtcagtgtagaatggggcaggagcccgggtactcagggagcagtatggctgcccccaggcagctgggttcttcacagtaggaagagacctttcagtttctgctcttccaaccctgaattcgactctttccctgtggctctgcacggctgtgataaccagccccattcacctacttttggccttcaaaaccttctactttcttcccctacacctgggggaggaataatcccagaacatgcaggagaaggggcttattggtccaacttggaaggttgttggcctatctgaagaaagaaatctctagaatgccatattttttaaatgttattatggctttatttaaaaaccgatccatcattttcttaacacagtcattaagaaaaaaaaaaaagaaatcatgtcctttgcagcaacatagacggagctggatgatatagtcctaagtgaattaatgcaggaaaggaaaaccaaataccacctgttctcacttctaagtgggagcaaaacattgagcacacatgaacacaaagatgagaataatagacactgcagactactgaagggtgggggaccagggagacatggattgaaaaatccactattcagtaccatgctcactatttgggtccaatatacccatgtaataatcttacacatgtacacctaaaataaaatcatctaaaataaaatctgaaatttaaaaacaaatgaagtgcttcaaaacatcaaaaaataaaaatatgtttaaagtaaaaagtgagtcttacacatgtacccctaaaatgaaaccatctaaaataaaatctgcaatttaaaaataaacaaaatgcttcataacattaaaaaataaaaatgtgttcaaagtaaaaagtgaaactgactcccccttccaaattcccagaaattactatcattcatagtttggtgtgctttcttctcctctttactgtgtgtgtgtgtatgcatatgtgtattttttgtgtatacattttactctcaaaaaaatggtctcataccatacataatgatctactcataggctgcttgctttgttacttaatgacttatcctgaatattacctttccccttcagcgcctcacttcatgcctttggagacaagctctttttaaatggtcatctaggtggcttctgatgctatgttatttcaaacaacatttcagtgaaaattcttatatagacatgtctgtgcactcgtatgtatatttctataaaataaatttcaagaagataaatttctagatcaaagaatttgcacattaattttaaaaaaataatgtcaaacttaaagaaagttcccagaataagaataatacagacaacactcatataacatttgcccggattctttacctactgttatcatttgaccccatttctttattatttgctctcttcctttctctctttctctctctgtaaaatattttttctgaactcttggaagatacgttacatacatcatcgctctttattcttagactcttcgtgtgtatttccgtatttcctaagaatagggagggatattctcttacataactatagtacagttatcaactttagtaatttaacatggataaaatacttttaactagtctactatctatattctaattttgtcaattgacccaaaaagtatcttttttagcctttttttcgctctagtacaggatccagtctagcttctgagactgcatttagttatcatgttcatttaatatcttttaatcaggaaaattttcacaatactttttaaatttttaaaggatacctttcaaatattgtgtaatagactcttcctcattttgagtttgtctgatgtcccttcatgcttagattcgggttatttatgtgttgcctaagtgacagtgtgcccttcttagggtattgcttctggaggcacgtgatgttcgcctgtcctttgtgtgatgttaacttgtatattttaaattttggtagctgtttattcccccaaagccttttgccaatttatattcttgcatagcttacgagatttgcccattttcacatcctcttcctcacacagagagtcatcagtcttagtcccagtgtaaatgtgcttattcatgctttatttaaaaaacaaagcatcaatgttttttcccattttactctgaggcactttaatattcttaatattcttatctctcaaccaacgtttctcaaccatcaaagatgtagtaaactgacatgctcttttatatcccagagctcactgagagtcgggcagtctgaggggtgacagcgtgggtggggtgggacccttggctgacagttaggaactccatgctctgggaaagtaaaacacaagccaatccttttgtttttcctttgggagatttttatctgccctccatatgcaaggacacacttctccatgtatcttctttccttctttcctgtcatccaatatgaggaaaaggcagcatgggatctggaatgggaggtttcaagagcacccccccactttttaccaggtgtggacccctggtcaccctcctctcctgtccagttcccagtgcctgtaaaaagagactcagaatacttggtttcatccccagtatagaagatacacaggaaggagctgccctcccaatacagcctttgaagcagactctgcccctccttggccatccctcaccaccaccagaggagggcagacagcccagagagcagggctcatgcagggaggcaggtggagcagcgccgtcagcactggcacactctgccagcattagctaacagctcctcatacgcccctctgagataattaagtattattatccctattggcaggtggagacggtaagacagagtgtttaagtgacttagttgtaactgctgggattgtttgcgggagaaaccatgccaagaaggaagtgcagttcaggaggccagaattgcttaagctatttaatgtgactgattatttttaaatagctgttggagggcgggggcaggaagagagactagaagcatggccagtggacactggtaaggcattcaaacattgcaatgaaaagaaggaatatacctagtgtgtctcttaaaacgggttgccatagacagtctgtcagctgcttaccccacatgaagaggagaaaaaataattgaaggccatgataaggacaatagaaaacaccccacagccttcccacagagttgtacagaggtctccaagttggctaagcaggggccagtctccatctgagagccccaaccttctccagagacagagcatccactggaatcagcagccccaccagtagccactcgatgtcagaaggacttgccagctgtattgcctgccgtagcaagtgcagcttcacctcagagcagcaggaagcccatgtagcctccatgcacagggcagggacagaatgggagaagagtctgggtgaccaagggttgttggggagacacatgcgaaaggtggaatggcatcatggcctactgatggatggaaaccctggagacatggggaaaggcccaggggtcactggtgtggcaaacagactggctgacagagaggaagctgtggtctcttaggatgagcctggggctgagggtgggcagcagtgaggcatgggtgcagagaggctctgggaaaaagtacagttcctgccattgtcagagaagcaatggatgaaacactggacgtggcctggaaacagaaggggagatagtggggtggcctctgagcctcctcctgaacccttcttgccccctgttccatggtcctccatgccagcctgtcacccagagggcctagaggctcattgtcccctccccacctgccttggaggagggcatttttgtttcagcagcagggcaagtccagccctgcttactacattcctgatgggatgctggctctctctgttcattatcagtaccccaccatctaggagagcaaagtgtctagagaagctaaagccctttggggtgagtccagttgctctttctccagagcactcacttcaggaacactgatagcaggacccaggcttcagggactaaacaaggagagaacacacctgcaccattattttttatttttattagcaagatctaaattagggtaatttaatttaaatttttaaaataattttggcttttactttagatacacgaggtacatgtgtaggattgttacatgggtgtattggacccaagtagtgagcatagaacccagtaagtagtttttcaacccatgcctccctccctccctctcacctctagtagtctgcggtgtctgttgttcccatatttatgtctatgtgtgctccatgtttagctcccatttataagtgagaatgtgtgatatttggttttctgctcctgcactaattcatttaggattctggcctccagctccattcatgttaccacaaaggacatcatttctttcttttctatggctgcatagtattccatggtgtacatgtaccacattttctttattcgacccaccattgatgagcacctaatgttgattccatgtctttgctgtcatgaatagcgaggcgatgaacataggatctgcaccactaaagacctgactaccactgcgggattccctggacagtgtcctcctcagggcagaagggatgctgtttctttgccctttattgtccctggcctggctcagagaggggcctgcttgtcaaatgaatgaaggcagctagttaattatttagcccttgtctctccatcctttctttttaattgtaaactcaagaagcactggataataaaaagaaataataatgcctgtatcctggccatcagaggctgttttgggtgtggatagtaaaagagagctgtttgcccagtcagtatagtacagaaaaatgacgtctgtttggttgaagattttttttccagttgggaaatgtcaccaagtggcctttctgttcttcacacatgaaatacacactatcatccacatatttttagttaatttatgtccaaataagcctttttgtagctgctggaaaattatatttgggctgcaattacctttcgcagcattgcacagaagggtttcagcgctcacaaagctcaggggagaggcagcaaggaccccacccgattgtaaatctttccatttgtagttattcaaatcacatattttattactagtacgaaatacattctgccattcattttggaggagcagctaatgcttcaagaaaagctttgaaaaacattctatttagaaacaattttgtcagcagctaatgctatgtgtctttttgggttgtcttttctcccagctctcttctctgttatgtgtgccatttgcatgacaaacgagaccatcctctccaaaagctcacctgttcctgcagcctgcttcccacctcaagttttcattctctgtatgttgcatcataatccttagcacggtaataaattacagtgtcaccatcaagattgtggcttctggaaagaaataagcagcagggccagatgaactctttcagaagatgagagactgttttcatgcaaattcctggcatcctggggaactgggaacagcctctttattatatagactcagttgcaattcagcagccagaagccatttccactagctgttagaagctggtgacactcagagcaagataaccttttaggcaaaaacttcttttccttcttagttgttatgagtcttgtctggaaaaatatcactttactcattagattgaggaaaatgggtcagtgtactttcagagagcttttaagttgagacatttattctaaaatacctttctaatttgacacagaaacacttgcagctcactttagagcagtgcagtagacagtgactgtggaacaggagcaggggtgtgccacatggatgccccctgagggcaggcccatctgtgtgtgaacttgtctacaatggattgcacagaccctcactcgcaagcaggtgctgtacccaggctggtcaaccacacagtcaggagggtcactgctcgaaggcagagtgtccaacctgccaactccagggtgactcttgacatacaatgtaaactttatctcaatttgccctccatttcctttgggccacagatatacttgacagaaacattaatgaggccaatttgctgcttttttcctttttcatcattttaagatcttttgaggcttagtacaatgttgaaaaatatttgctgtattagtctgttctcatgctgctaatgaagacatactcaaggctgggtaatttataaagaaagaggtttaattgactcacagttcagcatggctggggaggcttcaggaaacttacaatcatggtggaaggggaagcaaacatgtctttcttcacatggcggcagcaagaagtgccaagcaaaaggggggaaaactccttataaaacaatcagatcttatgagaactcactcactagtacagtagaacagaagggtaactgcctccatgattaaattacctcccactgggtctctattacaacacacagggatcatgggaactacaattcaaggtgagatttgggtggggagatagccaaatcataccattccacttctgactcctcccaaatctcatgtcctcacatttcaaaacatagtcatgccattccggcagtcccccaaaatcttaactcgttccagcattaacccaaaaatccaagtccaaagtctcatctgtgacaaggcaggtctcttccacctatgagcctgtaaaatcaaaagcaaattagttacttcctagttacaatgggggtacaggcattgggtaaatacacccattccaaagggaagaaatgggccaaacaaaggggctacaggccccatgcaagtccaaaatccaatgggcagttattaaaccttaaagttccaaaatgatatcctttgattccatgtctcacatccaggtcatgctgatacaagaggtgggctcccacagccttgggcaagtctgcctctgaagctttgcagggtacagctcccctcctggctacttccacaggctggccttgagtgtctgcagctcttccaggtgtacagtgcaagctgttggcggatctaccattctagggtctggaggatgatggccctcttctcacagctccaccaggcaatgccccaatggggactctgtgtggggcttccaacctaacgtttcccttccacactgccctagcagaggttcttcatgagggctctacccctgcagcaaacttctgcctggacatgcaggcatttccatacatcctctgaaatctaggcagagatccccaaacctcaattcttgtcttccgcacactcacaggaccaacatcatgtggaagctgccaaggcttgggacttgcaccctctgaagcaatggcctgagctgtaccttgaccccttttggccatagctggagcagctgagatacagttctgcagttccaaggctccacacagtagggggaacctggacctggcccaggaaaccatttttccctcctaggcctccaggtctgtgatgggagagactgtggtgaaggtctctgacatgccctggagactcagctccttattagttatgaaaatttctacagccgcttaaatttctccccagaagatgggtttttctttcctatctcattgtcaggctgcaaattttccaaacttttatgttctcttcctcttgaatactttgccgcttagaaatttcttctgccagattccccaaataatctctctcaagttcaaatttccacagacctctagggcaggggcaaaaagctgccagtctccttgctaaagcacagcaaaagtcacctttgctctagttcccaacaagttcttcttctccatctgagaccaccttagcctggacttcgctgtccatattcctatcagcattttggtcaaagccattcaacaagtctctaggaagttccaaacttgcccacatttttgtatcttctcctgagtcctctaaactgttccaacctctgcctgttactcagttccaaagtcactaccacattttcaggtatccttatagcagcacctcattctactggtaccaatttactgtattagtctgttctcacactgctaataaagacatacccaagacagggtaatttataaaggaaagaggtttaattgactcacagttcagcatggctgaggagacctcaggaaacttacaatcatggtggaaggggaagcaaacttgtccttcttcacatggtggcaggaaggagaagtgctgagcaaaaggggaaaaagccccttacagaaccatcagatcttgtgagaactcactcactatcatgagaacagcatgagagtaatcaccctcatgattaaattacctcccactgggtccttcatacaataagtggggattaggggaactacaattcaagatgagatttgggtagtaacacagccaaaccatatcacttgccatgcaaacagctgcctacttcctcacccaaggaagacattgctcatcaacacaaatacccctcttctctccatacctggaaggtctagcccagtggttctcaggcttggttgctcattggagtcacctggggaaagttttattttttgttagtgccttgagtattctaatttagaatctctgggagtggtgcccgagcattgatgatttgaatgtgcttcaggtgattcttacatgtagtcattagtcaaaacctcttgttgagcccagtcatgaagcctcagaatccttcttaaaccaggcactaacaattatcagagtttgtatttaagacaattcctaaagcaatccatgacttatgtcggattgatctatgccagcagttctcaaagtgggagaaccacactgggaatttgttaggaatgcaaattctcaggccctaccccagaactagtaaattttaaagtctgggttagaaccagttttatgagccctccagtaggttctgatacacattcaaatttgagaaccacttctccagccagtagctgtgactaatggcctgacattcaaatcacctgaagcatcaccaaaaacctaccaatgcttgggcaccactccgagaaattcgaataaattaaaatattcatggctttaaaaacaagcaaacaaacaaactttccccaggtgattccagtaggtaaccaagcttgggaaccactgggctaggccttctgagtaatcaaagaaaatgtgtattggcctagctttcagccggtgttgttgtgcatttacctaggcctggagtggccgtctgagtctggggacactgatggtagagtgaggatagaattctccctcaggcaggatgacaaagggcagtgcttcaaggtatgaactgtggccgaggtctgatcaacagcagtgatgaaatgttagaggggccctgtggttaatcgaggggctttgatataaagtgttggagctatccctcactcccaagtcctcttgccccctaatagtagcccgtgatggttctgccacctaggaacttaacagtggtattgttaaactagtatctgataaaattgtatatactcaatgtattagtttctcatggcttctataacaaagtatcacaaactaaacagctttaaacagaaatttattctatcacagttctggaggctgaaagtctgagatcaaggtgttggcagggtcgttctccctttgaaggctctagggaggatctatcctatgcctctctcctagttgccatcaattcttgatataacttggtttgtagatgcatcaccccaatctctgcctccatcttcacatggtattctccctggtgtgttgctgtattttcattcggccttcttataaggatgccagcatgaaatgtagggctcatcctaatccagtatgatgtcattttaacttgattatatttgcaaaggccctgtttccaaagaagatcacattcacaggtctcacagttaggacttcaacatgtcttttgtggggatataactcaatacacaacattcaataatttattgtttaatgataataagaatatattgtgtggtttaaatttctatcgtgttggactttcacaacaacctcaatatactttatgtattataaaccttttggaatagcaggcattacgaaattcagagccatttcatgatacactcggccatgaacctatcacttccaaacttcaaggggatcctctcatgctgcacaacagaaatatttggtgaacaagtccatgaacacaatactcagtattcatgagtggctggatttctgccataatcccattgagattttgtctcacacaagatggtggagaaaagtgctgtagcaatgcccagacacatagaagtgctaccctctgggcttctcaacaataagcaattagcaaaaggaatcagtcatatgcctggactttggcctggaaaacttcatacttgggtgggctctagaaccaaagctatgtgttgtacttctgtaacctcaccgtggcaagacagtgtgctggctggatggtgttagggacatccattgcccattgagagtagggctgaggctcatcattaccatgtccccagcagggtactgaggacagaatgggtgctgcatagatgcttgctgcagactgtctgaagctgagggactaaagtgcctctacaccaagagcttctacctgttggcatcacacctgctggcaggtgtggatgtgggtcagcagatgaccttgaggatgacagggttaggattaattcgctgccagatatcttctcgtagttcaccaaattctacacacacacacacacacacacacacacacacacagacagacacaaaatcttaaatttatcgtatatctgagttaagacataatttttctgaagcagtggttttcaaacatttgaagaattcttggcaacacaactattcaatgcaaagctctgtgtggaaggtgtgtatgaagtcttgaagggaactcagacccctaatgacagtgagctgcctcttcctcttcttctcttctccctcccccatgctccaacagtgacccctgcggcagctctagggaaacccagtccctgcagaaagcagacccatacccttagcatcccccagggaagcaagtcatctggtaccttgtagaaacccctgccagggacagtgctctccccaagcccagtgtcagcacttctgtgtccgtatgaatgcagattcctttccagtgagccccatgcattcttcactgccctgagaatttttccctgatattcctcaccacccaatggagcaagcactcctctatgccccttcctcatacctgcactggggagctgggggctcttagggcactttaaagtcacatggctgtgttggccctggtgtctggtccaagctcctcatgcagcagcagcaggaccgcctggctggcagaaccctgcctgctgcagcagggttccacttccttttcttctgcttccctccacagggctggtcaccatcctctaaattaatagatttcctttcacataattgaagacaagttataatcatcacttgatgatattaattatgtcaataattgatattgatattgattatatcaataatcatcaccatgattacctctgagcaccagaaggcaacattgacaatgatgtttgaaaagatggaaggaaggtttaaaattcctaggaaacaaagtgcccactcttgtgctcccctgactttgcatttccttttgttctgcctcccaagtcagtgtcccccttctcttcagctgagcaggagagcctgccatgacaagctgtcacctgcctgtccaggggctcttctcaaaggctcagccacctgctgggatggaggggggcggcggtgacagcccaagctcagtgttcagtgaggcccaacagtgcaaggtggcaggagggctgtaggctccttgccgtgggccaggcactgccactttccaggcaggagggagcggctccacagctgtcactgacagcccctggggtttgctccagacttggcagaggaggacactctcagactcccaaatcacctctttgaaattcagaagagccacactgtcatctcccctcctctctctgacacaaacacacacaaaagataagcaagccctaactctcttttactcagagacctacactgccaagttttctctgtctcccactctcacacacagattgatacattctcacacacaatctggttctctgtctctgtctctctctctctcacacacacacacacagtatactaattaaactccaattctctcctacctcacttaacccaggtattttgagagaaccaaagcccctcttttctgggggagcccaggccatctcgaggtgtgacaacagcaccttccctaatggcaacacacaacttggggtctctgcactatcagacattgacctccaggtgtttggtagctgctgcttcactggatgaattcttcacctctcttcccagccgtggggaacatgttgataaaaccagtaaattcattcatgttctgggggatgatgagaacagagagtctggctgcagccacagcctaagcatgccctccaggcatttgtcgtgtagctggcatttgagctgaggacatctcccccaccacaaaagcctgccaccatcctcaggggaaattaggactgtcttctttgcagaaagtgggatgtgtgcctggggaggtccagcctggttgcctttattcctcccaggctccagataggaaaccagataaaaatacactttgctgtttgctccttttttttttctgcctagctcgggttaaccatttttacatttttacagtatttttgctaacgtcaaccatgtatctttggtgacttgagcagattgtaagaatgggcagtataaaaatatcctctttcagtggaggcatgaagtaaatgaggaggggagtgagggagctgccgtccctgctctgtgctgttactgctgcagccagtggcttcatgttccacgtagtatggagagagacagagcctaagcatggaaaaaagcatgaaagggtgaaatcctggcatttggcatgaaaaactgaaaaggggggtcatatttgctatagggagtgatgagcttttgaggacagccttggcaagaaccctgtttaacagctgtaattggcactgatgctggacagcacaggccatgccagctgtctgctctatgctcacctcccattacttctccttcaggaactccctgcttcagccattgtggattgcttgtatgtcccagcctctctcttatccctggccgttgagaaagctgctctctgcctggacttccctcctccagtcactttgcctggttaacttctacttgttctctagggctgagcatagtgaaaataatagttaacactgggctgtgtaggtgctgatgagaaactgaggcacagagaggtaggttacttgcccccgccgcacaggtagaaagaggcagtactggtatccaaacccagacaaaggctccaggagttcttaaccaccaccagaaactgcttctctaacagctcctgcctgccttccctgacccttccctgtgttggggagtctcctctggttttcagaacaccttgtacccactctcatcttcaccttccctcacttttcaatgtttttaacaatatattttaagtttctgttttcttgtctgtctccccactgtcctgttcagcttgagggcagggacactggcttatttctgggacatcagcttctcagcaggacctggcacaaagtggtgcttattgcctatttgttgatgggatggatgaatgagtggatagatgtgaatcccttaggtaaacaaaactggctaaggtctggcagacaagctgagggccaagcagagagccaatttagaaacttccagtgtgggattggaggcaagaaggagaaacaagcctaagagtggccctgtagaaaagagcatctctagactctggaatcttgacctccactgaagggctggcaggacagccagcatgtagaaagaccacagcactgggaccattcaaccctcatgaagctcagggctatctgcatgctacagagttagggaaacctgccccccagaggtggaatgcaacaaaaatggggcagagggcagcatagcatgaccttgtagtggcagggctctccaggaggcatgcttcatcactcttctttccttttgtaccattgcaattccttctgacccaaatgtgttagcttttacattgccagggagcaaagaaaaccataacttgtttctcatgtagccaatctcaggtagttccagtgagttttatgacagttacactctctcctcccacccacctcccctgcagcaacattggaacccacatagagggaaccagggcacatgtggcatatccacatgaggctagaagccagcacaggcatgctggtcaccttgagcttctctaactaggcacagcaacatagcttgtgcacgaagcaagaatagcctgtctgtcataattcacaagatatgggagtgagagtttggaagaatgtgcatgccaagttttttattgcctgccttcaatcagaaacctgattgttgggctgaccacggtttctccttctttcagggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtgagtgtcagcagcacttggtcaccacaaacccccattgaagggatcccaaaggcagtagcataccaattcctcctgttttcagctcacggcctcataatctgaacctgcagtgttcagggtaggggatacagggacacccttagcatggatgttggaactaatcaaagagcccagcatggaggtgtgaaaggccctataaccacaaagcctgtagaggtgccaaggccacagtctccaacccaagagacaatgggctgtttccaaatggctgaggaccatgaatagatcagccccaaattaagcagtaaagtctaccctgcttctaagcgttcaggttctgtgttttccttccctgtgaacgacagaggggaaggaggcactggactgggggccagggcctgggttcccatcctgctctgcctctgacggctatgctccattgagccagtcgcagtttctgtgtgggacttgtacctcttagctttaaagagagtaattggaaagggcccttcttccttgagaattcactcttctatgatcccatatcacctatcagtgaaggaagaggtggaaagctttccaaagctgggcagcttcagatgggccacaggagagggtccctgtctgtggggaggtcaacactcccccaggatgccctcaagggaaaagggtgagaaaggaagagatgggtcatctaacatgctttaaatagaggctttttggaatgttccacatgagaacctttgctccatacttactaaaaggtgaggaagcctttttcggatgatttgctttgataagtctccaatgaaaagtcctgcctgaatttcaacactgcctctcaccctctccagggaccaggcctcttttgtgttttgcatacataccctcccgttggagctgagaggattacaatttgcaaagctgcatacctatgttctctgcttgcccttcccatcactttgggagggggcagtttttatccttcccaactgacagctaaaagagaaagaatggtccccagttcagatctgagtccactggcagccagccacactgtaaccccctctgtgctagggtggacactgaggaacttgtcagctatggagtcagcaagccttctatcctgtgaaaggtttagtgccatggcagctgctcggaagattgagaaaggtggcaacttcccagagagactgtggaaagaggagctggggtacttctatgacagtactccctgttgctatgggcagagtggctccagcctggagtgggtgaaatggctgcaccattaaccgggtcctgaagtcaactatggctggtgtctaggtcctctattatctgggattagcaacaccttgcctctgctcctgaagcacatcaaatcagtaagcggtggagttagtgcaaagcctgcttttatgaaatcagctgcaccctggttctgtctataccagctgctaaataagtataacatgttagtagaaaaagcagacccagcagggcgcagtggctcatgcttgtagtcccagcaccttggaaggtggaggcaggtggattgcttgagaccaggactttgagaccagcatggtcaatgtggtacaactttgtctctgctaaaaatacaaattagccaggtatggtggcacatgcctgtaatctcagctactcgggagactgaggcacgaaaattgcttgagcttggaggcagaggttgcagtgagccaagatcgcgccactgcattccagcctgggtgacagagcgggaccctgtctcaaaaaaaaaaaaaaaaaaaagaaaagaaaagaaaagaaaaatcagacccatcttatcctgcccaagaccttaatctgactaagaacaattcagcacttacagaatgaattacaaaactgtctgacaagcaagatttcacattcaagatattttctgtcaatgctgaaaacaaaatttctgatattagacttccagaattcccaagttattcatttaacacacaatcagtgtatgctagttgtgactaaacactgtgcttgctgattctagaaggttttacagtccggtggcataaacatggggctttgagaacatttgagtggaggaggtaagggaagacttcctggatatttgacgtttgagatgggtctcagagggaataagaacatctgtagagtagcagtttattctaattttgcgtgctccttcaaaataaagcccctaagcattgtctcaagtgcagttttgctcctcgtgggaggcaagaggtgacttcatgcccattcagaaagcttcttacaacctggcctgggagagagccaggaggggctcccagctgccgggctgaagcctcactcatcagaaaccaccaagttggtggtggtaaaggattttacagatgacaattgaaaggttttaaggaagagaattgcagaggcaagttggagtgccggtaattaggcttccagagcacaggaaggtctttgaacatgtacagagagtttgtcagccagagagagcaacttggaagttctgctgcttggatctgattgacagagataatgagagtggcagtgtctgtggagaggagctgcagtcttattgaaacatcagagcttgacttaacccactctgccctggtttctccactgctctgagttcctccacttccctctccccagtgcaaggtcgactaggcactacccacagcctgactcactaatgggaaatacatgtctgggggcagccgggagcaggccctgaaaatacaagggcaacaggaggggctctgcccacttcccagaggcgttctagtcactccacccagtcccagagagcacctggggtcagactacctgcacctgatccctacagaacctgtgtacctaccatttctcagtacaggtgaataaaggcaacccctcaccacacctcctccctgcctctttaattagatcccaggacgtttgcttacactggcctttgcaatggccaaaagagttgttgctgaactttcaaaatgagacagcagagagctctgggtaacagttgcctagactggtctccttgcccccagagctttacttttacttctctctggaaatgccatctgatttcattctaatcttcaatcttctcaatagccacttatctcatcctcttgtggaccaatgaaaggagcccagaattcacttctgttttcaactctgctcagtaggacaccctatgcctccaaccttaggccatatctttccatacaattcaaacctggtcattgtcatttacagccatcatcacatggccagaatgaaggtgcttttccactcctccttcctgttccccatacctgctagtgaggcaagtgtgacagagaatgatttcaaagtcccattagaagaccaaagctattttttgatataatgatattgtaatttgactaaattttattgctcagaaatttagaaaacacgcatatcctaaagaagagaataaaaatctccaaaggcattgtacttcaaagacttgagtggataaatgctactcatataccaatgaatgatctcagtatttttttctttgggctgaagggtaaaggacacttttttccctatgtgcaagaagcattaatgctcccagattatcagctcaagtaataacaacaaaattatttacaagaagtaacaaatggagtaaagtcccattttctaaacacaaacatggtagtgggttcccatggctatgctctaccctgaaaagtgagaaaagtccttggtgcttttcaaatactatcttcctggacctccaaaatgagcagtagtaactcccttctttgctgggaagacatctactaaaatagacacagccgtaatgacaccttctgtgtgatgaggattcatcctactactcatctgcgctgtgctcaacacgcatcacttcggtgtcatttaatctttgtaacaatctcatctgtgaagtttcaggaagtcaggtgactctcccaaggttctataggtaataagaaatggaacttggatttgaaaccagccttccaaggtctatgcactatgtagtactatcaccaacacagccaaatggacctgtgttcctagctgacctgcccagaaaggaggaatcagtggctgtttgatgtcctcttaaaaagaaagtaaacacaccaaacaaagagcaaatacaaaaacaaataccagaacagtcttcaaaaaaaaaaaaaaaaaaaaaaaaaatcggcccgtgcctgtaatcccagcactttgggaggccgaggcgggaggatcacggggtcaagagattgagaccatcctggccaacgtgctgaaaccctgtctctactaaaaatacaaaagtttgcagggcataatggtgcatgcctgtagtcccagctactcgggaggctgaggcaggagaattgcttgaacccaggaggtggaggttgcagtgatctgagattgtgccactgcactccagcatgagcaagagagcgagacaccatctcaaaaaaaaaaaaaaaaaaaaaaaagccaatgagatgccatgatgccatgcagtggagacaataagggaaacagaattgagttacattcggtctagagctcacaggcagaagactcagcatgtgcatgggtccccattctcttgatcccttgccaaaagaggttgggtcagctggtcacatcatggagctgcgctctctcagaaaggccctgactccagtgctccttcttgttccaggacaggtggtaaagctgtcttgtcagtgaggaaaattagtatctggggctctagcatctaatgatctgagcagagatgccattagtttaggggaccaccaggaacattaactgccctgcactggaagactttggggacccctggcatcatgagaggttgagtttggactctagctcctcctgctggccctacctaacctgcccttatgcaacccagaaggagctctaggggccattcaatgggtaatcccacttggagattctgtgactgggaccctcaatctagttacttggaaggaactggaaaagggtgcggggtttgtgagccaggctgatgggaatgatgcacagctgctcattctcatagattacttagtttagccccatgcccttgttgcatgccaagaagacagccgacacctccaggggctgttctccaggctgagattactatggcagctcaacagaggcctaggaaatacggcttttgaagtattcaaaacttaaaatcaagcaccgctgtgatttattcccagccctatcttttgctagatgtgtgcccctgggcaaattatttcactgctcatgcctccattttctcatggggaaatggggttaaaatggttgtcctcagaggatagcaggggaatttgattgacaacagtttagaggagaaaaaagattgtcagtgcaacacagtgttcaaaagtgagtactcccagtcactggatttttaaatatagcgataaaattgatgtggtttgtatgcttgattttcaccctattgaatgaaagaactaatacactttgattatctccaatgacttggttatcattttatctcatgtcctatctcatgtcctacatactatgcatagaaactgtaaaaactaaactaactgaaaatactcactttttgaccaatttataaagtatataaaaaagaaagaataatcagttgaaatgaatctcattattttttaagtagaggcaaaaacaccaaaaacaccctgaactccaaattatttcctttgttgtttaaaatgctttaactgtttattttaatataaaattaatgcaggattattatagaaaataaaaaattcaaacaagcaaagagaaacacatgaaaaatattcaggtttctgcctatccagaggcaactgctattaacaccatgctgtatatccttccaaggtcttttctatgcatgtctataatagttggtttttgttttttacaaagcaagattatactatttctgaagttatgcagccagctcttttacctgttacagtatgagcatatttccatctcaatagatggatttttgtagtattactttaaggcctacattgtattttaggccttctgttgcattatgggtgtaccataataaattcatatgtttagcacttgcgtcacttacaattatttttttaatgtaaaaagcacagtgtaggcataattgatttaaatgcatttgaagttagttaagatgtactggatgaaaaaacacaaagatctgaaaaacagacaatgtacttaacgttcctaaaatctttacaaaattactctctggcgtttgtgaaaattaccaaaatctgattgacggtattcattttggaccaccttgttattttgactgttgtcattgatttgaaccaattatttgtttaaccaagcccattcatgttgctgcctcatgaggaatatggcaaataatgcagaggaggcatctagagggtctctagcgtggagtaagtgctccatcaatgctaatccctttcctccctttctcttctcttccaaatgaaagaatgagtccaccacaagttttgaggacatcctttataaatagtgggttcactgggtttcccatgtgtcattgtttcatcactcctagtgccaccagcttccagtaaggcagaattgggccctatgtcttcttaaagagcggagatgctcaagctgttcactggctcattcttcaacaaacatttacagaggtccatgtgtgtcaggccctgcaccaggagctggggacataaagaagtactacaatgtggcccctgctttctaggagcccaatgtctagggggataaaccaagtgcacagaaaatccattacagcggaaggtgtgcaagcacagagcaagggcatctgagacagcctggatcagggaggctccatataaaggggataatttgtgagtgactggctggtggcagtcactcaatcacacctgttccctgtatgtcactgcaggtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgtgagtctagtgaaacggtgatccctaaatatggctggtttcatggtcaggggcatagccagcagcctctgaccatgatcatgttcgaattttttaaagagtatctagttgcagtgtgggccttatgttgaggagagcaacatgcatgaagaaagacaggagaacattgcaatgatcatgatagagaaaatagtgtcttaaatcaggataatggttgtggaaaaaagtaaacgagttttggggatttgagagacaaaatctttatgacttggtgaaggattggacatggatattgagggtgagggagatgtcaagatagcacccggatttctggtttggatacctgggtgtctgctttgaaaatgtgccagagaaggtcggcaatgggtctcactgctccattttttttttcaaatagctaaggatgaaactaggaaaaacaatgttaccaatatatctggggaggttgtgataaaatatgcatatttttaaaaggactacgtctttgaatggtgaggctcctaaattttggtttacaaaggagttgggagccttccgttcccttcagactgaacgctatgtcaacctgtctgtctgggttaactgaactgtgacagtgcccagaggcagagacactggccacctggatgtagaagtcatgctgatttaggattccatgaggaagaaaggttcagcccagggctccactataatcctcattccatcagggatgctgccttccatgaagtcagctgtcaggccagactggggcactgtccatgcatctctgcaatgtgtggtcacctgcccatctctgtctcaccaggccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagagtaagtgatgagaatctctctgtccagaccacacctaggggtcagtgctccttccctgctattgcagatggtgtgagtcctatttctggcctcatccctggagctccgtctctgtatagaccaggcctggacggggagcaccttggaaagatgaagggggatgtgagggtgggatggggaggtggagatccactctgggacccaaatgagagttcttcaaagttatagccatatgtcatttgcctaatcacccagagtctcttccccatttaagtttttaaactcaactcatcaaagagagcatccagatggaaagaacacagccatctagtactttaaataacagcaggaaaagcattgcactgattcagcaacagtctgagatatgtggggagcttgtccttatacttagatagcagttgtcaacaagcatgcatttccatcccccacaattatttaccagtctgtggctccctcaggagtttggaggaatacacaaaataaaattattcaaataagacgagagccagaaagagttttaaagatccatgtggtccagcatttcccccaagaatgttctgagaagcaccagttgtgggaaatgttaataggttctccttggaaaaaaggtcccactgtcaaataaatttgggaaatattgtgtactttatcaccctcttggagattcactgctcatattagcattataaaggccatgagaaatcctgaaataaaggaacccatttaaaattattaaataccatagaaccatatttttgaggggcagggttttatagaactgtagtctgggaaatatttatctggttccaccccttccattcagcagattctgaaattacatgacattggtcctcacaggtggcaaagctgggacacaagcctgcttttctggctgccagttcaatattctgctacctgtccaccccagggcctcagtggttcccaggctttgctgcacactggaatcacctgagggcctttaaaaaatattgatgcctggttctcactcccataccttctgattagttgtggtaagatctgagcataagggttttttaaagctcctcaggtgattctaatgtgcagcaaagtttgggaaccactggattaaggttggtaagggtaaaatttcaccttctacactcacagaagctcagataatcctaccttggaaattaactctacccttcaaacacacacacatacacacacaccggggggacttcatgggctccgtgggctacaacatgtaccgatagcacatattgtgggatctggcagcctgtagtacacatttcttatggtagaagattcattcatccatcagtctgcgaacacgtattgatcacctgttatacaatgggcacagtgcaaggtgctgggattccctccttgcagctgggacaaaccggttgctgagtcccaggaaagagcagtagtgatccacccctatagctgagcccccagggacagcttcctgacattccaacagttttcctgccaatattcctggagtccagctctacctctctgaggtctattttttttttttcagaaatgatggagccaccactttctccagggagatggtttgaatgtgtgtctagctttcgatccactgaacatcagaatacatttcttaaaaactagattaatttcctggtgatgccaaaaaaagatggttccttccattaagaatgactgtcaaatagacagcaaaaataaataaatagaaaagaagcacttaccagtgggaaaccagcttcctcatcttttagagtgaaaaattgatgcccctagataatcagagggactgagttcagggatagaaatgggtgtttatgaagactggctactcccattttcccactgtgatttgactgcctatgggggccattgtcacgtaatcccccaggatctaaaagaattctcttagtctgagaataatcaatgacaaagataaggggaagaccaaaaggaaagtgaaactataaattaagggatttcattcaaagtaaaacatgtccacacactattagagcaatttgatttgtttcttgagaggtaaaagatggaaaaagaaactgagcaacttaataaaatagattgtgggacaatctgtgaattcaaaattcaagcatgcttccctaaagtatttgccaaaaagacatgaacactttgagcatctcaaccagcagcatcccttgggagactgactaccagctgaaaagggcatggtgtgggagagccaaggcattgtggacagagatccagccaagcgttcaccagggtgtgatgtgcagtgtacaaagcaatcagctgtgctgggttcagggggctttagaggaaatacagtcaggaccttggaagagttctgccagcatccctgcatgggtgctgagaaccaacttctcttgtatttgaacactagctccaccactgcttacctactgtgtgaccttgagcacattacttaatttctctgagccctacttgccttgtttataaataatttataaattattataaataataatgcccatctcattagtgtttgtgatgggaggttaatggaatggcacatgcaaagtacttgatccattatctacccatagcatgcacacaaaaaaattgttactgttaaatttttttttctgtccatagcttaattttattttatttttattttttaatattttttatttattttttattattatactttaagttttacggtacatgtgcacattgtgcaggttagttacatatgtatacatgtgccatgctggtgcgctgcacccactaactcgtcatctagcataaggtatatctcccaatgctatccctcccccctccccccaccccaccacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctcaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtgaaagatcagatagtcgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattacctggggcagtatggccattttcacaatattgattcttcctacccatgagcatggaatggtcttccatttgtttgtatccttttttatttccttgagcagtggtgtgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccacaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagcgtttttagcatgaagggttgttgaattttgtcaaaggccttttctgcatctattgagataatcatgtggtttttgtctttggctctgtttatatgctggattacatttattgatttgcgtatattgaaccagccttgcatcccaaggatgaagcccacttgatcatggtgaataagctttttgatgtgctgctggattcggtttgccagtattttattgaagattttagcatcaatgttcatcagggatattggtctaaaattctcttttttttgtgtgtgtctctgcctggctttggtatcagaatgatgctggcctcataaaatgagttagggaggattccctctttttctattgattggaatagtttcagaaggaatggtaccaattcctccttgtacctctgatagaattcggctgtgaatccatctggtcctggactctttttggttggtaagctattgattattgccacaatttcagatcctgttattggtctattcagagattcaacttcttcctggtttagtcttgggagagtgcatgtgtcaaggaatttatccatttcttcttgattttctagtttatttgcgtagaggtgtttgtagtattctctgatggtagtttgtatttctgtgggatcggtggtgatatcccctttatcattttttattgtgtctatttgattcctctctctttttttattagtcttgctagcggtctatcaattttgttgatcctttcaaaaaaccagctcctggattcattaattttttgaagggttttttatgtctctatttccttcagttctgctctgattttagttatttcttgccttctgctagcttttgaatgtgtttgctcttgcttttctagttcttttaattgtgatgtttgttagggtgtcaattttggatctttcctgctttctcttgtgggcatttagtgctataaatttccctctacacactgctttgaatgcatcccagagattctggtatgttgtgtctttgtttccgttggtttcaaagaacatctttatttctgcctacatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaagtgtttattctgttgacttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttcttttgttttccatttgcttggtagatcttcctccatccttttattttgagcctatgtgtgtctttgcacatgagatgggtttcctgaatacagcacactgatgggtcttgactctttatccaatttgccagtctgtgtcttttaattggagcatttagtccatttacgtttaaagttaatattgttatgtgtgaatttgattctgtcattatgatgttagctggttattttgcttgttagttgatgcagtttcttcctagtctcaatggtctttacattttggcatgattttgcagcagctggtactggttgttcctttccatatttagcgcttccttcaggagctcttgtagggcaggtctggtggtgacaaaatctctcagcatttgcttgtctgtaaagtattttatttctccttcccttatgaagcttagtttggctggatatgaaattctgggttgaaaattcttttctttaagaatgttgaatattggcccccactctcttctgacttgtagggtttctgccgagagatctgctgttagtctgatgggcttccctttgagggtaacccgacctttctctctggctgcccttaacattttttcctgcatttcaactttggtgaatctgacaattatgtcttggagttgctcttctcgaggagtatctttgtggcgttctctgtatttcctgaatctgaacgttggcctgccttgccagattggggaagttctcctggataatatcctgcagcgtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgattgcattggctcctgaggcttctgcattcttcacgtagttctcgagccttggttttcagctccatcagctcctttaagcacttctctgtattggttattctagttatacattcttctaaatttttttcaaaggtttcaacttctttgcctttggtttgaatgtcctcccgtagctcagagtaatttgatcgtctgaagccttcttctctcaactcgtcaaagtcattctccatccagctttgttccgttgctggtgaggaactgcgttcctttggaggaggagaggcgctctgctttttaaagtttccaccttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccatgtgaggtgtcagtgtgcccctgctggggggtgcctcccagttaggttgctgggggggtcaggggtcagggacccacctgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgggctccacccagttcgagcttcccggctgctttgtttacctaagcaagcctgggcaatggtgggcgcccctcccccagcctggctgctgccttgcagtttgatctcagactgctgtgctagcaatcagggagactccgtgggcataggaccctccgagccaggtgtgggatataatctcgtggtgcgccgtgttttaagcctgtcggaaaagtgcagtattcgggtgggagtgacccgattttccaggtgccgtccatcacccttttctttgactaggaaagggaactccctgaccccttgcgcttcccaagtgaggcaatgcctcaccctgcttcggctcgtgcacgcacccactgacctgcacccactgtctggcactccctagtgagatgaacccggtacctcagatggaaatgcagaaatcacccgtcttctgcgtcgctcacgctgggagctgtagactggagctgttcctattcggccatcttggctcctccaatcactgttaattaaatttttatcatcattgtgtttgcagtggtttctctatttttatgaaatgctttcacataggtttaaatgagatagtgtatggcacgtgggatgcattcaagcagtgttatgtattattattaacctaggaagaatgcatgggtctagcacaggtcaactataagccatgaacttgttcttattaatccaattcagtgctctatcctggacatattccttgggttcctgattgggcagatattttagttattttgagcccactcttcttaaaaatgcatacattaaaattcacatggaggcagcaaatggaaactcaggggaaaacatcagaagaccaggtgagccccacatcttttcagtctcagtgggtgatcactaatttaggcagaaaactccacagaataactgaagccccgtatagtgtgcacttggagtgttaaaaaatagcagaggaaaattccagtccatctgagggtcaggagacaatgaaggggctgccttagagcccgtacataaggaacacacccctggaacaaggcacagcactcccaggattgcctaagctggaggaagcattagagaagaaggagaaagtgagcaggaaaatctctaattggaagtttgccaaaaatttgggtaaacttaagctagttggatttttgtagcatggctacttcccaagaacatggctttagtgatgagttttgatctgcgaaaagctaacctaacactaaagtgacttcttttctggctctttcctcctagagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaatggtgtcagagtgtgtatccctggatcccagagggttgtccccaaatttcaggagaatccttaacaactgtccttcttctttctaatgtgggagggagggaacacatccttgaccccatgaatgccaagaagcagaatgtagtaaactctctggcactgacgtgatccaaaggaaaaactgaataaataaggcttaagaagtcgctggcaaataaacataaacaatcaccatgaatacactatcaaccctgattttagtttacgcactgcatttgagaagtccacatccaggccaattttgtaaatgtagactgcttgctgtggtttatctatgaacatgcagttgggagtgaagagatatgaggcagtgaaaggtgttatggttgccaagtagctcatttaatacatgcttacactgataatagccttttcccctagtcattgttaactttgatatggggtggttcttaccttctaaaatcaccggccaagattccccgaacaattaaccccttcaaagtggtccacaagcctgggggtacagcattaattcagtggagctcatcttaaatcaccatccatggctgaacccctggagaatggaagtggatggacagaactcctctcagcaagtttgcctgaggctgcaaaggaccccaatccaaccatgcaggtagaagagaaaatttccctttattaattgcttaccaattccatgcacaatttactaattaccccaaagaccccgatccatgagtatcatacaagtctaggcaatttggctaatctattctcaattttccacaggaatgaattttaatctgtcactaaagtcctctggcagaatctttaaccccgaattctcactaccgcctccaccaatgccaactcatcttctggttgtggacaaagcagggtcaaggtgaaagtcctgttaaaccctttggcttggtttcaccatagatcccagaatggagacagcaagaatccaaagtgcacaagaggaaagcatgaggggtcagcagagccaaggccagggtgcctcgaggcacagttttcagtgaggtgggcacgaccaagatctggacacccccaacccccacagatgccctgcacaaggccccacccctacacccgggatgaactacaggaacacatgaagcatgaagggaaggagatgtgtcactagtgagtgagacctcacacattacctctgcagcactgggccagtcatgaacctctctgagcctcagtttcctcatctgtgtaataggaaaataatacctaccttcaatgaagagtacctaacattcctgagtaggttctctatgccaggcacttatctaa

SEQ ID NO: 14044 - DNA, 4412 bp, Human
actcaggaattcaagaccagcttgggcaacataatgacagcccatctctacaaaaaaattaaaaatttaaaaattagctggatgtggtcccagctacttgggaggctgaggtaagaggggcctgggcaacagagcaagatgaaaaaaggagggaaaggaggggaggggaagggagaagaaaaaaaggaagggagggagggagtgaggaagggagggaaggagaaaggaagggagggaaggagaaaggaagggagggaaggagaaaggaagggagggaaggagaaaggaagggagggagtgaggaagggagggaaggagaaaggaagggagggagggagaaaggaaggaagcaagcatagggcccacctctgcttctggtgagggcctctggctgcttctgctcatggtggaaggtgaaggggaacccatgtatgtgcagaggtcacagggctgccgcgagagaggacgccagagagagaggggagaggggtgccaggctcttttcaacaccagctcttcagggaaccaacagagtgaaaactcaccctaaaggagggcaggactctattcagagggtgacaccccaggacccacacacctcccactggcccccccctccctgggctccaactttagggatcaaatttcaacttgagagttggaggagatttggaagcttccacctcccgtccttgatgataagaacgttcccttgcttttactataaggagaacatctttcatatgggaatttcatctcttgtatttaagaaacaacaagaaattcagaatgatcttcctacacctgcttcttcttttttttttttaagtgcctttatctcaaaatagacaatatgccagaaaggcacatctttaccttcttcagaatcctaaggctcatctaagccgtacaggtaagggagttctttgcaggtcataaaaagtgggagattcctttaactctggctgcatcccagagctttgtcactgtgtaaaagtggaatgccggccgggcacgctggctcacgcctgtaatcccaacactttgggaggccgaggcgggcggatcacgaggtcaggagatcgagaccatcctggctaacatggtgaaaccccgtctctactaaaaatacaaaacaaaattagccaggcatgatggcgggcacctgtagtcccagctactctgtaggctgaggcaggagaatggcgtgaacccgggaggcggagcttgcagtgagctgggattgcgccactgcactccagcctgggcgacagagagagactccgtctcaaaaaaaaaaaaaaaaaaagtgaaatgccagctgggcctggtggctcatgcctgtaatcccagcactttgggaggccgaggcgggtggatcacctgaggtcaggagttcgagaccagcctggccaatatggtgaaaccccatctctattaaaaacacaaaaaattagccaggcatggtggcggacacctgtaatccctgtaattccagttactcgggaggctgaggcaggagaatcgcttgaacctgggaggtggaggttgcagtgagcagagatcacgctattgcactccagcctgggcaacaagagtgaaactccatctcaaaaaataaaaaaataaattaattttttaaaaaagtggaatgccatgtgctggcttctggaaggctcttgccacccaagtcatggggaagggagaagaggagcgctgagaagacatgaggaagcttgtgctggagagagatgatccccaccaccgcggcctacccgcatcaacccttcacaatgctggtgccagctctggtggccacgaccaacaggcatgaatataagggagaggcgcccgagtggagttccctgtgggccaatcagagagcagtgggccatcacgccacctgaggccagccaatgggaacgcggcaagctctataaaagcgagcaatccgctgaggtctgggcagaggacgccgcggggccaacagtttcggattcatggcccgaaccaagcagactgcgcgcaagtcaacgggtggcaaggcgccgcgcaagcagctggccaccaaggtggctcgcaagagcgcacctgccactggcggcgtgaagaagccgcaccgctaccggcccggcacggtggcgcttcgcgagatccgccgctaccagaagtccactgagctgctaatccgcaagttgcccttccagcggctgatgcgcgagatcgctcaggactttaagaccgacctgcgcttccagagctcggccgtgatggcgctgcaggaggcgtgcgagtcttacctggtggggctgtttgaggacaccaacctgtgtgtcatccatgccaaacgggtcaccatcatgcctaaggacatccagctggcacgccgtatccgcggggagcgggcctaggagggctatctcgccacctgagaggttgcgcaacgttcaccccaaaggctcttttaagagccacccacctggtcgaagagttgctgtagcaagctagtctcttgggtttcggggggttccttccgctggcctgtgctggcttacctacttctgattagggtgggaggctggcgaatcctgtgttcaccctgtccagttaggaggccagctactcacacgcgttacctctcagcctgtctccagtcacaaatccagctagtagtgtgtggggctaacttggcctatccgtttagataagaatcatggttggtctgttttggggacggggtgttgagggtagcctaattggtctatctccagttaggtaagcaaccccagctagttgtgtcaactcagcctatctacagttaggttggaaggctggctggtcttgtgtgttctcagctcagcctctttcaaattaggttagaagtcctgcgtgtgtgtgtgtgtgtgtacacgcagcttgtttccagtgaggttaccagtccagctagtcttctgccttgacagcccatctcctgttaaggccagcaagtagtatgtattatcttggcctattttaagttagaagtccagctacttcaccagcatagcagcttacgcctgtaatcccagcactttgggaggccgaggcgggtgtatcacctgaggtcaggagttccagaccagcctggccaacatggtgaaaccccatctctaaaattagccgggtttggtggcgcatacctgtaatcccagctacttgggaggctgaggcaggagaactgcttgaacccagggggcggaggttgcagtgagccaagatcatgccactgcactgcagcgtgggcaacagaacgagactcaatctcaaaaaaaaaaacaaaaaaaagtccagctacttgtgtgttttaactcagcctacctcctgttaatttagaaggctggctagttgtgtatctttttaacttgggctatctcccattaggttagaaggctggctaggggtgtgtgtgtgtgcacgtgcacccatgtgcacacatatgtagctgtggtgttggcccatctcgggttagaagtccatctcattgtatgtgttaacatacccaatctcccattcagttaaaaggctggctagtcatgtatgttgtaaattcaccctgtcttctgttagggtagatgactagctagttgtgtgtgagaagcccagctaggcatgtgcattgttaattcctaagtgaaatcaatactgggaaaccccagcccaaagttcaaagagggcactctgccctggaagtcagtttactgagcagtcgcagacaggcgtggcccatgtgcccagcactttgaaacaggcttcccagcgccacaaagtagtctggcagtgctctggggatgagagacacagagaccaacttgctgagaaatcctacagctagggcagcaggccacagatccaatagtagacttatgtcaggaaaacctgaggatggctgtgaggataaggatgtagggattgtctccctctggtacaggttggaatcatttatttgtgaaaggctttattaaattgaatgaggccaagcactaccccatgctgggatcatggagggaataaaatccatttcctgtggctgctgcccactctgctttcaaggtgcttatgcttgagtgaagggggcctgtattgtgtgtagaagcaatgatagtaaaaggtgctcttatacatagcaagggatgtgcataaagtgctatcaataggcaacagtggattttataagtctctttgaacccaatttatagcctgttgactcaaaattcaaaagcttcatcaatttattagtacacacacaactgaacatcataccctttaaatctcaggatgtatttaaacttatgagtgccagatccttggagggctatccagaaagcctagaatattcagggacagctatgttctggttttgaaagtcagctctg

SEQ ID NO: 14045 - DNA, 26104 bp, Human
  misc_feature (1)...(26104): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggtggggagggtttctctgtccgagggtgaatcatcagaggctatatgtgtgtgatttctccgatgctgagtgcaggccgtttctgccttctctgaccctgatagagatgtgtgtttgtgttcaggtgtggcctggcatggtgggcccacaatggactttggccttgccctccaccagcacgctgtttgggccctgacccctcagcttgtgtttctgtatcagcatgacagggacaagggcacctgccttagggggacatgttcgaggctgagaggggatgctgggcagaccccagcagatgggacggcttttttcctggggcagtgttcagcctggggaaggggcaggatgggcctctggagaagggtctgcaggccgggcagactggctggtacagggactgcctgcaagcccagaccagactcttcctgccccaagtggccgaacccaggaactgttcttgtcttgggagcagggactggcactgggctgggtgcagccatggcttcccttgtgtgtccaaacactaccccaggggacaagtcccagtcaaggccacacagcagggccggggattggtgctcctccacgtgtctggtggcaggagccccgtcctgtctcacaggtgaggcacaggcaggcaaagcctcccatgggcgtatgaggcagctcagcaggggcgagggggcaggagattcagccacagtctctcccgcgctcatggtgtcacagaggaggagacggggcttgggtgccaagggggtgctgcagccaggggacaagacctgagggctccccccatgttgtcccctccttgtggactatttgagcgcccttcatgtgtcagtctaactgtgaggagctcatgccaaagcccaggcattagtttaggaagggccaactctgttgacagagggtctggggtcagcctggaatgcaatggcctctgatgtgatgccgccctgcactgagcctggccgggaccagcgcagtccgtccatccgcctgcctgcccctggctgtccgtcctcccagacagggctggagctttgcccagctgggctgcaggggcacagccaaagtcaggctggtgtgacccatgacaggcttgttgggggccagtgcttctgatctgtgagcccctgggacacaagcctacctgattcacagctgcagcaaatggagactcacgtggagtccatgtcctttgtggggggatgctgagagggggtcgccaaggaggggcgccagagttgcgcgtggctgcccaagcccctcttgttgcattttacctcatagggtgtcgcaggccaggtctgtccatttggtggtggggaaagtgagtcatggtccagacaaaccactttccaggggtcacacgattggggtgggggccctgcatctgggcaggtgctgagcactgtcctcagacagcagtgctgttgctgctgaaaacggcccctggccccatgcccacccgcataggtgcctgagtcccctctctacgcagtgtgtgttgctgaggatgggctgcctgtcccgtcactggctgaagagcaggggtgtgttttagggaaaagggccagcacattcctgttgtgagggttgcactgtggggactcatgcaggaagatgcaggctggggacctgtcctgccgaggacctcccagtgacaccccctccccctccacgcagcacatctccatcccccagcctgactgccccgcagaggcgcggacgttctccttctacctctccaacatcggccgcgacaacccccagggcagcttcgactgcatccagcagtatgtctccaggtgaggcgccgccccaccccagagcaccccgccggctcttgaggtcaccctgccacctctggcccagggttgagatgtgccccattgaaaccatattgcctgagatggtgttgacagagtccattttccaggccaggtggtgggctgggggcttgggccctcaacggatcctccctgcattgtcccagctgctgaccccagctcctggccttgtcttgcagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggtgagcagtgggtttggcagggctgtagggcagccgggcagctgccagtgtcgggagacatttggggcctgtccaggctgggcactggctgtgccctgcacagaaatgatgggtcaaccgaggagtcggtccctgagcaggacgtgcctggaccagagtctgggttgggaagagaggtatggccacatgggcctgggggctatgtgagggatagggggttgggttatggcagctgctggcttgtgaagcctgaggtggacaaaggggcctgagaactccaggagctgtgagttggtggtccctgctttcaggctgcagccttggggaccttcacctgtcagggagatcaacaggctccctgaagatgggcatgcagcctagggcaaggcccatgtctgtctctggaggctgcccccaccctcacctgaccagccagctcctgcccaacgccaccacagccggcaacaggcaggaaatgagcctcacaggccctgttgccagcgacccagcactgcaggaaagctctggccactcagcatcaacttggaaacggtttcagcagttgagaagccaacaggccttgacagtgggaagcacagtgctgtttgtttacagagctgcagcaccccgcctcttagtccaggcagagctccaggagtcatgggaactcattacggcaggagtagggtgccgggcttcagggaggagggagatggctcagagcagacgacagccttgatggctttttgagttttatctttaagaaaaggcgggggcatttcaattcctctctctcctccttccgaagaaagcacgtgatttccctttgctgagcagaggggttccctctgagtgaaaccccagatgtgggtgcaggggttggtcttcctggtcaacactgagtccgggtggacatgtatggccagggagcccgggttgtccatgatgttgaggccctgggctgtaagccccaagcacagggctgctgtggggagaacagttgaagagacagcgtgttttgttttttgttttttctttttttaaagacaggacctttctctgtcactcaggctggagtgcggtggcacaatcatagctcactgcagcctcaaactcctaggctcaagtgatcctacctcagcctccagagtagctgggaccacaggtgtgtgccaccacacatggctaacttttagattttttgtagagacagagcctcgctatgttgcacaggctggtgtctgactcctgggctcaaatgatcctttcgcctgggcctcccacaatgctgggattacaggcatgagtcagcgcacctggccccatatacatgttaataaatctgtgggtccttcagccaaaaacttgatcagaaatgtatcttagcacaccactttgggtacagtgagggtttttttttttttgagatggagtcgcggtctgtcgcccaggctggagtgcagtggcgcgatctcggctcactgcaacctccgcctcccgggttcacgccattctcctgcctcagcctcccgagtagctgggactacaggtgcctgccaccacgcccggctaattttctttttttttgtatttttaatagagacggggtttcaccgtgttagccaggacggtctcgatctcctgacctcgtaatccgcccacctcagcatcccaaagtgctgggattacaggtgtgagccaccgcccctggcccagtgagggtttttgaaacagtttatgttctggtaggggtctgctgtctgtttagatgtgaatgtggccagatgcattggctcacacctgtaatctcagcactttgagagtccaaggcagggagatcacaaggtcaggagttcgagaccagcctggccaatatggtgaaaccccatctctactaaaaatacaaaaattagccagttgtggtggcgtgcgcctggagtcccagctactcgggaggctgaggcaggagaatctcttgaacctggaaggcggaggttgcagtgagctgagattgtgccattgcactccagcctgcgcaacagagtgagactctgtctcaaaaaaaaaaaaaaaaaaaaaaaaaaagatgtgaatgtgcgtgttcctctgtctcacagtgcccccctcaggttgctcctcctccctgtcaatcagcctggccctatatgggtgagtccagccctgctgtcaggaccccactgaacagaccccagaggtgtgagcactggccctgggtattctgaaagcaaggctttctgggttaatttgacagatcagattttgagagataagatcagagtgatgttgttacgaagagcttttgggggaaggatttgaggcactgttgagcttgctcggccgaccctgttcccaaggatgccggggcatcattgttcaggacagagcaggggagcagcgtgctggaccctgcccacgtctctgcgttggggatagaggggaacctgctctccccagggctctgggcacagccacgcctgccagaggagagcttgaccaggcctaaggctggggtgccacttgcacctcagggtcttcagagcagctgctgaaagtggctccgacatctttactgactttagaaaaacaaaaatggcagccacatggggccagcataggactctgaagtgcaggcttgggagtgactgcctcttgcagttcagggacccccagtttaacatcagaagggtttacaaacagcccctgcctcaggttgggcaggatggctctggtttataataccagcactttggaaagctgaggtgggagggtcctttgggcccatgagtttgagaccagtctgggcagcatagtgagaccccatctctacaaataatataaattagccaggcatggtggtgcacacctgtggtcccagctactccagaggctgaggtgggaggatcgcttgagcccagaagtttggggctgcaatgagccatgattgtattacactccagcctgggtgacagagcaggatcctgtctcaaaaaacaaaacaatccttccccccccgccccccgcccaaacacacacacacacacacacacacacacagcccactagagtgatcaggtgatttcatacacgcacacacacattgcccaccagagtgatcaggtgatttctcacacacacacactgcccaccagagtgatcaggtgattacatacacacacacacacacacacacacacacacacacacacacactgcccaccagagtgagagtgatcaggtgattttgctgtccaggatttaggttgcctgtgatgaagtaagtaaggctctaacacagttctgccgcctgcacctcccacttctgaggctgggtgccctgcaggtgcctgccttgggcagcaggtggcgctcttggtcgcccagggtccccaaggagcaagctggcttttgctgtggttggtgtggtgcctcccaccagcactgtctatagtctcaaacctctgggcacctggtcagcagcactggcttaggacacggcagcgccctctctgttccctaaagcttggattcttgttgcaggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtgggtgccgccccgatgtcttgtctttaccagtggtctccgcagatggtcttgtgcgggtgggatgggccagagcatggagactgggattgggactggcaaggaagagcccttcctggggtctctcacaggttcagaacctgcctgagagccagggcctcctggattagaacaagcttagggggccatggatgcgtttctgggcatggccccgactgtccagggttgagaggtggactcagcatggagcccaggccctccttcactgtctgctgacacacgggccgtggggcctggcacagtggattcaggcttcagttgcagacgatttgtggactcaaggcctggggaaggaatctacacgtgcctggcagagcctggcaggcctcagtgtgaatcagctgcctgccgccctccacctgcgcctccgggtgaggggcttcacgtctcagaccatcaggcttccatctgtgacctgcagtgcccctccctggggttggaggctaggccatctggaatgtggtgctggcgagtggagcctgctcttgagaaacaccccgggcattggagcaggtgcgatggccctgactgccttccacccccctcacccatggaggttcctgaggctccaccttggcttcctggggtccctgggaaggggagtgactcgcactggcttcagaacattagccaggctatgcagatgcagccttgaggtgaactgaggatgggtctcctcggatcgctgctgtggtggaggaagagacatggctgagcctcttgcaccttttaggatgatggaagtgggatgttcggggtcacatccagcacctcaggaacacaggtgatgcctgcagcaaaaagcacatgctgtggcatgccgggatagcagctgtataaaggacgttcttccatgtttacggagctcctcataggcgtccctctcgggtgcgcggctggtgggaccctgttccacattccttgggaggatgtcagcctggccctcgtccacccccatcctgctcccaaggctagggctggcatggtgccagcaggagttgctgaagggagctcgatggagtcatcagatgtgggacctgcattggcctggccaggaggtgtctgtgctggtgcctggcttctccaggtgactttggttcagtgcctcctgggagcaggcctggccagcatctgcaggcagattgtcccttcctgtgccactgtgacttcccctggacagctcgtctgcttcttgcttctatattcattatgcagctgcttccccccaagcagctgtgggggtcagcaggacactgttggcttgtagaagaggagggggatgtgcctcacccagactggtcatttccagcccctcacaggccctcagacatgctgaggaatggcagtgacaaaactgcatgcctcaaaggtgcttggccctccctctgtggaaaaatctagagcagagatggaaggtgtccacctctaggactggctgagccccagggaaacccgcaagcctatccttcaaggggaggggtgttgacggctgagtaatatttagcaaagcctgtcatgagccataaaaatattcagcctttgacctactaatctggcttctgggaatcccgtcgaaggaaactgttgccaacctgaaaaaaactgcacacagtaatgtctgtttatgctacagagaaactggcagcagtttgggggtgggatattactcaactgttaaaaatgctccccatgggctgggcgcggtggctcacgcctgtaatcccagcactttgggaggccgaggcaagtggattacgaggtcaggagatcgagaccatcctggctaacatggtgaaaccccatctctactaaaaatacacacacaaaaaaattagccgggcgtggtggcgggtgcctgtagtcccagctactccagaggctgaggctggagaatggcgtgaacccgggaggcggagcttgcagtgagccaagatagcgccattgcactctagcctgggcaactgagcgagactccatctcaaaaaaaaaaaaaaaatgctccccatgggatacgctgtgacgcagagccatgtcagatgcagcagaaaacagtgactgctatgcctgcagcaagatggagaccagagtgccctgtaggccagcacgcagcacccactcagggcagtgacctggagcttcctcagatccctctaaggcagacgttctgaatccatctttgttagcagtctgggagacgaacttagctttggtcaaccggcaacagcaaggcaggctggttgtagggaaggtgggctcagacgtggccccagaggtacccctcacccagcatccccagccgtggctgactcttccctgggagttgtgatcagaaatggggtggagcccagcgcggtggctcacgcctgtttccagcactttgggaggctgaggtgggaggatccttgaggccaggagctcgagaccagcctatgcaaaatactgagatcctatctatacaaaaaattagctgggtatgatagtgcatgcttatagcccacctacttgggagactgaggcaagaggatcgcttgagcccaggagtttgcagctacagtgaaccttgatcacaccactgcactccagcctggaagaaataggagccaggtgtggtggctggaatcccagcacattgggaggctgagatcagaggatcgcttgagcccaggggttcaagacaagcctggacaacatagcgagatcccatctcttaaaaaaaattagctggagtatagtggtgcacacctgtggccccacctacctgggaggctgacgtgggagggtcgcttgagcacaggaggtctaggctatagtgagctaagatcttgtatcaaaaaaggaaaaaaagcaggctagaggggccagggggcaggtgatggggtctcagtactgcaggtggtagccctcccctttttggagccagcctggccccagcacctctaagacagttgagtctggacctgccttcatgaccctcattatcccttctgcaccctgaggattgtgtgcgggggaactgggggtgggagacatcacggatcggtagtgggccatcctctttcctctcctctgtctctgtctgtctcccactgtctctgcacaccctcccaaacccactatcagatcttttttctctagtcccccgtctctctcaggattcccacaaagtgatggctggctctgtcttgcaggtggccaacatgagtgctaaggacggcacgtgtacactgcaggactgcatgtacaaggatgtgcagaaggactggcctggctactcggagggggaccagcagctgctgaagcgggtgctcgtccggtaatgccgcctcccatcccccagcatgtccccacccgcatgaaggcagccagagcttacccagaggatgctggggtggtcttgtgtggtcctgaaggccacagggcttgggagcaggatggaagggtccaagtaggcctctctggccatcctccctactgcccacgtggtgccccagggtgtcccgtggtgggggaaggccacgctcacagagtgggacggaggtgtgagtcactggccccgaccttggaatcttcagacaaaaggcctcagtctgctgagaccctcctcagctgtccccaacttcccttcatgcttccctccacaacctgggcatccccacagggcctgggaagttcactgactttttgaaaagagcctctcaagaacctgaagtagagagaaataaggccaaacgacactcccggcagggcaggcgtcattaagcagcgttaattaaatgcatcccctcaggctaattgggacccagggtcagaagtggcagcagctcaggggagcagtggttaaggaggcaggcggctaatgacttccttctccactgctgccagctaggggagctcgggctgtgaagcaggtcaatctgctaattagtccgtaagtgatttctcagggactcggaggtatttatgagtttgtagttgttttttggaagttcagctgtttaaagcagtaattgcctctggaaagcagaatgaagttgggggtccactctgctcccctgagagggtagtgcctgcctgtccaccctgggtgtgcaggtcaggggcctgcggggcactgccctggcttggcggcaggctggcggagggcacagtcttggcagaagacccgcccccatcctcataccctgtgtcctctcccttggccccctgggttcctcagacccttagggcactggaaggagaactgcccagagctagtggagtgaggtggagaaggctgggctgcacctctggggcgtcggggagcttccccgggatgcaggctccagagccgcctccagctcccctgattcaaggctcatgttccgtctgctgagtgagcttgctgggctcatgccagccccttggcactctgctttcactctgggccggcatggggatcagcactgccttcacaagcttccactagcgtgcagggggcagggttgatgtccctgggccataaccacatagaaggtgacctgcggtgcccctctgcatagctgtttttttttttttttcctatttagcaccccatccctaagaaagccccatttatagcagtttttgacaccatggcttcgtgtatatcaaagcagggccttggagtatttgttaccagctgggctagcccagtgcaggccgttagcctagtgcaggccgtgagacagatgggatgtgggggcccaagtcactgcaggagcctccccagctgagctggcaccacatgtggcttttgggggtggtttctccactcatgttctctttgttcatgatgtccaaacccgatctgtccctggtatccaaatctcctctcatcactgtccatgggtcaggggtcctgcaggtccccccaagagttcctgattcctctgcccaagccacacactgcctggtgcccttacctccaacctgagccactcccctctcctgtgagccccatgccagagtctatatactcctccttcctgctcctccctggtgccaagggagcacagctcctggagcacctctctgaggacagggctccaggaggactgctggccacatcttcatgcccagacgatggtcctgctgagccggcggttgatcacatctagacttgtagagtccaagatgctttccctccacgttgaaggtcagaggcttcccaccccaaccctgtgctggtccacagagccaggggctggccaggtacctactctgggatggtgggcaccacggcccccgcaggctgaaaacttgccttatccgtctatccgtccttctgtcctgtgtgtggtagtggaaaggcctatcctactgcacaccacctcaaactgctcttggcaggctgctagagtctgtcctcctcttcctggttttcatctcttttttttttttttgtgatggagttttgctcttgttgcccaggctggagtgcaatggcgcgatctcggctcacagcaacgtccgtctcctgggttcaagccattctcctgcctcagcatccagagtagctgggattacaggcatgcgcaccatgcccggctaattttgtatttttagtagagatggggtttctccatgttggtcaggctggtctcaaactccggatctcaggtgatccgcccacctcagcctcccaaagtgctgggattacaggcgtgagccaccgcgcccagctggttttcatctcttgctcttttttattctccttttaggagacttctttgacatttctcatcctgtctcttaatttactattatttgtagtttctttttttttcttgagacagagtgttgctctgttgcctaggcaaagagatggggtttcaccatgttctccagactggtcttgaactcctgacctcaagtgatctgcctgcctcagccacccaaagcactgggattacacgtgtgagccaccatgcaaggcctattatttctagtttctaagagtcttccccattgcgttttcgtaggagcatgttcttttttttttttttttcctgagacagagtcttgctctgtcacgcaggctggagtgcagtggcatgatctcggctcactgcaacctccgcctcctgggttcaagcaattctgtgcctcagcttcccgagtagctgggattacaggtgcccgccaccacgcctggctaatttttgtatttttagtagagatggggtttcaccatcttggccaggctggtctggaactcctgacctcatgatccacccgcctcggcctcccaaagtgctgggattacaggcgtgatccactgtgcctggcctaactcatcatgttcttatttaatggaaaggatgtctttttctttctttctttctttttttttttttttggagagggactctcaccctatcgcccaacctggagtgcagtggcgcaatcttggctcactgcaacctctgcctccccggttcaagcaattctcctgcctcagcctcctgagtagctgggattacaggcatgcaccaccatgcccggctaattttttgtatttttagtagatctggggtttcaccatgttggccaggcttgtctcaaactcctgacctcaagggcctcagccttccaaagtgctgggtttacaggtgtgagccaccgtgcccagccaggatgccttttttttttttttttttgagactgagtctcactctgttgcccaggctggagtgcagtggcgcaatctctgctcactgcaacatctgcctcccaggttcaagtgattcgcctacctcagcttcccgagtagctgggattacaggcgcctgccaccacgaccggctaattttgtatttttaagtagagacagggtttcaccatgcaggccaggctggtcgggaactcccaacctcaggtaatctgcccatctcagcctcccaaagtactgggattacaggcatgagccattatgcccagcccaggatgtcatttttaacctactctaaggatgtttattttatttatttctttatttattttgagacggagtcttgctcgtcacccaggctggagtgcagtggcgcgatctcggctcactgctagctccgcctcctgggttgacaccattctcctgcctcagcctcgcgagtagctgggactacaggcgcccgccaccatgcccggctaattttttgtatttttagtagagatgaggtttcaccgtgttagccaggatggtctcgatctcctgacctcgtgatccacctgcctcggcctcccaaagtgctgggattacaggcgtgagccaccgggcccggcctctaaggatgttttttaaagaataacagctttattcagatacagttcatgtaacacaagtcatccatttaaagtgagcagctcagtaacattttgtacgttcataatattgtgcagccaccacctctgtctagttccagaaaattttcatttccccaaaaggaaaccctatccccatcaggagtcattctccccattccctcccatgctcccagcccctggtaactactaatctgctttctgtctctattgatttgcctgttgtggacatttcagatcaatggaattatacgctgtgtggctgacatgtaatctgtggaaacctgtagctgtgaggaatgttgaatcaggaccgggcgtggtggctcatgcctataatgtcagcactttgggaggcttaggtgggaggattgcttgagcccaagcctgggctcaagttctagacaagcctgggcaacatagtgagaccctcatctctacaaaaaatgaaaaaattagccaggcatggtgttgtgctcttgtgatcccagctaccctagaggctgaggtgggaggatcacttgagcacaggagatccaggctgcagtgagctgtgactgggattagaggcgtgagccactgcgcccaacctattttctgttttttttattccagtcatccctgggtgtgtgtgaagtggtatctcgttgtttgttttttgtttggtgggtttgtttgttcattattgctccttgcagggcagggctaacccataggcagtgtgcccagagtagccagtgtctcgttgttttgatttgcatttccctgatgacacatggcattgagcatcttgttatgtgcttttagccatttgtatagcttctttgaagaaacgtctattcagagcttttgtttttccaaggacacgaaaactggcattttttatttatttattttatgtttttgagacggagtctcggtcttgttgcccagactggagtgcaatggcatgatctctgctcactgcaacctccgcctcccgggttcaagtgattctcctgcttcagcctcccaagtaattgaggttacaggtgcccaccaccatgcccggctaatttttttgtacgtttaggagagacggggtttcaccatgttggccagactggtcccgaactcctgaccttaggtgatccgcctgccttggcctcccaaagtgctgggattacaggcgtgagccatgggcgcccggcctgttgatttattttttaacgttttcatctccctgtggagtctcttttcaaatgtattttcgtgttcctctgttttgaggtctgacgtttgttgcctggaagctgcagtgcagccgttggggacactgcacagcttggggcctctgaatcccgatgtgccctagtcctgggccctgtttcttcttctcctgaggccacacatctggccatcctgttgtccagctgtggcccaggtaacttcccaactgcctggaggagtggcccgagcctctttgctgcctgacagccctgggctcactgtcctgcagccccaccagcagtgatgaggatctggagtagagctgtgggggatggccctgcagcagtctgttgtcccctgaggtcgtggtgcctcttgctctgggccctggattctctggatcctgcagcagtcaccactcatgcttctgctatgctttccggtgtcttcactcctccttttgtctctgccttgcctgtccagtggatgcaaatgcctgttctcagttttctgtctttaactgggagttctgtttatgtccacatggctctcctctcaggccaccagggaagtgacacctgcagtggtctgtagcctagcccatttgttagggagatgggctctgggtgtcactggctggcagaatggccacggccctggacttaagtctctctgcagggcctggaggggcgctaggctgccctgagatggcacagcccccgggaattgaacagttgggtcagagaggatacccataagctgcagggttgctggcgggggtgggggattccacttgcccagatcacatggagcgggagaaggggcatgcactggggtgtttcttcccttcttccccagctgcatcacctagtcaagctggtggccactctgccgccctccagatcctgctgtgacctgggcttccaggaaggctgtctcatcctaggccagggccctccgttctcttctgcattttggacagtttctgcagtgagcgttctgaacaggatgaacagctgtctttaaaagcagggtccagcaccctagcgtgtgtccctggtctctccggtagcaggcacctacacaaagtgatcctcctctgggctcagggggacagtgagtggggaagtcctcctttgggtgaagtcgggggcaggatggcctcaggcccaggctcctgtgaccccttggccctgctctggatttgggaggaggggggtcccttccttgaggcatctccaccgggcccccatgtggatacaggcctggggcccctaggccccctcagcaccttctgacctagccctgcctctccttcgcaggaagctgtgccagccacagagcactggcagcctccttggagaccctgctgcctccagccccccaggcgagcgtgggcgctcggcctcgcccccacaggtaagtgaggcatgcctggggtgactgtcccaagcacctgcagggcactctgtgctgcatcagtaacccttgtcaccttcctcaccagctctttggagcatgagctgctccaagttgagccgcctccctccgcccagggaccaagggggaagctgtcgggttggggttgggggcagattcctgccagtgtggccgcagcaccccagtgtcacagtgcggaacctgggacggggggcggctccctgatgtgggctcaaccctgggcttcctgctcctgtgtcacagttatcactggggaagcatgctgagcacagcagcgctttagaccagtccccaggggtggcccgctcacacactgggccctgccctccccctgcatcgatcccagcaggctgatgggccccagctgaggccaccctgagcggcacctgggacctgacttggtgctcgggcgcccccatgtggccagcgtgggccttgcaggcggcgttgggttttctagccaggccaggggattgcctgttgctgctcagccactctgtgctcccctctaaaatgatctctgctcctctccagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtaggtgcccaggcaggagggcgttgccggggctctaagtactggccccacacccgcctcaccctcatggggtgtcgagggggctcaagctgtagaagccaggggaggggaccctgttgccccaggccccatcagatttgccctgtgtgcctggcacctggcaccctatgttcctgcacctggtcctctccctgcctgtctggagtgcccggtgccacttgcagtcaatgtgccaggccagcactgggggccggaggcccagagccttgtggggaactgaggccgcagaaggggctaacatgcagagaggaatggggcccaggccccagctctgactgcagggaagccccaggagccagggccatgctgaggtctgctggggttcagggaagacagtgggggcccaggcaagccagccctattcagggagaggcagcacaggtgcagatgggcagatcctggtgggagagggatagcacctggacctctgtaggcaccgtgcgactgttgtggactgtaggtttctgctgtggggacagggcctggcaggctgggattggggagccaggagacctgggcggctccgagaccacagcccaggcacctaaactgagcagcagtagcacccgcctagcaccgtggccatgagcctgcgcagctgttcatttataggaaccagcagaagcagtggccagcgtgcagcggctgttccaccaccatgtgcgacaggggctgcagtggtcccatgtggcgatggcggccagttgcagatggccacttcgctctcggcgccagctggcccagggcagcccaggtggtgtcacctgctgtgcttttgggttgtgtctctggggaggaggctgagtcaggggattcctgggatgagggtgggagcccttctttcattatagctttgcgttgctcagagggccatgccccgtcccctgctgtggctggagagcaggtcctcacaactgtggctgggtcttactggataggaaggaagactttcggggttgggtcagccctgcctcgtgctgggcttcccacctcccgtgggactgcatgtgggggccgacggggagaaggtggccttactccctgggcagcctctctgaccagggccatgctcagggcaggactcctgattcccaggacacacccacaccccacagccagacctgggccacgatcaaatggcaggatctgccatttgagacccttggcccggctccagggtccacagaccactctgggctgtgtcccttccttggatgcccagtgcctaggtgccaagacaggcctggggactcaaggtggtttcctgtctggcctggtgcgtgttggcccctaggcagttcatccccggcccaggggctgtcatctctaccacaggtgagaaaatgcaaagcaggggtagatgtcccaagcaccaagaaaaggacagtggaggcaccagaagctgagcctggtgctggtggtccatgttaccagagtcctgaaggtggtacttgtgcagggcatgtcttagctgtcctgtgcccgtgcccaggacaagcaagtagagagacgtgggctgtgaaggggagagatggggagaggagctgctgtgggggtgttctccggggccccgaagcagggaccagcttggccggccccacacagccagagcttgagtaggagtcgggggccgctgaggtttgccaagggctggactttgaaggtcccactggtaccaggttgagctgaccctgagccttgatttccccgtttgtcatcctagctggtgaagatcttggggcatgtcaaatgaggtaatgttgaccagcctgacacatggcagttatctgttgtagaatacccacggagtccactgcgtggcgggagcatgggcttggccttcgcagctgcgccttgcctctcacttccttctggcccggaccagggtcagacccattcaatacatgcccattgagttgcgtccctgggaaggccacagcctcttaaagacaacccaggtgggggtggtggtgatatggaagacagtgtctggcccaaagtggggagtgttagaaactttgtggggagtgagcttcgtccacttttgggaatttggcagcagagaagctgctgtggtcagcccaggtgtgttacactgagagagagggctcagcaaactggagatcgcagactcctgctctctcaggggatagtgcagagggcccctgaaaatgtgcactagggccaggcacagtggttccgcctataatcccagcatgttgagaggccaagtcaagaggatcacttaagtccaggagttcaagaccagcctaggcgatataggcaagcctcctcatctctactaaaaagtaaaaaaaaaaaaaaaaaattcgccaggtgtggtggttcatgcctttaatcccaacgctttgaaaggccagttcaggaggattgcttgaggtcaggagtttcagaccagcctgggcaacacagtgagaccccatctctacaaaaaaattttgtaattagctgggcatggtggcatatgcctgtagtctcacctacttgggaggctgaggcaagaggatcacttgagcccaggagttcaaggttgtagtgagccatgatcgcaccattgcaactccagcctgggtggcagagcaagaccctgtctctaaaaaaaaaaaaaaagtgtattgaggatacatctgaaattgataaaatcatttctgtatcggaaagaaagccactgcaagaaggtctagaaaacgcactaaattgtagttgtggtcttaggcgacgcgcacttcagtcttcctgcccctcccctccctgatttccagaccctcaggggtgttgtcttatgtggccggggcaccccaccacatggctcaggagcaggacagctgcctggggtgccatctagccatcagctgtgctgctttgggcaggcccctgaaggggcgaagggctgagcgtcatcatggacactttgctcatggatggccgattggggtggcccatgggctcctctggctggccctgtcctggagctgccttgtggagcgtgcaattcagtgtctagtggaaaggacgggatgatctgggtggggcacagaccaagggcgtggaactttgtcagcagcaagagatgcaggccctgctggccatcttgtctttgtcctgtctggccagagactgggatgccccagagactcaggtcaagccaggggtcatttgttttcagcttagtgacctttgacatgcagtcagtggaggcagcaagggcctggcctgggggaagctctgaccggttgtgcaggctttggccctgcagttccctgacctgtccgctgtttgccaagaatgtgactgtggtgatgcctgggtgctctgtgtcctgcagggctttgccctggacacgcaggtgcacgctgagctctgctcaccacctggagggcacgcccaggtccagcagcccacagttgccaggtgcgaggggctcagcccttgcacctgccacacagtcatcccctctgctatccctctatgtccctccagcagcaaagtgtacagttttcatgcatgtccccatcctggcgtgcttcctgccgaccggtgccatgggcgcagactcaggaggtatgtgtttgctctcgtaggtttaaacggaacctgcagcgtttccagtgttcccacgtccacgtcggagacgcctgactacttgctgtgagtgtttgtctgggccctgcaggccaggcctcccttttctgggttcagaccccctcccccagcactgcaggttatcagaggtagaagccactgcaagtctgagtatgtgaattccaaacatagcagcctcttctgggccaggccccctcataatccagggaatcacccgagaggccaggccgccggtggagccaggatggccacttcctgggtggggctgggtccttccagcctccactcagtggcccctctctcctgtttcaggaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgaggtagagcccccccgctgcctactgtgccctggctctggcgggagccagggcccacttgggcgcgcaccatcgccaccacgagccagggcctgttggtggccccagagtctggcccttccccaggcagcgcttctccccctggtgcactccatgcagcaaccccatggttctggcccggccctggggtcctgttgtgggagtccttgaaggcagcccagcttgtcagcctcctttgcagtggggacagctgtgacccacctccttggatgggggcgagccggggtacatggatccccacatgtttgagcgcctggggtcctctcacagcctaggacacagggctcttggtacctgtgccaaaccctcaggagactccgcagctgagctctgtccagcaccctggggcccatccatgctgccacaactatagcagggggaggtgacaggtccctgtggtcctgggaatcaggactcctgtggtcccctggcttgagctcacagctcattcagctgccctgtgtatacagagagtctccacccttagcctagccttggacgtagccgccccacctgccacctttcggaactggtgacctgactacagggctgggccctgattaatcagatgccggggtctctcctggccaaggcccctttgccttccaaagacgacgactcatgatggggttctaggggctgcgagccacgggttcttggggcatctctccttccccttccctccctctttgctgcacccccccaccccctccccacccccccacgacatggatacttccttgtcctgccacgcccccacaacagcagtgccccacctgctattgcctccaggggacccggcagcctttccctcatgccccacccactccggagctacagccgctgtgggcccctggggtgttacttggccttgtccttgaggctgccccaccctcccatgcccccttctcagagcacctgggaccactcaatttgggtttcctgtaggcggggacacattctgttttctcaaaattttgtttttcttctagactactcgagggcagattttgcaggaatatcgaaaaatcaaaaaggtgagtgtctcttgtgttggggtgggctccaagtgagccatgggagctggagggaggagggtgggcccggggcagcctccctgcccgctacttccaaggtgtgggggaagagcctttgagtctgaggccaaagttgccccaccacccccagctaagtcttcagctgtggcatcctggcccagccacacaagctgtggaggtgcgggggaccaactcccactctgcccttggaccacaaccctccttgctgggcaccaagcccaggtttttggtttgggggggacactggcctgcttacagcggggagcagcacccagggcggctctgtcctgagcatgactgtgctgtcccacagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctcctcgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactattttttttcttttaatgttgtactgtggagaaaaactattttgagccatggggttggtgtttacaagaactttccacttttgccaaaatgttacaattgaaaggcatctgcgtcttcagtttcctgatattttcttaaaagatctagtgtcctttttgtacactaaacaggtgaatgctgacttttttcattctccaataaatttcactgaactgaacctggcagcccaggctgcctggctggtgtgtgtggtgtgtgggtgttggtgtatctgtgtgtgtggtgtatggtgtgtatgtgtgtgtggtgtgtgttggggtgtgtgggtgtgtagtatatcctgtgtcggtgtgtgttggatgttgtgtgtgggtgtgtagtgtgtgtgatgtgtagggtgnnnnnnnnnnnnnnnnnnnntcaggggctctggctgggaccagataagaaggcagagtttgcagcctacctgagccgttgcctgagaaaggaccaaatcagagggccctgtaggtgacggggagcgcgggggtgggggcaggctgggtcagggcggagggatagggagccatagcaggtgtgtgagcacagcagtaccctctggtgtggatagggtgggctgaacccagcattgggattccttggccccctgtggcaccaaaggctacaggagtggggctgggggtgggggaaaccagctgtgactgtctccctctgatgaaagcagcagcaggtaacggtaatattacctgttcttcccacactggggcagtgcgcatcccctgtgccactagtggggatggggaaaaggcctgacgggagcggcggtggtgcaggtggaacgagccaggggccatggcagaacataacactcaacctgccagccaaggcacaagaaggggtgcatttagtaagcgataacaccgaagaataggaccgtgggcaaaggtcctgggcctgcagctgtggggggggcctggcctccctgcccgtccgtggccttggcccaagttctaaggccacccaggaatctgaggggcgcgggaggggaagtcatgcag

SEQ ID NO: 14046 - DNA, 68173 bp, Human
  misc_feature (1)...(68173): n = A,T,C or G
gagttctaggatcagtaccacagttgaagctttcaggtaatgagtgaatggaagtggtgtataaatacccagttcccttgccttttaggtaaaatcatttggagatgcttgttctatgctggctctgggagatccccagcagcatgaacctccagttgctcacaatgataacttaatatatgcctgatattgtcttctttcccaactcatttcctcactcacctacccatgttctctgtacctccagaataaactacttttacttgaatccttgcctcagggcctgcttgtggggaaacccacaacaagacaaattttatattccattttctttaagatcctcacaggtatagagttcataacttatattattttcttttagttttaatatttcagtaaataaaataagttatggtatgaagagttcaaagtgttttgatgacaaccttgaagagctcatcttattaccttattcatgatactcatctgacatgtgaatctgccaatacgtgagaagatgagaaaagagattgatataacagcagcagagcccaatggggaaaagccctggtttccagttctggttctatacttgttagctgtatgaccttggtcgggcaagctgcttaacctctccgactcagtttcttgacacttcaaacatgggggaactaatggtctccatccacaggcttgtggatgttcaatcagataacatatgtgtttaggacaaggtctgacactattaattacgagcagctcaatggtctaactagttacccaagaatactgaatccatggggataccttcaactgtaaaatagaagtcccaactaaacatggcttgcaccaataagaacatctattacaatgtaaagcaagattctgcagcaagaatctcccccctccctacttctcacatttcattggccagaattaaggcatatgcctataaaaccatgaatcaagcttccaatcaagataaacctcctctttctctgtatcctttttcatttcatttctcacactgggccactgtgtgtcagaggactatcacaataagcctcagtagattggctggtgccgggcaaccttagctgagctcattcatatacgtgtggattgggtaatatacatgaggctccaccgagtagctctgcttcaagctatagatctgcaggttgacgaggtagctttttcacctgtttctcattcgccttggaccaccaggctaggtggtgcaaggtcttctcatgtccatgatagagggtcaggtgtgttaagacctaggcttggaactggaacactgcaacttttctgcccttaaaccattgatcaaacaagtcacacggccaagtccaaagccaaggtgtggggtcatagtgtctgcctaccatgaagccaaagggtgtggacgtaggaaggacagaaagggatcagtcattcattctaatgtaacacgttgtcagaacaaagaatgtgtcagtacccaaatggatctgaattcatatagcattcatgtttctgccatgaatttctgcactggttactatattgggatgtcatctggggtcccatgtaagtaagctgttgcaaatgggcctgagagattacttgccaaatgacagggttgcccaggacttagtgaccttccagctctagcatcccattatttgcagtttgtagaagaaaaccgggagaacgtgaaaacccaaagagaagtgagggatcatgtcttaggaacctgcatccttccatcctgcttcgacttctcaactaaattcttaagtcctggagtgcaggtatcaccgaaatttgccccatgcctgaaatacatggtagtagatggtgactctgacaagcgtgaagtgacctgaatctgggggaagtttctgggtgaacagagagcgcggaggatgcgcgggtcatgctggaggcgggtcccagccagatgtgcacagcccgccccgccctccctcgctcaccccgtccagcttcatccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccaggtgagtgtctgactggcgattggcttccccccacccccggcctgaggtcccgctttggggccccatgtctttgcaggcacccccgcgtgtatgggtgtgagtgtgcacgtgtgcctgtgcgcgctgcgacgggatttaacctggataccaggccgggagcgcccacgggctttcctccctgctctcctgtggcggggctttgcacctagttagctccttttgcatcagctgtgccccacctggctgcgtccggagggttgcaggaggagggaggctctgcacgcagacccgtgggtgcgtgcgggcttgatggtctgcagacctgctgtaggggcaggtgtgtgagggttggtatgcgtgtcggtgggtgggttctgtgtctgtgcggttttgtgttttccactctattcacaggacaccaagtgcttgtcagtcgctagttttgctggggaaggagggaaagaaaccgaggacgataaagcatttactgttcttgagctgagccagccgggctgctctcctcactgctctctgattagggttgatgaactggaaagaaaggacacggttgtcagatgacaaccattctcattcttgctatggcaatgcagactctgaagccgttccctactgcccttaagcttagctgagacctgaaatattttttccagagatctgcaaagacgcttagtaaatgcacgcttacatggtgactgtcgacctggcactgttctaagcacttcaggactattaacctacccaaagccataatggctctgtgtgtaaggtactattatcatcatctccgtgttgtagaagagaaaaacgaggcacagagaggtaaagtaatttgcctgaggaagcatagccagtaagagatggagccagggtgcaaacctaggtattctggcccaaagtctgttcttcaccagggcactagggcagccttccggcaacggaagaggttttctggttctctaactgtgatgtcttgctttctacttaggtgtccactagaatatggtttttccaccgcagcattattgacctttcgggctgggctggataattatttgttggggtgatgggctgccctgtgcattgtaggatgtttagcagcacctgtggcctctactcactagatactagtagcaaccttgaccccaccccaccccccaccaccaccaccaccaccaagttgtggcaacaaaaaaaaggtttgggatattgcccaaggtccctggagggcacaattgctcctagcggagactgctgaactatagaaatttttcagtgatgattcctgaggagagtaggataagagctttggtttggtacaggcttctcgaaggtttgcctatctttgtttgacttacaggaaaaaatatttcatcagagttagccatggtattaaaggatttcgaagttaaaacagaacaaacctcaaaccaggttcttagaatgtatgatcgcaagtttcaatttccttttcatgataaaaatgtaagcagatgcaatttgctcataatcacattttccttgaatgctagaggttcttgcgttgctagaaagcccacttaaaaaagaccaaatgctgtttggagatgagattaatagttctttagcggccagcaaactgacctccaggagcttcactttcaaagtgccaccaaattaaattaaaagccaaaagcccctggataaaccaaagcatattaaactggagaatccatgtcaggattctgcaattctgcagttttcaagatgtgaaccatggtttctttagacgattatcaagtttatgagctggtgtgtttattatttgctcaatgtgcttggaaatgtcaagtggtcagctcttcaggaatgtccaggacccatgtttaatcagctctagattccacattatggataagacactgttacagagaaggcaaggcacccattgcagaaaactgtgtctactggttatttcctggggtttcacaacttataggaaaaactgtggctgctgtatagagatttccagtataagcatcagttctttttaattgaaacactgcactatgattttataacctagaaaattatgtgcttcttaaatggtatttagtgcatagtacacaattaacgctcatcaaatgaataaatcattagctccatgcatgtacctgcccttaagcttcagaatttggcttgccttatattttttatgtcctttgggtattggaactatttagataccctagacctgtccaatacagcaaagatggtaaccaggagccccaagtggctattgaatacctgaaatgtgaccagtccaagttgagatgtgctgcaaaaagtatcaaatacacatctaattttcaaaaaaaagaacaggaactatctcactaatcatttgatattgattacatgttgaaatggtaatgtggatatactgcattagataaaattgttattaagattaattgcttctgtttctttagcatttaaaaaatgtggctactagaaaattttaaatggcatatatggatatttatttctattggacagtgctggtctagaacacttattgatctgaactccatctcgagtgttctaagtcctaacactgggatctttttgccttgagtacctaagataaatatattattaactttgctattctggagattaacgtttggagcaactccttccttacaacatatttctgttttatatttttttctctactgaattcaagtaaaaataatgtgagagaggagggaatgactaggttcctgctgagaggctttacttacagagaccacatgctatgtgggtaattgatttttctcaaagccctggtagcaaagtgccactgtaaaaattggccacaaattccatggcttaaaacaagagaagtttattgtcttacagttctgaagaccggaagtccataatgaatcttatggggctaagattaaggcatcagcaggactggtttcttctggaggctccagggaggttccatttcttgtatcttccagcttctagaggctgccaacagtccttagcttgtggcacaatatctttttcctttgtcactttgccttctctctgattcttccttgttttcttcctcctaagaagaacccttgtgattatatcaggcccactcggataattcaggataatctgctcattgcaagagccctcactcgatcacatctggaaagtcccttttgatatataagataacatttacaggttccggggattaggatgtatacctctgcggggtgggggcgttattcagcctttcacaggaagcctgagctgtaagtctgttgttcttatttctatgggctagattttatctttaaacatgattttggtgattttcgaatgattggtatatcatttatttctttattcttcaagctgtaatttgtgagaatgtacccaaaactaaagagctgtgtgtttctgggaaataataatcatctaattacaacttaaaaatcatttctgggcagccttatttcaatagttagtttcactggcttagaaagtgttaaagtcctatttatatgtaattcatgagcataaatcaaggctatgtaaacattacaatgaaaataagtgtattacctagtcttcataaatcagattggcattcaacagatattattgaggccctagtcagtgtcaaccattttcaatgttatttcaatcaatcctctcaacaaccctaagaaatgggtattgtgttcatttgacagacaagggaatggagaaacttgaagaaattaggtgatttcccaggaattacatttgatttggtcttctgctctaagaccagtgttgtcccactattccaaatttattccctcaaaaaaagtgaatacagaaaagctgacatttttacaaagggctttcttacaaatgatcaccagtgatcctgtttagcttgactctagttcagcacattcaagggacatatgtagagtaagtgctccatccacccagtaccaccactttcctttctaagtttgcattttctcagaagcagactctgtgtgtaatttatttgagaggtgaccccaggaagttctggtagagaagtggggaagtgggacagaaaagggaaagaagtgtcgtaaaaataagtcaccactctgtcaatcctgctggggaattctaggagacagtagaacacgagaatcctagttatcccttgtgaagacaagggagccggggtgtttgtaatcccaacagtcattggttgagggcttctggggaaggggattctgcactttcagcctactgtgcacacaggaagagctggctcctgccaagacaaaaagttctcaggaatcgtgaaatgaggctggtcaggttccacaatgtgccaacagctatttgccactgagccagtaaaacagggaactaccactgatgaacttgtgctcctggtgacaaatttcaggacaaaaactcctctgaggacagtgggggcaggacatgcaggtatcctgaggtgatgtggactgaattgtgtactccctcaagattcatatgttgaagccctaaccccactaccttagaatataattacatttggagatagggtctttaaaggagcagttaaattaaaatcagttcattatggtggtccttatccaatatgactgctgtcataagaagaggagattagggcctttctccctccccagccatcttggtggatgctcttggctgggggccatcccacacctaagacaggaagactgtggctgcaaaaaagacaaaaaaaaaaaaaaatcaccggagtcaatcagctgtaggctccaactcattatgaaaagtgaaaagtacatgctggagtacaagaagactctgaagatgatcagacaaggcaaagtgaaactgtcatccttgccaacaattgtacagctttgaggaaatctgaaatagcattattacagcatattggcccaaactggtgtccatcactacagtggcaataataatgaattgtgcacagcatgcagaaaatactacagattctgcacactagctatcatttatccagatgattctgatatcattagaagcatgccataacaggctggtgaaaggtaaaccatacaagattattctttactaaaacttgccaaagcttatttaaaacaaacaaacaaacaaacaaacaaacaaacaaacaggccgggcatggtggctcatgcctgtaatcccagcactttgggagaccgaggcaggcagatcacctgaggttgggagtttgagaccagcctgaccaacatggagaaactctgtctctactaaaaatacaaaattagccaggcatggtggtgcattcctgtaatcccagctactcgggaggttgaggcaggagaatcacttgaacccaggaggcggaggttgtggtgagctgagatcatgccattctgtctcaaaaaacaagccaaaaagaggagattaggacacagacacacacacaggaaagaccatgtatggacacaaaaagaagacagccatcttcaagcaaaggagagaggcttcagaggaaaccaaccctaccaacaccttgatcttggtcttccagcctccagaactgtgagaggataaatgtgtgttgtttaagccacccagtctgtggtactttgttatggcagccccagcaaactaatacataaggtacgttcagaaaagatagaaaccgcataggatcaaaaaacaaaagtccacctgatctttattttcagttgaatgcaaattgaaaactggcctcacaagctatttgacattgggggttttaagcaggaaatgtcagaatatggataatgggcacatagcagctaactagcatggcaacattgctttttgatccttcagaattagctgcaagtgatagaaaactcaaataaccttggcttaagcaagatagacatgtgtttctctttcacaaaggtgtgggtagttgggctgatatggctggctttcaatggagtcagggacccagatgctgccattttatgggtccatcagaaggccctccccttgtggcctaagatggcttcttgagcttcagcaaacatgtccaaattccagccgtgttgggccgttcttgcattgctataaagaaatacctgagactgggtaatttataaagaaaagaggtttaattggctcaccgttctgcaggctttacaggaagcatagtggcttctgcctctggtgaggcctcaggaagcttccaatcatggcagaaggtgaagcgggagcaggtgtctcacatggcaaaagcaggagcaagggcggggaaaggtgccacacactcatacacttttaaacaaccaaatttcatgagaacacactcactaccatgaggacaacaccaaggggatggtgctaaaccattcatgagaaatccaccctcacgatccagtcacctcctgctgggccccacctccaactttggggattacatttaaacatgagatttgagagataaatatcccatctgtatcaccagccaataagaggaaataaatgaagaacatcatcctcccttcacagccacatcctggaagtgttgcacatggcacttctgtttacatcccattggccggaacttagttccatggccacatattattgaagtgaaggctgggaaatgtagtctatattctgagtagctatgtaataggggtcctattactaagaaggaaggggagaacagagattgaggtcccactggcaatgttgaccatgtgtaaattacagatcacatctccaattatatagatgagtaaactgaatttcaaaaggatagattgttaaatgatttgcccagaatctcacattgaacaagtgacagatttaaaagccatggtgtttcccaaggatgattaagtcacttttcatgaaatattttacccagagagatcagtagtacttctagtttcatcagttaacttgctgggtcccagtgggtaagttttaataactgacctgttttcaatgtgaaggtcttgtttatgaaaaaaaaatataaaaagtgttaaaattaattcagtttaatgcaacattaactgaacagttgatgtgcccaaacattcttctgaatgccagagattcataactactgcctccctcactagacaacttcatagggccatcaaaatgtctttctttcctttttggccagggaagccagggaggaaggatacaagtccaggttctagcccagtgcctggcacatagtaggtgctgaattaaaagttaggtaaattaataaatgaccaaggaagggggatggagaggcacataatgttatttatatatgaattttatatatatatatatatatatatatatatatatatatatatatacatacacacacacacatacagtatagcatttcaaacaatgaatatatgtctatatgcatatgtataaacatataaaactataagtttatatagggtgtatatatatacatattatatatatacatatatataaaaacatataaaacattccacagaatacagataagagagaaactgagtccacatgagagaatcagggaaaactgaatacagtggatgacacttatagtgttcttatggagcaaatgtgagcccacctgctataaaatgggcatagaaagcaaacattccaatgcttaattcctagtaggtattgcataagagtaaatgaatggatggatagatacatacctgcaaaaagaatgcataaggtgagcatcagcccaagatacagaaagtggactggccagaatcttaggtaataagcccagtggctgccaagaggcaaagaaggcaggctggaaccaggctgtgaggagcccagtacactgagccaaggagtttggacttggttctgacaacaatagcgagcaaacaggccattgcaggctctgtgttctttaaagttaacacgatcgtgactaattcatgcacagaattatgacaaaattgcacagaattattaaggtaatgagctatagtttagtttaattggcagcatttttcttttctaatgtacatagtaatagaatgcttataatctatgatatctcagatttaatgaatttaagtacaaaattaaaactcaaaataccaaagcaacaaacgtcaacaaagatcatcaccttgctcttcagtacgttctgcttggtttctggatatcacatttattagttatctattgctatgcaacagaatacttcaaaatttagtggcttacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattagacccagccatcccattactgggtatatacccaaaggattataaatcatgctgctataaagacacatgcacacgtatgtttattgcagcactattcacaatagcaaagacttggaagcaagccaaatgtccaacaatgatagactggattaagaaaatgtggcacatatacaccatggaatactatgcagccataaaaaatgatgagttcatatcctttgtagggacgtggatgaagctggaaaccatcattctcagcaaactatcgcaaggacaaaaaaccaaacaccgcatattctcactcataggtgggaattgaacaatgagaacacttggacacaggaaggggaacatcacacaccggggcctgtcgtggggtgggggcagcggggagggatagcattggtagatatacctaatgtaaatgacgagttaatgggtgcagcacaccaacatggcacatgtatacatatgtaacctgcacgttgtgcacatgtaccctaaaacttaaagtataataaaaataaataaataaataaataaaaatttagtggcttaaagcaacatttattatttcacacattttctgtgaatcaggaattcaggagcagcttagcaagatggggcttggggtttttttaagacattttttagggcagttttagattcatagcaaaagggcttggagtcttttaattcttattttaggttcaggggtacctgtgcaggtttgttatatagataaattcacgtcatggggggctgttttacagattattttgtgacccaggtactaaccctagtatccaataggtattttttctgctcctctccctcctcccaccctccactctcaaataggccctggtgtgtgttgttcccctctttgtgcccattggttctcatcatttagctcccacttataagtgagaacatgtggtatttggttttctgttcctgcattagtttgctaaggataatggcctccagctccacccatgttcttgcaaagaacatgatctcattctttttatggctgcatagtattccatggtgtatatgtaccatagtatctctgtccagtctatcactgatgggcattttggttgattccatgtctttgcttttgtgaatagtgctgcaatgaacactgtgtgcatgtgtctttatggtacaatgatttatattcctttggatatatacccagaaatgggattgctgggtcaaatagtagttctgtttttactatttacaaatagtagttctgtatctactatttcctcaaatagtagattctttgaggaatcgccatactgcttgggcttggagtttttcacaaggttacaatcaagttgttgatcaatgctatagtcatctgacatcttgactctggctggaggatctgcttccaagacggcgtactcacatggctgttggcaggaggcctcagcttctctctatgtggacctctccacagggctgcttgaatgttctcacaactgttagctgacttcccccatagtgactaatccaagagagagagcaaggaggaagctacaatgccttctgtgtcctaatttcggaagttacccccatcactcccacagtattctttgttagatatcagtcactaagtacaaccccacataaaaggaggggaattaaacttcaccttttgaaaggatgagcatcagatcatttatggacatattttaaaaccgtcacagcatacaacacattctggtttgccttcgcccacacttgttannnnnnnnnnnnnnnnnnnncgtcacagcatacagcacatctgatttgcctcgccagcactgttactcttccgtcgtcaaacagagtttaaagtgctgtattccacgagagatgatctctgaccctatgtctttcttatttacactctccagttatcttcccagtcccagcactttcaatgccatctatatgtatattcatgtcttcaaaatgtgaatctcaagccccagcctctttctgctgcattcttgaccgattcattgagatgtctcactgagcctaagacatccaaaactgaactcttgatcatcattcagaacttgcttccctccacttcaccctttctccccaccccagaacaaacagcatccaaactggctcaagccaaaaactggggtatcattgctgacaggtggggttcttcctccccacttgtattacatctgctactaagtcctgttacaaaccatgtctcaagtccatctccttctatccccactctctgcccctgcctaccatcatccagctacaccaccattatctctcacctgaaccaccacaatagcttccttttactttttcttttgctccctctagtccatgctccaaagtgttcctcttaacagttaaattagaccatgtcagccctcttcttaaaacttttcagtgactttccaccagattaagaataaaattcattctacttaaaatgacataaatggctctacttgacctagactttgactacttctctaactccatcttccatcttatatcattctcccccatgcttactatgaatgaatgaatgagagggagaataaatgtagctgtcttgataacacttgctttattgactgccttcccttcctagtctcacttccccactcctttatcaacgttcccttcacctcctaagtaaaccacttccatgcaaattcttgtctcatggtctgcttctggggtagccaaaaccaagacactccccatccccaatctccacataactcctgagcttggaagataaatgagggaaatagaggaagcaatggaaagttccaacttttgcctgaagtttactactatccctaccagtcatggcattagaaatttgaggacacatcaacacacactagtataggagagctttataacccaggcaagtttttcactgggcacataagcccctacacatctgggaaagtgagatgtcttggggtatccctggacccgctggacttgtactctgtttcttgatggtagatgggaacccagacttaattttaactggctaagtacagtgaacttgccatactgggagctatgataaaaaaaataacaaaaatcaaaaccaccgccaacaaaaatcttcatggctggaccttgttgtccctatttagaaaatcttttatttcatttatatggcaatatttaaatgtatttaaacatcggcaaaagaagtttaatttctcaatttgtcttggagaatatcatgaagttttctggaatctgaccataaacaaacatactaagaattctggcacagtatatttttgcagaaaataaggaatcctatgaagaaatactacactacttacacaatccctggaatgtttttaaattaacttcagctgtggagacggcgattttctgattaatttgatcaatgtagacagcaagctgtataatgcattaaagaaactgggcaattcagcatttagctaagactcccacagctcagggcttccactccacagagacttgttcacctacattagcatttccctgtctcaagactcggttccctgagcctcatatgtgcaaaatattgtttaggaagagacagagagagagtgagagagaagctggccagtccatctagaccttccaaggtggcagaggatgttgatgggattagtacagtccaaaattagatattctatttcttttctttttttttttttctttttgagatggagtctcactctgttgcccaggctgaagtgcagtggcgcaatctcggctgactgcaagctctgactcccgggttcacgccattctcctgcctcagcctcctgagtagctgggactacaggccctgctaccatgcccggctaattttttgtatttttagtagagacggggtttcaccatgttagccaggatgatctcgatctcctaacctcttgatccgcccacctcggcctcccaaagtgctgggattacaggcgtggcccactgcgcccggccgagttgattcttaaacaattacttccattttttaacaaatgagagtgatgtagatttgatggcaaatctcctatatctttcgacagaactataatactaagatgcttttgtgactgagaaaggaattccttacagcagataagaaatcttaatttattaacaaagttaataaatttttgatggcccaagtgttagtcattaacatttgggggagttttataagtaacactttatacgacatcaaaaacaatgatttgggagaaattaatacacctcagatttctcagtttcaccttttcacctgaaagcaggcatgtgaaagcaataaagattgagaaaatgaggatttctctggagagttgtggtaatgtcaaacagtatatgaattttatcttctggtaactgtctcctgttagttaaccccaggcagtattctttgcaatcccaagtaattgactttgactggtacatatgaagtaggtttgaccacctgtaccaaggactcgtggctggtttctgattaggctttttaaaaatatcagatttcaacaaatttctatttggttttgtgtgatttcacatctaactgtttcagaaatattgttggagcttagtgagctcaccctacttctaaggaggctgttttgtgtattacaaaattcttgatatttccaactgcttgaaatctacctgtcactgtctgaagcctgcaggagggacacaggcctttttcttttgccccctgctgtttccctgcgccttctctatcccaccattcccctgctgcccttctcactcctgctcctaacacacaccacgatctacactcaaattttcaggccaccaactccccatgttcttaatggtgctgtccttggcacaggctattttttctgcctggaacaccttccccaccatacagcctcctcccacttctcctaagttccatggctaagttccattcatattgagccccatttcctccagaacacccctcacccacccatcccaatgtactaacttccatatctccccctagctcctgagaacttgcccctttggtagggtcatatgttggaatataatggggcttctctcatatacctcctgtagtctcagtgcctagtacagtgcctgatgtgtgtagttacttaataaattttgggtagacaaatgagtaggtgaatagtttggtgaagtgtgttcccctctggctcctaataccaatgaaatactcagtttttcttggccttagtttcttcatgcacaaaatgataggttggaaccagatgatatctaaggttgctttctttaaggtgaaattctatgataatctccccttagaatgaacagttattcctacaaacataaaaaaggcaagtcacatggaacctgtgacagctatgaggatgtgcctcgcagacatccaactgcagggagcataattgacccagggtcccaactactctgctcttggaaatccagcaccacttttaagtgaggctgcaactcccacaggctgctgccaccaatgactgagcatggcagggatactaaggcaggtccttctgtgggaaacgtggctctcctctgaaggtcaacacatctgataatattaatcctactactacgaataataaaagcaatcaattagggagcatttactgtgttagtcaccattcacagccctttacatatatttaatgatttcattatcacaaatacccttaaggtaaatactgttgttttccctgttttagaaaagagatagctaaggcatagaaagacaaagtaacttgctgaaggtcagagttaatatatagtagagccagaattcaaacccaggaaggagaccatagtcctgaccaccatgttatgcagcctctcaacattcagagttgatcccactctcttactagaaaaactctcctcatttggctttcccaacaatgtactaacctggtgttcctctgagcattgcctgggcctctttctggaccttcctgctctttggtccatctcttacatgctggcatctttgggactgtgccctaagcctccttcttttcttacactacatccacttctgtagaatcagttaccatctacctgcagatgattcccaaatatagttctgcttcctggactcctcacccaaatatccaacttcctactcaacacctcttctaggttgtccgtctaatgagtactcaaaatcagcatgtgccaaagagaattcatcatctatcctattccctaacgtgttcctccacccatattcctcattccagaaatacagtgctaacatctacccgatggtgcatccctctgacgctctatatccaatcgactaggatataagctccatgaggacagaaatcttatttcccttttggttgctgatgaacttctggaaactagcccagtgtctgatacattataggcactcaataaatacttgttgaatgaatgaatgaatgaatcactctaatccattaccaaatcttttggtcccactttgatgccattcatttctccttacctccactgcttctgctccagtccaagcaaccagaatctatcttctgagccaactggtatcttttcttccattctgtctccctccaatctatcttccagactgctttcgtggtactgtttttcaagagaaaaaccttatcaaataacattcctacttaaaacccttcagtgctgttctattgccattaagatgtaaaacccaaagccctaacttgattcacaagaccctctgtgatgtagcctctgccaacctctcggggctcatctctcacaagctgactcctccctccctttgttgtaatcctctggtcatctactcattcctcaagcacaagcatggtgtcttttacctcttagtctgcactcattctattccctttgcctctaatattctttcactttatgtggttgaaccctgtttgtcttaagtctaatttaaagtttgcaccttcaaagggaacatctgggaccctttagactggattatgtttctttgatttaagcttctgtaatagactgaatatattgagtgcctctgttaccctgaaccccttgtctaaaagctcatgagtaggggaccctctatgccaggattataagtgtatcctcagcacctagcactatagtccatacatattaatgccctattgaggattatactgattttttttttggcatcaggaaataggtaaggtccttcctattgtgattggggagcatattgcttgcaaacctgcagtcaagaagttgacagatcatctctaagattttgttgctagattgaattctaattaaatgaatcccacatttcttataaaaatatgaaattaaaattccaaaggcagaatttcccccatacagcttttctttcatcatgttttcttttgaaatccaactcaaatgtcacctaccctgtgacattttcctcctctttcccaagcaaggttagttcctctctccattctgctcccccaggcatcagcttcatgttgttaaaggaagaggtaaaagcagattgtagtactttgtcaaggtttctcacagatgtgtatggttaagaaatggacttactgtttatctatgtggaaggggtttttcaccaaggtatggggatagttgtttttaccaacaaatttcaatcttgttttcaaatcttaaaaacatcaaaacaaataacccagttaaaaaatgggcaaaggacctgaatagacatttatccaaagaagatatacaaatggtctataaacacatgaaagacacttaatagagaaatgcacatcaaaacaagatgctacttctcaagcattaggatgtctagagtttttaaaaatgaacaataacaagtgctggtgaggatgtggagaaattggaactctcatatattgctgatgggaaagtaaaatgatatagccatgttggaaaacagtcgggcagttcttcagaaagttaaatatacaactataatatgtcttagtcagttcaggctgctataacaaattaccataggttgggtggcttataaacaatagaaatgtatttctcaccattctgaaggctggaattccaagactagggtgtcagcatggtcaggttctggtgagggcactcttgggttgcaggctgccgacttctcaagctctctagccttttcttattagggcactaatcccattcataaaggctccaaccccatgacctaattacctcccaaagaccccaccaccaaataccatcacattgggattagggtttcaatatatgaattttggaggacacaaacattctgtccattgcaccatatgacccaacaattccactcctgtgtatatacccaagagaaattaaaacatatgtccacacaaaaacttgtgcaccaatgttcatagcaacattattcatgatgaccaaaatgtagaaacaacttaaatgtctatcaactgatgagtggataaataaaatgtggtatatccatattatggaatattattcagcaataaaaagaaatacagtactgttacaagctacaacatggatcaaacttgaaaacatactaagttaaagaagccagatacggaaggctacatattgtgggattccatttatatgaaatatccagaacaggcaaatccagagacaaaaagcagatttgtggttgccaggagatgaagggagaagttagttaagatgaactgctcataggtatagggtttatttttggggtgatggaaatattctggaactaaatagaagtgatgagtgcataacatagtgaaaatactaaaaaccactgaagtgtatactttaagagggtgaattttacgttatgtaaattatatctcaatttttaaaatactaaagtaaaaaaattattaaggacatcactgtatttggactggcacttatttactcagcatactttatggttagttgcccatagtttcttcttttttactgatacaaaatattttacatatttatggggtacatgtgagtgttacatgcatagactatatcatgatccagttgtacttggggtacccatcaaatactcaaataccttgagtatttaccatttctatgtgttggtaatatttgacatcctctcttctagctacctggaaatttacaatacattgttgctaactgtagtcaccctgctgtgctacagaatattggagtttatcataggttctttggaaactgttaggcgcagactgggtcaagattgtggtatcccttgcagaattgttaggaatatacaaattagattagacacatggctgcattatttctcagtcaaaactctttagcagagcattttaataatatttagcatgctatcctatacttgaatgcatatgtttccaatagactgtgaacttaagagagcaaagaccaggcccttttcgtcactgtactctatgtgcctgagacagtacttggtacatagcaaatgcacaataaatgttttgctttaaagtactactacttaatgaaagaaaagtttaccttccaggggacatttggcaatgtctggagacattttcgtttgtcagaactagaggggtgtgtgctactggcaactgtagataaagaccattgttaaatatcctacaatgcacaggacacctcccaacaacaaacaatgatctggcccaaaatatcagttgtgtagaagttgagaaaccctattctaaatgtttgagtgacttatgaatccctaaaattaattccattaaaaaatgaaaaaaagttctcttcaagaaaaagtaaatgttaaaatcatcctcccatttggtgctctcagtaaatgaaatgtctcagaccatatctttatagctcttaactgagtaatcacatttgtgggagaggcagatcttgagggaaatctacaaggttgtttaacttcccgaccttgacttagatattattaacttgcatgaagttcagttctgtagcagaaagcacatggtaaaatgtgcattcctttgtctgttaaagagcccaggaaacatttttacagtgtatttaatatgtgtaaggaaataatcacagccctccactaaacatacaatgcaagtattttccttcaaagtctggtagcaaccctgtccaataccaggacagtaagtaggtaaacatgcagtgagcttcatccatggcggcactacttgggggcacttggtgggggacagggggctcacctttttcaggcatctagatcaggcaagctacagcctgctggccaaagctaggtgatcccctctttataaacagcccatgagcgaagaacagtttttacatttttaaatgttagaagatggagcaaaaggagaataccatatcatgacacaggaaaattatatgctattcaaattacagtgtccataaataaagttttattggaacacagtcatgcgcatctgtttactattgcctatggctgcttttgtacttggacagatatcttatggccctacaaagcctaaaatacttaccatctggctttttacagaaaatgtttgccgatctctgctctaaaattaagcagtttagcaaattgggtttccaggaggtcaatgggaacgagccctgggctagaattcccaacacccagctctgctggggatgtgactccactccattggactggagtttcctcctctgtaacataagagggctttgctgaacgagcccttccaactcttaatcatctatagtgtatgttgattccagtctattcaatggttcccaggtgccagtgggataaaagtgcagagctctggtctgggacaaagccacaggattagaaagtgactgaaatagacaaagaactggatagttgctgtgcgtatacagagcagatctgaaaagtgacactctacaaggttcaaaaacatatactttggacatcttcatgtgccctagttttatagattcttttaaccgtggggaagaaggaaatggttgaaactaattattgaggaaggctggcaaccccaaaattcaggttttcaaaatctaatttagcacttactgcgggttcgttgaaattaaccaggtaattgacatctctggttcttttagtagtagggaagagtttctgttgtcttttctattttctcaatactaacatgtagttctttatctgcagtgcaaggcatcacgggttgttagcatcggcacgtcagcctggggtctgtcactatggaactaaactggcctgctgctacggctggagaagaaacagcaagggagtctgtgaaggtaattttgtaaaaactcagaccctgcacttggatcagggcccttaggtttttatctgtcataccatgaactgccacaaaattgccagtggatctctcaggcaaggacatgcataactaccaataaccaaggtctgggttcctatgagatctcttcccagacaaaatgtggctgacgccatcatacttggcatgatttattttagaagactgtcttgtcaattatttttgtgattatcttaatgagtatgactgggttgtttgtttttggttttctttttaatctaaaggaactaagatgggcaaaagcaggctggtaaatttctcctctaattataatttaagtgatttccaatgcaataaactttaattattaatcacccaaccagtaggcttcagccacaaaataagtacaccttttagcttatagatttgtaactcacatttttaaaattcatactgccaatttctaaatgctttcaaggtacatatgcatatatgcaaagattttaagtattttgctgatttttttgtacattgcaaaccaaggaaccataatttgccttggacattgtttctcagactatgtgttaggaactccgagagaggcctctgatcatttcaaggaggttgggaagggcagagatgagcataaagtttttgccttgtttttctttttatgactttccataacgaccaacactggcagtgtagcagaaccaaatccacattcctcctgactgtctcaccaggggtgtattccttcagggcagtagtctactctcactgtccctgtgtccttcagtaggtagcatgtgcctcatcctaagttatttatctattaaatgggataacaacacagttgcaggtcccataaaagcactaacatgttagctatttttaggaataacaatgctaccttctttttgctagtctgttcctgccccaacctccttctctctggctggttaaaaaatatctggattgaccataagtggggtcagaacttgataatatccaaaatctataaaacaatagaaaacattgatatcgttcccacatgttccatattatgcaaaaccttctgccatcatagtttgcttgtgacaagatgacaagagcataaaaatactagacaaaaacaaagatcatcattgcccacttagataaaggaagttagaatatcctcctgggacttgtgtcaattaaaagggtgggtcctcatcctgattggattgatagtgtcatgatcaagggcattgagaaccagactgacgtgggtgaccttgggcaagctagctaaggtaagctagctaaggctcaatttcctcctctgcaacctggagagagcaatacctacctctgagagtaaggaatgtatgcattaaagggtgagttcattacctggcatgcatagaaaatacctcataaattaccattccttcaggaaggaccaataattctcatcacagacttctcgtcattaaagcaccaggtgatggggggattaaatgtggctttattcttttgctagacacaacataacacatttttatttgaagtcagtcaggtggaaaggggcaaaaaccacgtgaaacacatgatttagagtctctcttacagttgcacgaacatcagcgtctactgccataaaacttgtgagacccagcatgtcgctggtgaataaatgaaggcaaggtgttaaaagggcaagtgcagggggttcaagcaaaatgctcactatgcaagttttgcaagctgaagagacggtcagcacacctactgctccagtcaaatgttcaggtcttaaattgcaatgatttttagatctaaaatgtgtatcatgttttatccaatttgcatggtccttcttgatggtaaagtcatgtttcttgaagcaccaaataacagggtagttattccctgattgctgggtttctgatttctaagccagagttgtgggatgcatgataataagaatacacatcaacctgccccaacaaggagagccagaccccaggctgtgaggtcacagtctacccaggccttcccctctgtccatctatttgcccttcactccttttgaagccctgcctctatgtatcctggagccttctagctctcagcctctaccctgtctaaatctcctcccaaggcagggtctcatcagttcgatatcattaaccttaaaatgtatgccacttcagtgagatgaaatacagaattgtccataaacaagtacctgatgaaaagcttcagatagagaagtttgggggagaaccaaataagacttttactttgtctaaatcatgcttcaatctcaggccattttaaacacaaactgaatttcccttgctgtcgattggctgttgaagtcacagatccaaagttactgtaaattgaaaacatcttactgaagctttaaccttatagcaagggtattattcaccatttctcctatgttctatttggcatttatgctgggctttcctgtctggaccacattggaaatcagtttccagggaacaactagaggtcttcagggcttaaaaaaaaaaaaaaagatttatttttctaacatctgaatttaaagttgcaactccaagtacatatccataacaaagtagacactggaaattaaattctctctcttttgtctctaaaagtggaaaaaccttgctggggaagcatttttcccttatgatttgttcagggccataaaatgttcccccattaaaagttctacagtaattactttattcattattcaaaaatattcaaatatttaacatgtttacaacactatattaaatgctacaggggaaacaatgatgaatgtttaagtccctgtcctgaaggcacttggaaacaagtagtggatgaaagacaagcactgtagccaaatatatgcctcattatttaataagacaaaaactgatcagttgcacaggagaggcctgccaaagttctgtggagttctcgaagttgagtgggcattcataggtggctggagaaatctgtaaaggcttttagaagaaggggccatgcaaggtggtccttgaagaatggggaggatatgaactactggaaacccagggaagagtatcctagggaggggtaggaaaaggtagaaagtaaagggtaggtctagagaatagcaagcaatatcttttgcccacagtgttgcctttgtcgggggggtgggggggctagaaaagaagggggaggccagatcaggctaggttctttctttttttttttttttttgacagagtcttgctttgtcacccaggctggagtgcagcagcgcaatctcagctcactgcaacttctgcctcctgtgttcaagtgattctcctgcctcagtctcccaagtagctaggattacaggtgcccgccaccacgcctggctaatttttgtatttttagtagagatgtggttttactatgttggccgggctggtctcaaactcctgacctcaggtgatccaccctcctcggcctcccaaagtgctgggattacaggctggagccaccatgcctggccagatcatgctagttttaacttggttatgatacctgtactgtattcaggagggaacaaagattatattatgacctctgtgcaaggcgtggcatgatcagagctatgcttttggactattagtttaatgtcgtgtctgacataaagtttgctaggagcagagcctgaaagggggattcttgtacaaatattccattgaaaggtatcttacgagcaatttgcaagggagtgagggagcatgggaagcggctaggcagagatatggtttcagaagaagtctagcttcagcctgatcccacagggacctctagggggttaattgcaccagagtttgtcctgccaagaaacaaggaactaggctgttagactcctgcatcagtgaggcactggtcacaagctgtggtggggaaagcagggagagggattcagcatcatcttccaagtatctgtgggcaaggtagttcccattagctagatagatagttgttcaatgaatgagttggtggtagaaacagggataggatgttgcaactgagtggtctggagacaagaaaaaatagacaactgaattttttgagtccaggtaactggtagaggaatgatgataataacaaaaaataggatctggggttgtagggaaagatgctggtatctttaagaataggctttcttagaggtggacctactgtgagccaggggaattgatggatggagaagtaggcaccattcctgggcaattgctgagtcattctttcctattatggctatttcttgagctcctactatatccagaaactgctgagagtccttgataccctaaaagtctcctttctctctcatatattatatcctctccctttctactcttgaggctttcccattttccttttttcctatctactgctttttctccttataacctccctgtgagctggaatgaaactgtccatcatctttgactgtttgttttcttgcccccaactgaatcggttataacatcctacccctgttgtttttcctaccactttattcattgaacaaatatttattgtctactttgtgtcaggagttgggatacagaagtgaataaaatagaaaaacaaatcctacctttgtcatgctttctcatgcctccatcatcatcctcatcatcatcatgatgcttttagttcccatccttagggctagaagtagcaccttcctccctccaatctgttggttgttcagtctgactgataatgtgcagcattaaaagattttgatcatttaaaagagaaatggagaaaatatggaggagatgaaacgaggcaagagacagaaggaaggggaatgacgttggcatttgcccagggttactctggagtctcttccagttccaacattacacttattttattaaatcttttgtgtttgcatgcaaaactggctgactgtggtctggaaggctttatatttcattgaataccactggaagtgtggtattgcctcccttcaaagggaggcagattgtcctctgtatgtccccatggagttctctgccacacagaacgcagcgaagttttgcgtgcatttcactacactaactactgttcttttatcatcaagacatcttttccttccacagctacatgcgaacctggatgtaagtttggtgagtgcgtgggaccaaacaaatgcagatgctttccaggatacaccgggaaaacctgcagtcaaggtcagtaaggtagcccagggtcatagttcaaattcaatcattgcagcagggctggcgactcaatatggtacgcaggatttcttagggtttttttaaagtcaaatcttcaaatgaaggtgctttcaggacaagtttttcaatctcttctccttgaaaaatgtaaaaagtctgatgtttttgtcaagatgcccaataaaaggccttttttcttttcttttctttttttatcttttttaaataagctaaaggtcttttatattttttacttttttatttcatctctttccgtaacacagaaaaaaagagcctttttaaaaagtaaataattttattgctttttaaactacctatgtattataagtatatttttatttttaaaaatccagcagtgcaaaaaaatataaacttaaaagtgagagtgatcaccactagtttttactataagcatagttaagtttgtcttagatcctggaagtctttttctgtgatagtataaatgtaagtttttctcataggcatctttgcatgtcagcacacacagaactactttacattttttaaggctgtatcctagtccctagtgtgaatacttttatcctttgtgcaaaaatgtgctttatttaaccattatcatttatgttgtctccaattttttgccattacaaacagtgctaaatctaacattgttctctgcatagccctgctttcttgaatgaatatttttgtaggaaaaatatttaaaagtggaattgttgggttgaacaacgtgcatatttttattatacttcatatactttttttttttttttgagacagagtctcgctctgtcacccagggtagagtgcagtggcgtgatcatggctcactgcagcctcagccacctgggctctagcaatcctcccatctcagccttctgagtagcagggaccacaggcacacaccaccatgcctggctactttttacagtttttgtatagacgaggtcccactacgttgcccaggctggtcttgaactcctgggctcaagccatcctcccgccttgccctcccaaagtgctggaattaaaggcttagccaccacacctggccttgatatatcataacagataatttataactttcatcctagattgtttgtctgaaaacattaaagagatgataatatctataacagtggttctcaacctgggtaattttgtctcccaggaagcgttgccagataaaatacagataccaagttagatttaaatttcagataaacaacaaataattttatagtatatgtttgttcaaaatagtatataggggatgtgagggtgatctggctgtgacatctgtcaccccattgctcacctgggttgatttggctgatctggctggctaggcagatgtccccttcctccctcactgctccatgtgtgtccctcctgaagctgcgcgctcgtgtggagaggacgaccatccccgatagaggaggacttaccttcagtcaagggtatattagctgtgctcccctgctagcacctccaaacaagctctcaaaatagtatatgagaagtgtgtatactttaaaagtattagtcatttatctgacattcaaatttatctgagaatcctttactgttttgtttagagatgggggtctcactatgttgcctaggctggagtgcagtgactatactgcatccatgatctcctggcctcaaagcaatcctctcgcctcagactcctgactacaggcacacaccaccacacccagctggaatcttgtatttttatttgccaaatctgggagccttatcccgggcaacatctggcagtgtctgaggacatttggagggggtgctactggtgtctaatgggtagagatcagggatgctgcaaagcaccttacacaatgcacaggatagcagcacccacaacaaagaatgatcagacccaaatgtcagtagtgccaaggctgaaaaaccctgctgtaaacgtggtgaataaaagtgcctcattggagcaagggatatggtctttgctatagatcagcagatttcaacttggctgattttgtcatccacgggatacttgacaatgactggggacaattttggttgtcataactggatgtgggaggtactcccggcatctagtgaatggagcccagggatgccgctaaacatcctgcaatgcacaggacagtccccacaacaaataatgatttgtgtcaacggaagttaagaaaccctggcatgaagaaatcttcaataattcagaaagggtccccagtcctataaggaagttgaacaaagagcagtaaatccaattcagctgcccttggagaatggagtttcagagaagactggacacccactccactctaccactcccagcccttgctgccaagcccagaggttagccccataaactgaaatagccgctctttgagctgccagccctacagtctcggagagcaatctggctctctgcgtcctgccaccagcatagaggccagagccctggagatgtttcttagaattgcatgcaattgcttgagagaggtgcttcaagaatcgtgcattcagggtgggcacagtggctcacacctgtaattccggcacttagggaggtcgaggtgggtggatcacttgaggtcaagagtttgagaccagcctggccaacatggcaaaaccccatctctactaaaaatacaaaaattagccaggcgtggtggcgaatgcctgtaatcctagctactcgggaggctgaggcaggagaatcacatgaacctgggaggtggaggttgcagtgagctgagatcgcgccactgcactgcagcctgggcaacagagcgagactccatctcagaaaaaaaaatcatgctttcataagtaataattcagctatacccttcaccagaggttttacagcagaaaacttggttttccatatgttttggattctgaaccaagatactgtctcaagagatttggaatagagacaatattttccacgctagttttaaagtctcagcaaaatattaacgttgagggagtggtccagttggatcaagttttgaggcagtctgttttcttcccacagcctccctgccctgtggcagcctgatcaaagtccacgtacatccattaatggtgacaggcctcagccctcaactcatgtctttcccaaaacactcttccaagaaatgagtgagtcacctcagagttagggccaagctatgggatattcctgggtttcccgttatgtccaatcagcatttttcaatttccccatttgaagaggttaggttctatgagggagatggtagggtaaaggggataggcagtggagaagagggtttcaaatgtccagctagggcactggaaaatccccatataaggatattttcagagatgaaagcagctccttattttcaagaatctgttaccatgctgaccttttgccttccatggaatttgtttgtttttttcctctctgtatgttccctggtagagttaagatatgaaaccctcacatgaccacatttccaaaggcgacatcctctacagataatcctttttaaagttctattttccttctgtgtcattttttattttaataaaaatgttacttattcttaagttgttgttgttgttgttgttgttgttgttgttttagaaaacaaaaaagcacagagaagaaagtcaccctcgatcttaccacctgaagataaccattagtcgcatttagagcataccctcctaggcttttcttttcctatgtattttttaaaccaattttggaatgatctgtacacagagttttgtaaccttcttttatcacgtaacatcctgtgaacgtcatatgtatatatttcatatatatataattcacatatatataattcatatatatatttcatatatataattcacatatataattcatatatatttcatatatataattcacatatatataattcatatatatatttcatatatataattcacatatatataattcatatatatatatatatttttttaaatcatccagcccaaatgtcatcctgtgaacatctttacttaggattaaatattgtcctccaacttcaccactaagagctgtctgacagggctccctctagaggaatgtgagccaaggcaatttggccagtgcaggggccagccaaaataataatcgacaggaggctgtgctgtcagcttatgtcagcggctgcttgggatagcatgaaaggcagaaatatataaattatctatttctaaattattgttcaagtagtatacacatagaattgtgcatatataaaaaatgtatggctcgatgaatttttctaaatgcccatgtcactagtatctagatcaaaagccagaaacttggcccttcagaagactccctcacacaccttccagtcacttccactgccagtgagagaaccatatgttgacctcttatatcacagattagctgtgcttattttttaactgtatataaatggactcatacagtatatacacgtttatatccagcttccactcaatatcatgtttgtgagattcatccattgttgcctatagttgtcgtttgttcagtttcattgctatatagtattccattgtgtgaatatacaagtcatttatctattcttctgttgggaggtgtttggattacttctagtttggggctatctagtatcatgctattatgagcattttagtatgtaggggaaatcccaggactggaatttccaggtcatgagtatgtctaaatatagctctagtagattctgccaagcagttttccaaagtgttgtaccaatttacattccttccagtggtgtataattattccatttgctacacattgtcaccaatcctttaaaatggaatttgatggtcagagagaaggtgggtaagtggtggtgttcagggaagctaacccagttgtcctttccaagactggggtctaatattccccatctggaagtttcctgattcagttcacctttccctgttttctaaatgtccctgcagatgtgaatgagtgtggaatgaaaccccggccatgccaacacagatgtgtgaatacacacggaagctacaagtgcttttgcctcagtggccacatgctcatgccagatgctacgtgtgtgagtaagtttcaacagccaggctgatctcagtcaatgtttaaggcttggcttttgccatttgatgcttggggaaaagctgacttcagtgattttttaaaaaatctctaatattgcccccagctaaaatgttttgtggcacttgtttctttctttcttttccttcctttctttccttctttctttctttcttctttttttttttttttttttttttttgagacagagtctcgctctgtcacccaggctggagtgcagtggtgcaatctgagctcactgcaacttctgcctcctgagttcaagcaattctcctgcctcagcctcccgactagctgggactataggcacatgccaccacgcctggctactttttgtatttttagtagagatgggggtttcttcgtgttggatggggcctctgtcagcctgtgtccttaagtgattttattgagaagaaacccctgaaaaattctctttggacatattacatgagtgagaaataaacctttattgttgctgtagttattaatnnnnnnnnnnnnnnnnnnnntagtaagatgggtttctcgtgttgtcagctgtctcaaactctgacctcagtgatccacccacttcgcctctcaaagtcctaggattgcaggcgtgagccaccatgcccagctcccataatttttttaaaaaagtaagtgctgattgggcacagtggctcacacctgtaattccaacactttgggaggctgaggcaggtggactacctgaggtcaggagttcaagaccagcctggccaacatgacgaaaccctgtctctactaaaaaaaaaaaaaaaaaatacaaaaattagctgggcatggtagggcacctgtaatctcagaaagaaaaaaaaaagcggtaaaataatgtgaaattcacattattttaaatttcaagtgaacaattcagtggcttttagtacattcacagtgttgtacaaccatcacccctatcgagttccagaagatcttcatcactccaaaaggaaaccagacccagtcactcctcactccccctcctccagcccctggcaactacaaatctgccttccttctctagggatttgcctattctggatgcttactttataaataaaaaggcaaactaggagaaaaattaattatatatctatatctgcatctatatatatgcagagccctgttgagtttcctcatgaaaataagcacgttgaacaaaataagcagattgttttagggaagtgatacatttaaattccttctcggaacatcaattcttcccaccagctaactttctcacgccccttgccccactaccaaagattagtgatacttgttggaaatacattccgacttactcaattccttgaaagaaaagcccttctgtgataaagaaaaacccatgtcctgtgggagagtgagagtctatacccattcatttattgagagggaaggcttttcaggttttatgttccagttgaaagggaaacccaccctccctgcctgccttcccttctccccttttctctctccatctttctttcctctgccttgcagcccccaacaaacccagagcctgtgccttcagccagcttcctgtggttgcggagttgcacagactccccagcccatcctgggttttcccgagattataaaatcttgcctagtgcacgggctcctccttggcaaagtgtcccaacaccaccagtcacgtagatcttctgctagcaagcaagcatttgaaaatgggcattggaagggcctttttaaaaaatccttattattataaattaaacagaaactcacaggaaacaaatgcatagtttaatgaattcttataaggcaagcacccttgtaatcatcaccaaatagaactctgccagaacctcctcctcccacccctccctaaagggaaccactatccaggcttttatagtaatcacttaaaatttcaaaaaagatgtacgctaatggatgtttctgaaacattccatgaaaacccagtcagtgccaaaaaagatatctttcctcaaatggaaagatagaattaggttaattttgaagattaattttaaaagaagacaactaaagagaaaagatgaaagaataaaggagtaatataatcataggtagatgtttgttataatacattgggtctctttctgtatatctaggggttacctgtgcctccctgtttatagctcaaagtgtccagatagccctagaactctctcctggatgctgattggattccaccaggccccttgggtctcttttgtccagctgggtgattggcacgttctggagggggatggagggagggagtacattcaccatgcccctctgttatggacattgggctgaaaccatatgagtttcttagcccccctgcatttctaatccacacatactggactgctgctataaaaatgcatttgtgtaagataagttatatttagcaacaagtgacaaaaaagccaagtaaattgtctcatttactttaaaagctgaaggcaagcagttccagagcagctcaagaagaagtccatctctgtcatcctcagagtattgattttactctcacacttgtggcctcatagttacaatatggctgccctagctccagacatcacacacacatgggaaaatagacaaaactaagtgggtacgggtgatgccaatgaaccaatgcctctttcatgcctgtctctttttatcatgcagtaatatcttttccagaagccccactccctccagtggacttatttttgtatctctttggccacactgcatcatatggccactccttgctgaaggaaagctgggaaaagcctcagtgctgggaatggcaagagaagagtccagaatggctttcagatagctgatcagctatatctgccacacgttttagttcagtcacctaaaatatcgagtcttgtgacttaagtgactctcactgaggctagatatgtatggagagctctccagagtagattcttttaccctgattactcaggttgataatctccatcagcagttgcaattcaacctactgaggccagccaggtgacataaaagagtggctagagcacacacaagtggagaaagtgatacagtttgaggggtgcatgctctgcctaaagacagtcaaattcagtgaagtggccaagaaagcagaccatgagtaggattcagtcccagggccaccaagatgccacccctactgatcccttttggctctccatttgggactcagacaatgaaacttgtcctataatgccatgcaacgtgttccattcaatggctcagaatttggtgatagtttcttagtaagctctttttatcatctcaagagagaaaggctaatccttgtctactttttcagactctaggacatgtgccatgataaactgtcagtacagctgtgaagacacagaagaagggccacagtgcctgtgtccatcctcaggactccgcctggccccaaatggaagagactgtctaggtacaacagcaggaatcacctctactcctccttctcctcccttgactccccttttactgaatcttttttcattcatcacaatcagcttgttgactagacattggaaacttctaaaagtacagatttatatcagtttctgagatacttttagccacatatgctctaaacatactttgggatgctaaaaaacacatttttctattattttgtattgccttaatgccatagtagaaaagggataattttagtatatttactatgtacattttatttaaattaccatccaatataaactccactacttatattttgtcatttaatgagtaaggtcctaaggaccattgggttttattctgggttctagctaatattttctggaaaaactatatttacttattttttagatataacattattgaaaatagtatacaccttctatataatttacattagcatgtaataaatttcatgttgtctttaaaacttgctccaagttatatgaactaagtataattaatttaactggagaaaatgagcagattaggtccataatattaattaagggaacataaaaattatttgtttataactttgaatttagtcaaattcattggcttagaactttcctctcttgttctcctttgtcttattttgtgtcttagttttgggttccacagaagctgaccctgagcaagtagttgatttgggaggtgatcccagcctgaaatcccagcctgaaattcattcactaaggaataaaatatttatttcacatagattagggcaatagctgactggtaccagaatcttatgagtaagattctggttgaggagtagggaagtaacccagggaaaggaaggcaccagtgttgggtaaatctgatgagcaggttaaatgagctgggggcacctctgggaggcagagagaagctgcccctgaattttccctctggggcaggagtgctggatattcatccaccaacttctgcccttcattgatgggaggctgctctgggacatgaccccccagcactcccagcctagcctgggtcgggagcaaagcacaatgttgtaggtgcagcaagcagcctttggcaggtatggaaacttgagtgctgaggagctatggatggagcacccacagggcaccctcagtgactgaagcaacacttttttcactttgtgctttggttcctttgtggatttgaattatgttcaaccatcaaattgccatcaaattgtatatactcataacacttaattacattgcacctaatatacataatatttagagtaagtgagcacttagcattaatgagggatgtcaaaccaaatcagaatgttgaaagagttcttaatctgtgatttaaagaagcacatatcagtatgatttcataatcttcttcactacaatagaaatatttttcagtcaaggtgctagatgtttatttatcctaactatacataatgtaaaaaaaactgcatttagaaagctcagccaaatggatcctaaattagctaaacactttttaaaaatatacatgtaaattaaaattttgtctctactctgagaataatcaaaggtttaattaggttcacaggatttactacttttattataataagatttatatgacaaggctaattattgaccaaactgaatccaaatttccacccaactctttgagttgttgggtgccatttttattggaagggaaaggtgatgtgcatgaaaatgatcaccaaaaataattttgttcaacccaacacttatttattatttggaaaatgcaagaggccagcctgggcaatatagcaagactccatctctataaaaaacttttgttaaaaatagccgggcatggtgatgtgcacctgtagtcccagctatgctagaggctgaggtgggaggatagcttggactcaggagtttgagaccagcctgagcaacatagggagaccccatttctacaaaaaaaaaataataaaaaatagccaggcatggtggcacatgctttgtagtcccagctactcaggaggctgaggtgggaggatcacttgagcctggggaatttgtggctgtagtgagccatgattgttctgctatgctccagcatgggtgacagaccaggccttgtctcaaaaaaaaaaaaaaaaaaaagattgcaagggaaatagtaagacaacatcaacttgccggtttaagccaggttcagaagaacaaactaacatctatttgatttgacatctgaaagttaaaccaagcctgagtcttagtagattggtcagcatagctgtcagcccctctgttacctgactttcaatggtagaaaaggaacaacacacctattgttggctaaaattacatcattacataattacacctgacccacaatttatgcataagtgcatgccttcacaaccacatttctgtgagtcaatattgcaggggccttggacagtcttactcaagaaatagttattttgtaaaatgcaaattgtaaaagtctgtgtgtttggtttacttaaagtatagctatctgactctagtttcaaaaattgtatatgttatacaatatacaatattcactcagctggagaaaatattcactcagcacacacgtaatgtataggtaccaagtgtcagacacatgctccctgcctgagaacagccagggcctaacagaagatgtgaatgtaagtaatgacattatggaaagataatgcatcttaaaaaggtataaaataatataaatacataaagtgaagagctgtgtgtgtgcctgggggatctagaacacttgccagaggatatgatgttggcaccagtatactattatcagtttcccagataaagaaaagtagctgtgagtgtgcgtgcgtgcatgtatgtggctacttttcttgctatcactgacaccttctggtttttacaccctagatattgatgaatgtgcctctggtaaagtcatctgtccctacaatcgaagatgtgtgaacacatttggaagctactactgcaaatgtcacattggtttcgaactgcaatatatcagtggacgatatgactgtataggtaagattcgatggcaccttttcctttttttcctgtccccaccaaacctttgagccttctctgcagatattttgatgtcaattcaagctattagttgaacaatctactgtgctgaccagcttaacaataaggaaaggttatttttttaggtgtctggcatttagggaattccaatgacatcaattataaagctaggtcaataaagatttaaagtaaggaatacagctctcttgtggaaacgattatctcaagatgattctggtgggactctctttaatttggctttttgttttgtttatattttttgttttatctccagttacacatctaaaaatcagaacaataaagcagtatttatatttggtaaaaggaagaataacaaggtctatctaatcttgatctcagtgatctgtttataacagtctccatcaggggtggctttagagaaatgtatgagagacatgaaggcctatgctctttactttcccctctttcagccctttcatagttcaagctccaaatataatgttccctttccacagttaccaaaattgctctctgataagattctggtatcagtcagctattgccctaatctatgtgaaataaatattttattccttagtgaatgaatttcaggcctccatgaacaagtgaggtggggtatttggggagaccttggatgcattcccattgccctttatataatgtaggatggggcctgccctatagtgaagggaaattcgggctctctgtggatttctctgcccgtaacacgtgtaacaaagctatatgcatgacatggaaggctaatagttgagaaaaaataggatttctttcaaccctatactcagggcttcccaggacacgtcttgtgtaatcatgttgggacaacacacaattgctgggtttcgaaccatcttgtgaagcctctacaactcttccctcaaatttcaaacacaaagtccatcctagagaggatcataaaatccatatttctcgtggacttggaccccatgccctcctgcagaccaaaccagcccagtaatcctatgatgctgtgttacagagtttaatcctgtttcctgatacctaaggggaggttccacagaacagggtggaattcacatggaaaggttcaaaaggaaacaaatctttgagactttaaaggtgactaagattaacatctgagctcagctttgtggctaaattaaaaccaacagactattttgtacatacatgtctacaaatgcatagatagaaaatggggtggagaatacggcaaacaaacctctcgcttgggtgaaacttggcaaattttcctcctctaaacccagcagacaagctcaggccagcctgaccctttctcctggcagtcttagaacaaaatgcctgtgcctataagttagatgatgtcaacggttcctagttgatcttgcctttgtttgttaggagtttcaagaccttctgaatatagaattgattttctggtattgttatttagttctaagttagaggagaaagttaagagaaaaacctaaacatcttacagatttcaatagcattgataagcaggagattaaattgctgtgggggagggaagcagcaaacactccctacataccaggcagcaaacaaagccagggctgctggccaatgagcctgcagttctgaacacctctcagttctcaggcaatgcttggtttgtcaggggtgtttagtgcttggccctacagttgatcaagtgtaagggtgagtctttcagcaagctctgtaccacagagtcgttcactggaatgttcttttttagatataaatgaatgtactatggatagccatacgtgcagccaccatgccaattgcttcaatacccaagggtccttcaagtgtaaatgcaagcagggatataaaggcaatggacttcggtgttctggtaagtagcatttggtcatggtgtcttagctattcccaatgaagcattctccccatatctccttcctccctctatttctctcctttctttgtcttcctcgccttctccctctcccttactctcactctgtgtgtgtgtgcagtgtttaactctctgcctcagccttctcttctttgctaattggaccacatctccaatactcactgaagttgtaggcactaaacttaaagaacagcaagggtacttaatatctttctggccatgacatacttcaaatactgaacataacatttaaggacaaaagacactgagcaaatttatctatcaggatagactgagttatgatgcagtaacaagcaaacctaaaataacagtggcttaaaaccacaaaggttttttaaccaagtgaatccggacgttttccagaatgcacaaccaaaacaaagtaaggcaaagctgatcttcattaaagtatgattactttatctgtcatcctcaacgctggatccacttgttttaatgtatatagcagagagttccattgttcttgctggtgaattatttaatactttttgttaaaactttaaatttataaaccagacatctaacaataaaatgtcactgctattaataactacagcaacaataaaggtttatttctcactcatgtaatatgtccaaagagaatttttcaggggtttcttctcaataaaatcacttaaggacacaggctgacagaggccccatcattttatggtaccatggtctcaattcaaggccttaaggtttgtcacagcagagaaagaagcatgaacaatcatgcaccagctgttagtttattcagcttggaagtatctaacttcaagggacaaaaataatattaaacttgctgtgtgtcccaaaagagaagaaaactagaaatcttggtgaataccaggaatgtcttccaaggcaaggcagctatgattacagcacaatcacttccctaacaatatcttacaatgtttaaagtcatccaggttcggctgggcgtggcggctcacacctgtaatcctagcactttgggaggcccaggtgggcagatcacctaaggtcaggagttcaagaccagcctggccaacatcgtgaaaccctgtccctactaaaaatacaaaaaaattagccgggcatggtggtgcacgtctctaatcccaactactcaggaggctgaggcacaagaattgcttgaacctgggaggcagaggtttcagtgagccgagatcgcaccactgcactccagcctgggcaacagagtaagactccatctcaaaaaattaaaaaataaataaataaataaagtcatccaggtttatccctctggtcatgacccttttagcactagctcatagtgtgactagacttgttgactgccctgattcaactctcttatataccccttagcagagttcccgcatgttcaataaatatggctgcaaggtgtaccctaacttacgtcacattccatacacccatctggccaatgctcccaatgatgcaaatgactgtaacagtatctactcagtcatacaaaaataaactatatgtaccatgctagacattcagcgccacacccataaaaggttcacagtaccccagtgggctattgttgagcaccactggacaagagtatgtataaaagaatataaccaaagaaaatgagtctggaaatcaaattctgtgaagaactgccaaaagaacagggcagcatttagtctgggaaatatagtatggaaaagcataaattgtgcctgtaaatactttaagaaatatgaaataaaagtggctttctcaagcaaactaagtccagtgggtggaggttacattctctcttaaaaatggctgctaggtattgaagagtggagcagggagccccatggagtagggacattccactgcccctggcttgcaggctgggggctctgagacggattcctgcattgggctggagatggtattaaatgaccacttagtgtccagcaactggatgccatggtttctatccctctagatagaagtatccaatgatgtccttctgaaacttgattcagagagagagattggctgcccaggcagggctgtgcataggtaggttggggggaaggacaccataaccttgggagttccccagagaggagactgaataaatcagctttccatatcggatgagtgcccaagggacctgtgctcaaagctcctttatgccaccaaatttgaacatgcacattccaggttgggaaggcctgagtttaaatcttagctctgccctatgctggctgtgacctttagcaaatttcttaacctctctaagctcagtttcctcctgttcaaaatggggtttatggtagtactgtggtgggttcttgtaatgggccagtccacagtcccttggagctccctaatcctattgaggtagggtagacagttgcatgcgtatctctagcagtgctctctctgacaggagtctccagcttccacttcacggggtgggacagttctgaggtgtgttctgcactggctcccagatgtccccagcaggactgagccccacttacccacagagattacctgtccatctaagcaccatcttttggcttttctcccttcctgtctcactgtctcctctccccagtttctgcctcctggaatcaccttccaagtaagtcatctgcacccaaatccttgtctcaggctctgcttagaggaacccacactaagacaaatatgtctcacagaggttcattgtgaggtttaaatgaggtaatatagagagagagcttagtttagcgggaccatatagtagatgctcattaaagttcgctgtgattgttattgttattagtatcatttcaatcagctgtttgttaagggccacccactctgaaatttcacaaaggtaaatatgaaaatgttgtgcatacaaaaaaagacacctcaggaaagcatttgtttcaataagtgggcaactcacccccacatactcactctcctacccctagaggggaatcgaaggcccagagtaaacctggagccatctttcttcctcgtcatttgatccccttaaaccgcaatgtattattaatgttcaaatgaaggcaacatctttaagcatgcaattagatagttgtttgcagcctgtgttttctatattgtaactcagtgctttgaaattgtaaatcctacatcaacacaaacatttcttgtgtcaagaaaatgtctgtttttcttggaccatccaactttattttgggataaaagaaatttgtctttattctttgaaacctcaaattcatcacactgttctattcaatatctgaaaattatgcattttgttatccattctgcagctaaattatttctttagtctttcactggaatgtttatttaaaggagaaaactatctttgggtcatttactatattacttgtccaacccttttcattttgctttaattctctaattctccataaaataaacagccatgttactattgaaaattcatcttaacaaggtcttaacattcattgcttaaagaaggatgcctcaaaatccactctttttttttttaaatttttttagtatttattgatcattcttgggtgtttctcggagagggggatttggcagggtcataggataatagtggagggaaggtcagcagataaacatgtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctcccagacggggtggcggccgggcagaggggctcctcacttcccagacggggcggctgggcagaggcaccccccacctcccagacggggcggctggccgggagggggctgccccccacctcccggacggggtggctagccgggccaaaatccacgcttatgtacatacaagagtcataaaaacaaaaatgagagaattgcatctagttagcattcagcattataaaacattataaaatgttatattacaaatacatttgtatgcacataaattgttattatataatctagggcataggccgggcgcagtagctcatgcctgtaatcctagcactttggaaggccgaggcgggtggattgcctgagctcaggggtgcaagaccagcctgggcaacacggtaaaaccccgcctctactaaaatacaaaaaattagccaggcatggtggtgtgcgcctgtagtcccagctactcgggaggctgaggtaggagaattgcttgaagccaggaggcagagattgcagtgagctgagatcgtaccactacactccagcctgggcgaccgagcgagacttcatctccataaatatatacatatatatatatatatatatatgtcatatatatggcattgatgtagcaacttttattaagttcattgttttgaaaatttcagactctacattgcaatatggaaaaagagttagattatcctaacccattctctgtacctaaaggaagaagcaccctaaatgtagatgtgtatatgttccactgttctaatatgagtattaatagtatactgccagataatttggtcttgatttgacagcagctacacctcattctaagaaaatcaaaacccagataacactcaatttggggagtaacagtcaacttaggaaaggaaactgtcattggcttacgaggagcacagcttctggaatcgtattaccttagcttgattcctgacttgctagcctactacctgtggagtgagaacaaattattcaacctttcagtgcctcagtttccacacctgcaaaatagggatgatagtatctagcccttaatattgttttgatgattaaatttattcacacagaataagtgagcgtccatctaaagagcttagcaccagcccagaatatatgaaatgttcaataagtatgtgctaggagtaggagtaatagtgacaaagccctccttaccaaaattcaacaatcatttctgttgaaaagcagcttctttagtcactaaaaatatgctgattgcttaattcagtttgtagggtgtgtattcaagaatatgggttttgctacaaccaggccatccccattttttttcttcaattataaacattagaaacttggaggtatggcctgggaatttttctaactctggaaaagattttaaacattctggtcatgaatgctaaaaataatagcacacatgctgagtgtgtgccaagcactaatcttagtaatcgatgtgtgttcacccatttaagcctcccaaaaaaatctgttcttatcccaattttataaatggagagactgaggcaaagagaagttaattattcatttgaggacatatggctagaagatgtgggagctaggagtcaaactcaggaaaatgggcttcaggattatgtgcttaaacacaggacaggtgtgttcatgaccaattggttgatcctctgtgatggagaactcacagagtttgccctcctcagcaaactctcttggctcatcttttgttctgtcctagccccttcctgtttcctgggtcccatgctggaacacattcttcatctgtgattaagcttcttcttccaggactgtgtccaaagctcagattagtagaacttttctcctcccagatgatagatcatctaatgcactaagcacagttgaatgaatgtcaaagtcatattcctcctgggtaagatattctcacctaagagtgatcttctataaagttttattccaaagatatgaaattaaaattagggttttcaggttgatagaagtgtttgacaacatgggtgtttggagaaatctcaaatacctcccgagagaaattgtcaactttacaaaaaactggcctgtgaacctgaagacctaagttttatatctgagttccccaaatgtgccaaagaccctcctactgcaactccctccatattttttttttttttttgacatggagtctcactctgttgcctaggctggagagtagtggcatgatctcagctcactgcaacctctgcttcctgggttcaagcaattctcctgcctcagcctcctgagtagctgggattacaggcacctgccaccactcccagctaatttttgtatttttagtagagacggtgtttcactatgtatgttggccaggctggtctcaaacacctgacctcaagtgatccgcctgccttggcctcccaaagtgctgggattacaggcgtgagccaccatgcctggcccctcccacatttttatattctcaaaaagatgatgcaataatcaataaatctttaagagaaaaccgtcataatgtcaaatttgaaacagcaatacctagataaatccaaatctacttatgcatatgcatatcattaaagtgcatttttatccttgcccagctttctgtttacatactaagagaatgaaattgtcaacactatcaagattatgatgttttagtttttgtttcttttcaataggaacatttgaaacttcaaagcagaaactgaaagcagatgtttaggtttgcctggtgtgagctgaaaccctttcctcattatttattaaaggtctttagttttatgttactgattgcaaaaaggaaatttgcagggaataggggtttcctgttaatttttcttgccaggtgctggagaaagatgcagtcgaccatggatagaattacagtggggcctccagaggaaggtctatatatgatcacacattacggtcataacttaacatgcaatctctggcaaagtagctgaaacaggctatctgaaggtcaggaaaatgagtaatgatgcattacttgtattagtgcttgttggttttctacctatagtcaggctgtcacaatgataaataactagaatatttcattgaaaagaaaaatgttgctcttttgattccaaagtaaaagcaattattaattaagagcatacatattttcaaagcatttttcccccgtttggttaccccaaatattgtggacttctgcttgtttatttttctactactttgatatagattgaatcagccaaatgatggagaaggaacaaagcaggagaagaggttaaaacattgttaagaaaaatattctaataaaatcccactccaattttttatagtactctttttaggcatcaaaattaatgtctactccattgtttcacttctctctaaactatgtccaaataatagaattaagtgaattgattgaggtgttattagaccctttcttgcttagtcttagattagtacatgcctagatattttatagtgagacaatatatttgatttcaaatatcagtgtatttaattttttaaaaattaattacttctttacatcagttggatattctgaattatcatgagtatatccctgaaaaggagacatatatctttgaattatagatctcaaggaatttgaaacagtctagagaaaagtaaccttaatcttaaagcagaaataaatctatcatagaaataggactggaaaaaagagacattcatggccaggcatggtggctcacacctgtaatcccaacactttgggaggccgaggtgggtggatcacccgaggtcaggggttcgagactagcctggccaacatggcgaaaccccgtctctactaaaaatacaaaaattagccaggtgtggtggcacgcacctgtgatcccagatactggggaggctgacgcaggagaatcactgcaacccaggagggggaggttgcagtgagccgagatcatgccactgcactccagcctgggtgacaagagtgaaactctgtctcaaaaaaaaaaaaagaaagaaaagaaaagaaaaatagtcattcatatgctctactgccaaatcttagctccgtccctaacatgatgagtgcctttgggcaagtcacttaacacccagttgcctcatcgacaagacaagagtcctggactaaatgaacttttttgtacctcttgcgttcttcgacaccaacatttttcctccaagggtcattagtccactgagggataagaagaattgatctagaggtacatttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagagactagaggtacatttttaaagtaatttacttttgtggtgggaaatagaaaacgaatgaaaaatagtaagtatagaagcctctctgaaatatttaataaataaactcatttagctttagataatggttgactgaggtgaaaaaattcaaaggggagagagaagagagaaagaaaattgggtatgtgtatattgcaccataagtcaccatttttgtaggtcacaaatggtccattattagcaatttatatggttcaacctaatgctgtagctgtaatttttgaatatcaaatttggacaaatctatagggctatcaggacaataccagtttttgaagaataccacaatgaaagcagaaatattagacgaacatggcaaatccatgtctttgggatctgtagcccaactgggtagtaataagtgtttcactaaagtggtctccgaagcaaaacaaaagcaacaaaaggtaattaagataactaccataacagtggaactgcttaaaacaatacaaatatagttcttcctaatttatcatcaaatagtagagcctcatgtgggttcattctggaagcattcacttactacactttaacactttttaaatgctccattttgtgagtaatttaattatcttccaatttggaacatattgcctcttatttgttttagctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgttttgtgagtgttatttttattttatatgttttatgaaaaatgaattgcaatttctcctggcaaatgaaagaagacaaaaagccggtttcacagcttaagtaaaatgggttgggtcttaagtcctgagaagcaacattctctgtaatgtctagaaacgaataccttctgcaaatacccaatcaaacctgctgctctaggaaccaaggaggggaagtcctgttcccctacttggggggtttcctatttgacacagaccttctcttctagcttccagccaaggaagcctgctagtcctgcaagggcagtggtttggctgcccagctctccatgaggcatgcccccaaatcaaagagaggctcaccacatggatctgctaagctctacctttttatttcttgaaggcacttttacaggcctagtctatgaaaatggaacctcacagttgtatggttgtgattttaaaagccaaaatcgacaaatgtaggaggacaaattttatagtggagcttaagttttctatgtgaactagagaactgccgtaactcccttttcactagttgctgtgcagaacccaccataaggctcagtccccccaggagggtttccatattaacccaccctgcatctctacactgagactttcccattcattctggctgggcatttgttgctccctctatattttgccttatctagtctcggctctgtgactggtggtcatatatacaaatgccagatggatttaaccaaaggaaaagtagacacaggcccacccgtccaagaactagcatccggtgacattctctgccttaatagagagtgaaaaatctcaaaaaaagaaaaaaaaaaacatatttccaaaacctagtatgaagggatgtatcaagagtgtagatgcttagtttacccaaggaaatgtctggaaaagatgttttagatgaggaaactggatccaatgtgaattatttggaaatgttagggaaacactgctctaatatattctgtaattagaatacatgatctaaccttctttgtttggtcatttgattgataccttctgagcatgtgggctttaaggtttttttcttaactgaccaagtgttctttattagtccctaaggtgaatgaagcaggtgaattcggcctgattctggtccaaaggaaagcgctaacttccaaactggaacataaaggtaaataattctttctcccaagtgtatgctctttcatgttgtcctggtcgttttcatttcttcatacagtgaaatgattgtttatgaatccctgcttcattcgtaaacccccaagggaaaaatcattacatcacacacacagtgccagtattaaaatagtaggtccttgtgtgactggtactaatgattgaaatatagtaaggctattctcttctccccgccactcccacctgatgctgagagtgaatggttgaagcagactgtatatatggagatgggagaaacttacatattttcttcaactctactgcctgaggacccacaacctgaaagtcctcatgtactaaatttggcccaaagtgcctgtatcagttacctattgccataataatgctgtgtaacaaacaaccacaagccctcagtggcctacagcaataaatatttatttttgcttatgagtctatgggttggctggacggttctgctgccctgagctaggctgggtgggctcactcatgtgtccacatacagtcagttgtgggcctgcttcgtgatgttgctgatcttggctgtgctttcttacatgcctgaggcctcagttgggaggattggactcactcagctctgctccatgtggtctctcatcctccagcaggctagtccaagctgtttctcatgaggcaacagcagggtttcaggaaagagagcagcagcacacaagatattttgaggtctaggcccagaaatggcacaacatcacttctgccatattccattggccaagccaagtcacaaggccagcgtagacttcaaggttgtggaaggagctgtgaagtcatacaaagagtgtggatacagagagggataaaaatcaggaccatttttgcgatcattccaccaaagcctcataatctggagtttcttaggcatgatccctaattcctcttggtttatttagaacgttcaccactcatgacaaattacacagacctcagggaaaagcccatttatatatttatccctttcacttggtataagtatgaatgccttgatcatctctttccttttcaaagtttctttcacttaccactatacatgtggtaagtaaaagattagcataaccttttccttttcaaacttccttttacttaccactatacatgtggtaagtaaaagattagcataaccttgtgctaattgattcccttttgtgtttaccctgtgagtgcattgcccagttctatcactttggtttacaggaccatctctaccgcaaaaaaaaatgtacctctctaattcagtcctccaaattgtatctgagaagcttctactaaaactcttcaaagcctagtaacctatgacccaactcctacaggcattttgttttcttccatatttctcctaagtattctatgtttttgtttctctgcattagacaacttattgcccattttcctggttagaaagaaaatgtttcattgtacagggggtaagctacgttctccaggtgctcacaagttctgcccaagctctgtctacccttgataagtgacatgaaggaatccgttgactcctctttcgatccccaaaccaccagatttcttagtttactttctattccatgattcctaatgaaacacagaaaggttaaaattttgcacatgaccatatgaccctgtaatttcaacagtccttgagtaagttgtcttggaaagctcagtcccaatcagaagattcagatgcatactgcaactcttccactggttgtttgccttggacaagtcacttggatttgcagtgcctccttgctttcatacataaaattggaataagagcaatattcatctcttaggtgctgtcttaggctgggttccccagaaatagaccccaagataagaatttgtgtgcaagtggtttatgtggaagatgatcccaggaaatggtggttgggggtgtgcataagtgagatggggagacaaggaggcaataatgggtatgttatcaggcaagtttccactgtgggcaactggagctcaatcccattggggaactccagaagccagtgtagaacacatggctcataattatcctactgaaggagtaaggaggctggggcatatatataccaactcccatctggcattgattgaaggctgctcccaggagggtgctgattccttggtgctcctggcctggcatgaaagcaaggaagggcaccactggggcaacttgatctcaatcccacttggaccctcgacaagacaggggaagcctgaattccaaactgactttagtccacattcaattccagcacttagtggtcctttccaaaggcaaggaaatggaggtatctatccaacaactcctgtccatcactggttgagggctgtccctgggaaaataacttcccagcattctagctcacctggttgggccaagaatgctccagccagagaacaccctcacacagagagctgtgagtgtttccagtagaaagccaaatgcctgcaagagaatataagtactgacagatatttgtgtggcaccaagagcatctgcttcaaggcaggtgtggattaaaccagagaatatatgtgaaagcactttccaaaccatgaagtgctatacaaatgaaagaatgtgcctgtgagaccaaagccttgagttttatctctgtatggaatagtttgctatatactattccatcatcccaatttacacactcgctttccccatgtggaggaaggggaagagtttgggagaaacattccaccacaattgtaaaccaactgaaaagctgatattccactatttgtgggataataacatcaactatctaactagtattagcactcattgaagaatactgaagactggaagccagtattacctggcatcttttacttttaaaactgggactagaaagaaaatatatttgctgcacagagaaaaaatagggagttaagaagaaaggaaagtgaggaaagggaccgtatgtgctcacttaggatatgtgcaagatggaaggtcctggattgcagtctgatttgggattcaggtccaactccagcattcagtgtcagcagaacttgagccttagttttagtttcctgaaaatgagtctgatgctagacgtttttttaaacaacctaatcaaatgatataaaatatttggcaaatcaaaatgagtcaagaatcagctgctgctgtgtttctttttaccctattccctttccttaccattcctttcttccccagcattaaaacatataaagccccaaaatcagagccagaggctagccttagttataaataaaaaatatctcattcttcacccccgccctttcccagtggtatttatctacatcagaggtcagccaacttttttctataaagggctagatagtacatattttaagctttgtgggccataaactactttcacaactattcaactccgtcattgtagctcagatgcagtcattgatgttatgtgaatgaatgggcatagtgtgtttcaataaaactttataaaacagacagtgggccaggatctacataaaagtaaccacaggcactggttcaaaacttaaaactagctgaatgaactcttatatttctctgacacatctaaacaaggcagtcattaacagtttagaggccaggcacggtggctcacacctggaataccagcattttgggaggccaaggcaggtggatcgtttgagcccaggagttcaagaccagcctgggcaacacaatgagacccccatctgtacaaaaaaaaaatttaaaaattagctggcatggtagcatgtgtccatagtcccagctactcgggaagctgaagtgggaggatcacttgagcctaggaggtagaggctgtagtgagctgtgtttgtgccactacactccagcctgagtgacagagcaagaacctgtctcaaaaaaaaagaaaaagaaagtagaaagttccggcaaggtcttcactggtttatttgggtaggagatattttattttctggcctgaattcgataaacaattgcttatattctgtttctctttgtgcatggggttctcgcccattactaattttttttttttttaaaaaagggtttttgttttattttgggttttttttttttttttttttgagacagagtctcaccctgtcacccaggctggagtgcaatgatgtgatcttggctcactgcaacctccacctcctgggtgattctcctgcctcagcctcccgagtagctgggattacaggtgtctgccaccatgcccagctaatttttgtatttttagtagagacggagtttcaccatgttggccaggctggtcttgaactcctgacctcgtgatctgcctacctcagcctcccaaagctttttgtttttttaagatcaaaactgaatttgttcagaatggcttcacagacataactcaaaacagggtatgtcatgatctgtactctgtgcgactgaaaacaaggtattgccttccaaagccccaaatgttagacaccttcctaatgcttttaggggttatgaaatatgttctttctttttagcagatttaaatatctcggttgactgcagcttcaatcatgggatctgtgactggaaacaggatagagaagatgattttgactggaatcctgctgatcgagataatggtatttatatttgacagtttcatgttctgcaatatggtgaagggatagaaagccctccatgagtgatgggttgttattcccattactcatcagagcagggttgtttgtcatttttggaaacttttagaccttctgagctctcccttgatagatgactaacttggtccagcatatattctcctacttaatccctctcccacacacctgccaccacaaaggatatgggagaaaacctcttccatattcactctcctgctgctgagggagagatgttgagatttgtataaagtttgggagagttagggaaaaggtagaaagaaatggtttcttcttcccagtttaccagccatggcatcttgtagtttttgttttttgttttgttttcatgggggaaataaatcttgaaaggaaatataacctccacctaaacctggtgttttagtagagtggcccctcaaagcatgaaaaccataatgaacatcaagtcaatgacctgaactcctgaactgagctttcccttctgtttgttgcttgaggatttctttcgagccacctgtccttgaatttttctcaatcttatctgtgagctgcggatttcccactcttcccattgcctacttaaacactattgacggaccctaactatccccttagtgtttgtcttgcagatcccatttagagcacaaattgaatctctgtctcctgaagactgactatataattaaagacaactgttacaccttcagggactccagttacttatcaatcaaattatttctttggggatgtataggctcagccctcagttaaaagatctttcttttagatccttcctctagaccaattcctctccaacatctttcctttcatgccctcacatgcaatcagaaaacctagatatcccctaacaagaattcctttttgaacttggggttaggggagaggggttacatctcacacagcagttgtgtgaatgggacttttactaaagattcagtgtaagcaaagggcaaatttaaccaggctgaaaacatcatatcattggaaaagctatcttgttgataactaacctgagtttctcttttcttccataatggcatctctaaatttatgtctaccagagctatatcatattgggagcccataggttattccaggacctccacagctgatataaggttatgttaagtcttaagttgagtcttctgtccaagggaagttccctatttacaaacactcaattcacaaataaccccagggttctcagcttctgcatcattcaaatcatacccctgctcctcctgcacctccattggatttctaggtgagcttttcattccctctgtacagctaaatatgaaaaataaacatggccaaggcgggaggattacttgagcccaggagtttgagaccagcctgggcaacattgggggatcccatcgctacaaaaaattgaaaaaaaataggctgggtgcggtggctcatgtatgtaatcccagcactttgggagcactttgggaagccgaggcaggtggattacctgaggtcaggagttcaagaccagcctggctaacatggtgaaaccctgtctctactaaatatacaaaaattagccgggcgtggtggtgtgtgcctgtaatcccagctacttgggaggctgaggcaggagaatcgcttgaacccgggaggcggaggttgcagtgagctgagatcgcactattgcactccagcctgggcgacagaacaagactccatctccaagaaaataaataaataaaaaataaaacacaaaaaaatgaaaaagaaaaaaattagccaggtgtggcggcatacacctgtgatcccagctattcaggaggctgaagtggaaggatcacttgggcccaggcatttgaggctatagtgagctatgatggcacccctgcactccagcctgggtgacagagtgagaccctgcctcaaaaaaaaaaaaaaaaaagaaaagagacatgaatgagttagcattattaaagggataaaaccacaaagacagctcaaagcggactttatctgggagagaaagggaaaccttccacagtaggtgacagaaagcgtagctgaaagagatgccagatgaaatataggatggctatatttcagacaggcaattaatactttttagtatgtcttggacatgtactttatctgaaattcaaactccactgggcatcctatatttttatttgctaaatctggataccctactagctggggaagaagaccagattctggatgcattgaaaactaaggcaatgtcagcctgggtcctgcaagtatctccgacttgcagtagcagaagacgacccattccccaatgtcttcttcctggcttctatagaaatttttccttcttatcaacttcttcagaccctactctttgagagtttttgcccaagttcatcaaagccacaacccgaagattggatatgagcaaaagtccactacaccacaggttaaaagatacttagaagatttgcaggatttgaaggagagtgttcctgtcatcctaaatcagaaattggagtgatatgttacacatggtagttgagctccatgaaaccactagtacaggtgcaggtgtgttttggattaaacaccacactctggacccatttaaggagctgatcatcttacatgtcattgactcagtggggaagtgcattctaagtttcaagtcaccaaaatggaaatgaaattatggaacacaagttctccatcaactgcagattacctgcagtgctaaaggatcatttaattagattcttaccccatatctttgtgtatgctttgtgtatgcaaaaaattcctcggtttctctgaccatcaatttgtctatataacaaaagatttcaattgtgtgatccctaaaatccattttagcatgaaacttttattcctatgttcaaaatgaaaaggacttcagctttccctataggagactattgtttactttttatagctttttttatacattaaagccaaactccttacaattgcctcattaattgtgcattttttcccttctcttaaagctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcgtaagtgggaaaaaaatgattaaactcaatatttgcattcttttgcaatgatttaacaaatgaaacaaaacatttactgaagtatgtaggcattaaggatacaacgataagactttttccctacacttaaagaatacgttctggagctgaataggcaaggtgattaatcggcacaactcatggatacttatctggcgtatgcatatcacgttctatggaaataacctgtttgtcaggctcctctcaccagcgtccttccaaatcaggctatacatgctatacattccgtagtatgtaaaagaatgtcatgctcattcattctatgcccagaacttactacaattaatggcagctagaaggtgatttcttttaaatatttttttaaacggaactgagagagtggctattgtcagtgtccccaggaccacccttaggttcagtgattccgtaaaaggactcacacagaagtcagaaaagctgttatattcacaagtacagtttgtatagattaaaatcagtagagggaaaagacacgtagggcagaatccaggagagaccaggcagaggcttgcagtttttgtctcccagtagagtcatatgggcagctattaattctcccagcaaccaagcatgatgacacttacaaagtattgcccaccagggaagctcacccaaactttcatgtccaaggtttttgttgggggtcagtctgcccatgtgatcacctgcatagctgactttagttatctagtctccagcctctctagtggtcaagttgataccatgtgactcaaggcccccaccataagtcacattgttaccataaactatctggcatggcccaaggcctcaggtaaacaaaggcactcttaatcaaagagggtattacaagggcttagaggttatctcctaagaaccagtcaagggccaaacctttctttggaatgtgtatggtttggacaacccagacctactgagttaatcttttattgcacagtgggtttaataaaggaaaaggaaacagagttttaagaggaagttggtcaagtggatgaaaccctgagaaagaacaagcagaataaaaatggcaaagagtctattcagtttgacccatcagaaggtggctagtgacctttgcaagagttctttctttggaggggaagggtcgaaggtcacacttcagaaagatgaaaagagaagggatcagagccttaaggcagccactgtggacgttataaagagtttggtcaaggtaggccagacgaggtgactcacgcctgtaatcccaacactttgggaggccgagacaggcagatcacctgaggttgggagttcaagaccagcctgaccaacatggagaaaccccatctctactaaaaatacaaaattagccaggtgtgcaagcctgtaatcccagctactcagaaggccgagtcaggagaattgctttaacccgggaggcggaggttgcagtgagccgagatcgtgccattgcactcaagcctgggcaacaagagtgaaactctatctcaaaaaaaaacccgaaaaaacaaacaaatgaaaagtttggtcaaggtgggaaggaaaaagggtgaaagctagaaaaaggtacattaagtggtgataataggaagagcaattagtagatccatgtattgggattccatttatactttgcttgtgaaagatgactaatgcaaatttaacatcttttcatttacatgtcatagtttaattaaagcagaacatcttgtttaaaatatgtcatgagacatgactataaataaaagtatatgttgggtaccagttaatgaatttcctaaccactcttcccctctgaggtaaaagcagccagtgcttgtttaggaatgacacatgcattaatttgagtttattcttatagcagtacatttaaatcaatacaaatccaatccacgtattttcttgttgtgtttgcagcatggtttggggactgtggcactgagccatgctatatatggatgatatcccctgctggagaattgaaacatgcctctgcacagcattcataatcactttcatgttgactgaattcatgtgatggagaatatttttaatataacatggtagcttgcagggagggtatactagcaaaacagtgattttttttttaaatgcacatttctgtagacatgcccccaaagagcctggccagcaatcacactggaacacagcagtgctttcataagaggcattctcagacccaggcatctgttccttgaattcttcagttctaggggaaatcttgatggggggatattgaagggtaaggaagctgactaatccagtctaaagaatatattccagtttagcaatgtcatattggctgtggacatttgtaacatatgtgactcttgctgcataaacttgggcatacaatgtaagtcacattgctttctcgaaatcaaactatttctgaatccaaagccccatcccattaggctgggggggaaatttaatcttggctatttcctcattcagggttgggataggggccccctccctagggtagcctgtgcttttgaaaggctaaaaatggtccagacattaagaagggggcaacacatctttacttcatcatgggggccatggatacccatatcttctgcacctacgtggcccttgaagtcactcatctcttcaacttccatgccaggcccagacacagaaacctttactggggttggaatcttgttgctgagaatctagcctcaataggaacatcaggcaaccattttctgcccagggctctgccagggagatgcagtggtacagcatcctagtcctggagaatctcatggctcccctcaccacttctccttttaaccttctaccttcagccacagtctcagaaagttaagcttgtgggtaacaaacgtcaggaaagggaccatcttccagaaaagtctgcttttgattgttatatcccaaatctccttgataaaaaagaacattaaaatcctgcctaattttgggggggatagaggaggtaaaaatatagtgaaaaacacaaaattagtatgtcaattaattatccggacatttatttctagttatccagtggttatcagtcaggggtcttagtgttggaaaagccaccatatgccaagatgtagacatagccaccctcattatcccacccattgcagctgctgtgaggggtctgctgtttggctcacccctactttttaaaaaaagttcctttgggtgcaaaaggaacatctttctgaaagcagttccctcctgagactagaggaaaaagaaacttctatacccagttgtgctatcactggctgcttagtaataacttgtttccaatagttctcaagaaaatgcactcagattgagagcaaaagagagcagcccaggtactgagcagtcatagacccttgtcatctccatttgttccctgaggtttctcttctttggagagccagagaaaactggatatggtgatgacagcaagcctaaagttgcttcatttctgaagactattctgtgattctttattaagcaaaaaagagatggtgctggggatagtgaataattgcatgatggcattgttgtgagcatgattcttaaagggtctttctttaaaatgccaatttatacaagtttgaatttatataagtttgagcttaaaaagtttagaaatgacaaaaggaaattacttttttgaaaataagaaaagattcataatcatactacagtaacatgagtgcttttatatttcacattttactttgcacatgaatgtatatttttatttatctgtaactgcagtatgcgtaggctattgttgaatttcattttgataggctatatgtgcatgttattttaaagaataccatgttccaaatgaaatattcttttccctctatgtttgttcacagggtaacttttgtcatctttgaatcaggatcattttgttgtcctctaaatctgcttatttcggatattgaagattgtagaaaccctctaggcctagtctgctctttatgggaggcatgggagacatacttctctttagagtgaatgttactggataggtgctccataaattgtagctattattattttcataattattgaatttaacaaatatttctagtgttttatctgattataaaattaacatgaactatttttttttttaaattacaatattgaagaaacattcattcaggccgggcgcagtggctcatgcctgtaattccagcactttgggaggcctaggtgggtggatcacttggggccaggaattcgagactagcttggccaacatggtgaaaccctgtactaaaaatttaaaaaatttaaaaaattagctgggcatggtggcacatgtctataatcccagctactcagaggctgaggcacaagaatcacttgagcctggaaggcagaggttgcagtgagctgagattgtgccactgcattccagcctgggtgacagagcaagactccgtctcacaaaaaataaatataaatataaataaataaaacaaaatcttcattcagcaaatattgattttaattttatttatttgaaaacatgtttggataaatgaatgaatataaaatagtcactgtatatccttaattttgttaaatgagtcccctgtcattttgtgtccaatttgaagataatttttttagtattcatcctctgttctctctatatagaaatttctaaactataaagaagtttgtttctcttttgattactaataaatttattagacaaaagtgattatagcatattatgaaatattttcaacacgtgaaaacaacattccagataatctccaaatacattaaccaatattttaagaaaaataattaggccgggcacggtggctcacgcctgtaatcccagcaacagagtgagactccgtctcaaaaaaaaaaagaaaaataattacactcatataaactaccaaaatctaaatatatctttgactatatagttttgttttttggttttttttttttttttttttttgaggcagagtctcactctgtcgcccaggctggagtgcagtggcgcgatctcggctcactgcaagctccgcctcccagggttcacgccattctcctgcctcagcctccgaagtagctgggactacaggcgcccaccaccacgcccggctaatttgtttgtatttttagtagagacggggtttcactgtgtgttagccaggatgatcttgatctcctgacctcgtgatccgcccgcctcggcctcccaaagtgctgggattacaggtgtgagccaccgtgcccggccttgactatatagttttttattagatgttcaaggggaatatcaaatttcttctcacttggtttttgtaaagaaaaccatattttattttttgttttgcttttctttaaatgtgaattccaaaatttccttttaaatcttattcttctcagctttatggcgtttttcagaatctatgtgggctttgctatgaccttgttttcaccaaatgtagttctctcagcgcagacacctggcatctaaaaaataatctattacagtatattcaatgtcgaagccggtttctatgaaatagggacacgagttaatagctattaaatagcttgattatatcattgttttgaacagtttggagtaatttttttattctctctccattattagatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcatcttgtgtcatggtttaatttttctaggtaagaaaatatgttcttgattctgtgtttacttatgtaaatgattatttgcttttctgaaaaatgtagtttttatcttttcactattacttcatattctttaaaggtactttctattatgggaaaatatgactgctttattaggccttataactgcaaagcagattcacatatattggggttttgtttgttttttattttttagaaatgaggtcttgctatgttgcccatgttggtcttgaactcctggcctcaagcgatcctcccatcttagcctcccaaagtgctggaattacatgagtgagctgccgcacccagccagcatatattgttgagctcaaagcctcagagaactacctaaaactaaatgagcaggtagcaggactcaaagaaacatggatgacttctttgtcttactcttttcttccaaattcaggaagagctttgtgtaggaatcttgagtgtattccttgaggacggttttatattctgtttaagattctgggttagaaacaggtctaagacaccctccaaacagaaggttctccagatatttgctctctgttacctaaagcaattaaggcattgaaccatggtaggaaaaaaagagaggtgatccacttactaatctttaaaatttaattttaatacaaaatttaaaccccactcttgaaggtttttaaatacttaaaccctaagtaattcttcttcaacaatgttctctttaatacaaccaacacacacaaccttttaagatggggtggggaccacattgtttatccctagtgtgagagaatctgggcatacaaaatctatataggactgtaactgtatctgttaggataactgctagttatggaaaccacaaaaatagtgtttctggtgagaccagatgaaaaactgcccagctaaggcaaatcagcccacagaatcctaagagataataaaaatagttgttttaagccacaaaattctggggtagtttgctacacagcaaaagttaactgatataggtgatttctgatattgtggtagaacttgaagaagaccccctgtctcttccatgaccaaggacatttgagagcacaatgtggcttagaagaaaggacaatggggccgggtatggtggctcaaacctgtaatcccagcaactccctttgggaggaggaggtaggtggatctcttgagctgaggagttcaagaccagcctgggcaacaggacaaaaccccatctctacaaaaactacacaaattaacagggcatggtggtttgcacctgtagtcctagctacccaggaggctaaagtgggaggatcacctgagcctgggaggttgaggctgcagtgagctgtgatcacaccagtgcactccagcctgggccacagcatgataccctgtctcaaaaagaaaaaaaaaaagaaaggacaatggaggggagaacttacaatgaaaggcagtgcccgagtgatttaggttaaaggaagaaacgttaaaccagaaatgaaataaggagacctgggaactctgctacatatggatagaaaatcagtgcacaaagctcagttaagtttcatgtttctctaaagtctgcagcagagaccgtggttgcctacacaatatccattctcatctttttccttaccagtatgaccacatataaatagatttttagcagggggaggtaggcaatgtgatcaactaatagactgcatttcccagcctctcttacagatggggaggcccctgagatggaagctgaagtcattcttggggctttcaggaaggatcatcaaagggggcttccagctggcagacccctcttttggcatttcccttcctccttcctgcttgcaatgtggctgtaaaggcagaaggtccatgaaccactttgtgatcaagagggcaaggccctcaccttgtgaagtacataactggaggaagcctgggtccctgatgattttgtgaagtctctaccac

SEQ ID NO: 14047 - DNA, 36322 bp, Human
ttcaggagttcttgtaaggcaggcctggtcctgacaaaatctcccagcatttgcttgtctgtaaagtattttatttctccttcacttatgaagcttagtttggctggatatgaaattctgggttgaaaattcttttctttaagaatgttgaatattggcctccactctcttctggcttgtagcatttctgctgaaagatctgctgttagtctaatgggcttccctttgttggtaactcgacctttctctctggctgctcttaacactttttccttcatttcaaccttggtgaatctgacaattatgtgtcttggggttgctcttctcgaggagtatctgtgctgttctctgtatttcctgaatttgaatgttggcctgccttgctgtgttggggaagttctcctggataatatcccgaagactgttttccaacttggttccattctccccatcactttcaggtataccaatcaaacatacatttggtcttttcacatagtcccatatttcttggaggctttttcatttctttttattctttttctgtaaccttgtctccttgctttatttcactaatttgatcttcaatcactgataccctttcttccgcttgatcgaattggctattgaatcttgtgcatccgtcatgaagttcttgtgccatggttttcagctccatcaggtcatttaaggtcttctccacactgtttattctagttagccattcatctaatcttttttcaaggtttttagcttccttgcaatggattcaaacacccttctttagctcagagaagtttgttattactgaccttctgaaacctacttctgtcaactcatcaaagttattctccatccagctttgttccattgctggtgaggagctgcgatcctttggaggagaaaaggcattctgatttttagaattttcagcttttctgctctggtttctccccatctttgtggttatatctacctttggtctttgatgttggtgacctacagatggggttttggtgtagatgacctttttgttgatgttgatgctattcctttctttttgttttccttctaacagtcaggtccctcagctgcaggtctgttggagtttgctggaggtccattccagaccttgtttacctgggtatcaccagcggaggctgcagaaccgcaagtattgcagaagagcaaatattgctgaacaacaaatattgctgcctgatcctttctctggaagcttcgtcccagaggggcagccgcctatatgagttgtctgtccacctctactgggaggtgtctcccagataggctacacgggcatcagggactcacttgaggaggcaatctgtcctttctcagagctcaaacgcggtgctgggagaaccactgctctcttcagagctgtcagacagagacgtttaagtctgcagaagttgtctgctgcctttttttgagctatgtcctgcccacagagatggagtctagaggcagtaggccttgttgagctgtggtgggctccacccagttcgagtttcctagctgctttgtttacctactcaagcctcagcaatggcggacacccctccctcagccaggctgctgcctcacagttcaatctcagactgctgtgctaggagtgagcaaggctctgtgggcgtgggacccaccgagccaggcacgggaatcaccttgtctactggttgctaagtccttgggaaaagcactattttggtgggagtgtcctgtttttccaggtagtctgtcacggcttaccttagctaggaaagggaaatcccccaatctcttacacttcctgggtgaggcgatgcccccgcctgcttcagctcgccctccttggactgcacccactgtccaaccagtcccagtgagatgaaccaggtacctcagttggaaatgcagaaatcacccgtcttctgcgtcgatcatgctgggagttgcagactggagctgttcctatttggccatcttccagtttcaatagttctttattttatttatgctatctatttcttttccttttttttttttttttttttttttgagatgaagtcttactctgttgcccaggctagagtgtagtggtgtgatctcggctcactgcaaccactgcctcctgggttcaagtgattctcctgacttaacctcctgagtagctgggactacaagagcatgccatcatgcccagctaatttttgtatttttagtagagatggggtttcaccatattggccagaatggttttgcattcctgacctcaagtgatctgcctgcctcagcctcccaaaatgttgggttacaggggtgagccaccgtgccttgctatttatgccatctatttcactgaagattccgcctctcatttcttgagtcattttttttaaatttccttaaattggacttcacatttttctgatgcctccttgtttagcttaataactgaccttctgaattcttttttaggaaaatcaggaatttcttcttggtttggagccattgctggtgagctagtgtaattttttgggggggatgttaaagaaagttgttttgtcatattaccagaattgtttttctggttccttctcacttgggtaggctatgtcagagggatggtatagggctcaaggctgctattcagattttttgacccacggggtgttctcttgctgtagtattctcccccttttcctatggatgtggtttccagagagctgagtggtagtgattgttatctctcttctgtatctagccacctagctggtctgccaggcttcaggctggcactgagggttgtctgcacagagtcctgtgatgtaaaccatctgcaggtctctcagccatggataccagcacctgctctggtggaggtggcagcagggtggaatggactctgtgaaggtccttagttttggttgcttaatgcactatttttgtattggcctcctgccaggaggtggcactttgaagagagcatcagctgtagtagcataggggcatcaggcagtgggcagggccctagaattcccaaaagtatatgccctttgtcttcagctgccagggtgggtagggaaggaccatcaggggggcagggctaggcatgtgtgagttcagactctccttgggttggtcttggtggcagctgctgtggtggatgggggtgttgttcccaggccaatggtgttatattcccaggaggattagggttgcctctgctgtgtcatgcaggttgtcaggggagtgagggaaagctggcagtcacaggcctcacccagctctcatacaacccaaaaggccagtctcactcccaccttgccctctcaaacagcaccgagtctgtttccaagcagtgggcaagcaagactgagaacttgccccagactaccagcctcctagctgtgaaagcaaacggggctttcctgcctccctgcctgtggagtctgcataccagattcacaccctcccctgaggtctggacaggaaacttcaggttctgttggaattgttacaaagttcagctggaggtttccttttccctgtggtcttttccaaatacctctggcagccctccccaaggactcctatgagacaaggcagaaatagcttcccaggggactcagagagtccacagggcttttcttgctgcttcctctatccctgtatttcactcagctctctgaatcgacccagcttaaggtaaggtcagaatcttctcccatgatctagaccttcaggttccccattgagggtgtgtgtttggggcagacaatctccatttcccacttccacagcttgggctctatttggggtgtctcctgggtcctctaggagcattccgcttccttcagatggtctgtgagtgctctcagctttcctggttaatttctgcagtagttctggagcaaaagttcacaacgtgagtctccatacattgctctgtctgtccacgtgagagctgcagtctagtcctgcctcttgtctgccatgatttcctagaataactttctactatggtttttgtttgtttttgtctttctacttttaaaaaatttctgagatatacttttagttgttttcagtctttgagtcatgttatcccttttcattttcagctttatagtgtattttttctaatcctaggtgctgaaaatgacacagtaaataaatacacatgttcagctcaccatcttgagccattagttctagtaaattcatgttgtatttactcaggatgatacctaatactctattcaacgattccattatcattaagaatagcacattaggatctatttttttaataatacatgctttaggcctggagcggtggtttacgcctgtaatcccagcactttgggaggcccagtcaggtggatcacaagatcaggagatcaagaccatcctggctaacacggtgaaaccccgtctctactgaaaatacaaaaaaattagctgggtatggtggcatacgcctgtagtcccagctacttgggaggctgagacaggagaatcacttgaacctggcaggtggaggttgccgtgagctgagattgttccactccactctagcctagataacgaagtgagactccgtctaaaataataataataataatacatgctttagtacacaaagcacttgacccccttttttctctttattctggaagtcttacatatacagttttcttttcttccttattttccagctaaagagtcaaagttttctttcttccatcttaagttagtgaatttaaactgggtattttcagaaagcaatggtcatgtatactaagatgcttttaagagaactgactttggttataaagagatttaatgcaagcctccagtttaacttggaggactgagtcacccctgtaataacatgtttgtctgaaccacgcacaggacatcctttgccattcaacctctgatttgcacaaggtgactaaaggaccagcagcaaacaaaagcaaaggtaaaatagacttttttttcctgtttgtaaaaattttaaaaattgtttttagaaatttgaggagttagaaaaaagccaatattaatttcttggaatactcaatttcttttgcagcctaactttacttaattttcaaatgcattaccttttgaaatatgagtttgtttttatgaaccaagcagcctaaaatacacatttgtcactgatagttacgagctaaatttcagttaactttttatttattataaatctacatttgaaaataattcccactttaatgactactcaaggctttcttcatttttcttgtgcacatagtttctgtgattgcattactaaccttaacttgtgatagcatcaaaatgtattccatgaagcaggttagtaaattaactacaaacaagccataggaacacatgacttcatgagacagccacaactttaatattcttttgaatcaatagatgtaaagcactcctcaagctaactttataaacataaatgttttccattagagtattagtgcgtattttgacaaagattttacttttgcaccatctttaatgaaacatgtttttcatacctaattttatagttatacttaccatgatggtcaatacaagaggactgtttgttggaataagtattgcagattttaggaagcatgcaacatttaaaagggctcagaaagtggatgatttttggttgtaaaactgggtcgtacattttctttccaaatattgttaaagtgactgaatatttagagataacagtcatctgacatttcaaaaaagaaaaatcttagtaattggggagaggataaataaataaacatatacatatatgtacatatggatagatttagattttccagaaaagaaggaacaagtaccaaaacagtataaggaaggtaaatcttaaatcattcaacctgttaaagagaaatcttaaagttgagaaatttaataatgatggggaaaatgctgtttactttagtgactatgtatgtgactgtatgtatgtatataaagtgaaaatttgaaaaattatgagataataaaacttgttatctctagatcctggagtacctgaataactaatgtacagtctctctctctctctctctccctctctctctctctttctctttctctctctctttgagacagggtctctctgtcacccaagctggagtgcatcggcgcgatcttggctcactgcaacttctgcctcctgggttcaagtgattcttctgcctcagcctcctaagtagctgggattacaggcacccaccaccacgtctggctaatttttgtattttttggtacagacagggtttcatcatattggccaggctggtcttgaactcctggcctcaagtgattggaccattttggcctcccaaagtgctaggattacaggtgtgagccactgcaactggcccaggctttcttttttaaaacaatatacataaacaaacaaaagagaaaccttttaagacaaaatttttgttccttcatagacatgctgacttgaatcatcttcataatacttggttctctgcagggtatggtggagcgtgcctgtagtcccagctactcaggaggctgaggcaggagaattgcttgaacacaggaggcggagattgcagtggaccgagatcgcatcactgcattccagcctgaacgatggagccagactctctcacaaataacaaaaaacttgattctctatttcacctgtttatacaaaactttctatatttctatgtagaaacatgtttctatatttctcatatgttttatcttacatagtagcatgcaaccctcttacataccaatcaggtagaattagagtgacactggatttacctgtttgtttcaaagctttgggaattcttccaataagtgtgacacatgttagaatcattgttacttgagatacttattgtactgataaatgcaatacaattgtagcaatagctaagaaagcttagtcacacgatttatttcagccttgcttgtaaattagaattcagtttgaggatggaaagaagagctcttgttgaaatatgaatacttagatttttgttgctgttgttgagacagggtctcactctgtcactcaggatggagtgcagtggcatgatcactgctcactgcagccttgaactcctgggctcagatgatcctcccacttcagcctcctgagtatctggaaccacaggaacgcaccaccagccggctaattttttgtattttttgtaaagacagggttttgccatgttgctcaagctggtctctaactcttgggctcaagcggtcctcctcctcggcctcccaaagtactgggattacagtcttgagccaccgtgcgactctacttataatagaattacagatactgtgaatttctaacaagaacaacctgtagttgttttgttcacagaccgaagtctctttacctaagtactaagcatgggcctaatgttcataataggcccaaatgcatgaatcctgtgctctgtcttatcatgaatatgtgaaaaatctaaatctcattcttcgaggagcaatatttctttgatacactatattgggtggttgaagaactggctacaatcctaggctggagttcctcctgcctttgtcaagagaattccagaacgaccttattgcatccttagtctaacccaaaatctatgattggaacatttccaaatttccttattgtattaggaaattctctcaagattacatctggaaatcaaaatctattgtgaaacattttgaagttataaggtttgtgtaattagactgcatgcaattagcagtcttggacaaataaacttatttttaaagaattaaaaaatatttgtatgaaaaagtatttcttcacatttatggttaatgtatgttgctatgaattaatgtaggaacgcaacttactttactaagatccaagtgcaacacagttctcacaccatgtgaatgggaaaccaaagtagacaacaaattatttaatgatcttttaaaaaatacatgcaaattaatgattagttaaatattacatttgatgtttcaacaaagtttttttaaattatactttaagttctgggatacatctgcagaatgtgtgggtttgttacgtagctatacatgtgtcatggtggtctgctgcaccaatccacctgtcatctacattaggtatttctcccaatgctgtccctcccctagccctctgccccctgacagcccgtgtgtgtgatgttcccctccctgtgtccatgtgttctcattgttcgactcccacttacgagtgagaacatgcggtgtttggttttctcttcctgtgttagtgtgctgagaatgatggtttctagcttcattcatgtccccgcaaaggacatgaactcattcttttttatggctgcatagtattccatggtgtatatgtgccacattttcttgatccagtctatcattgatgggcatttgggttgtttccaagtctctgctgttgtgaatagtgctgcagtgaacacttgtggatgtgtctttatagtagaatgatttataatcctttaggtatacacccagtaatgggattgctgggtcaagtggtatttctggttctagatccttgaggaattgccacactgtcttccacagtggttcaactaatttacattcccaccaacagtgtaaaagcgttcctatttctccacattctctgaagcatctgttgtttcctgactttttaatgattgccatcctaactggtgtgagatggtatctcattgtagttttgatttgcatttctctaatgaccagtgatgatgagctttttttcatctttgttggccacataaatgtcaccttttgagaagtttctgattatatcagttgcccactttttgatggggttgtttgtttttatcttataaatttgttaagttccttgtagattctggatattaaccttttgtcagatgggtagattgcaaaaattttctctcattctgtaggttgcctgttcactctgatgatagtttcttttgctgtgcagaaggtctttagtttaattagatcccatttgtcaattttggcttttgttgccattgcttttggtgtttcagccatgaagtcttttcccatgcctatgtcctgaatggtaatgcctaggttttcttctagggtttttatggttttaggtcttaggtttaagtctttaatccatcttgagttattttttgtataaggtgtaaggaaggggtctagtttcagttttctgcatatggctagccagttttcccagcaccatttattaaatagggaatccttttccccttgcttgtttttgtcaggtttgtcaaaaattagatggttgtacatgtggtgttatttctgaggcctctgttctcttccattggtctatatatttgttttggtaccagtaccatgctgttttggttactgtagccttatagtatagtttgaagtcaggtagtgtgatgcctccagctttgttctttttgcttaggattgtcttggctatacaggctcttttttggttccatatgaaatttaaagtagttttttctacttctgtgaagaaagtcaatagtaacttgatgggaatagcattgaatctataaattaccttgggcagtatggccattttcatgatattgattcttcttttccacaagcatggaatatttttccatttgtttgtgtcctcccttatttccttgacagtggtttgtagttctccttgaagaggtccttcacatcctttgtaaattggattcctaggtattttattctctttgtagcaattgtgaataggagttcattcatgatttggctctccgttggtctatcattggtgtataggaatgcttgtggtttttgcacattgattttgtatcctgagactttgcttaagttgcttatcagcttaaggagattttggactgagatgatggggttttctatacagtcatgtcacctgcaaacagagacaatttgacttcctctcttcctatgtgaatgctctttatttctttctcttgcctgattgccctagccagaacttccaatactgtgttgaataggagtggtaagagagggcatcctagtcttgtgctgcttttcaaagggaatgcttccagcttttgcccattcagtatgatattggctgtgggtttgtcataaatagctcttattattttgagatacattccattaataccagtttattgtttttagcatgaagaggtgttgaattttattgaaggccttttcggcatctattgagataatcatgtggtttttgtcattggttctgttgatgtatggattacgtttattgatttgcatatgttgaaccactcttgcatctcagggatgaagccaacttgattgtggtagataggctttttgatgtgctgctggattcagtttgccagtattttattgagagtttttgcatctatgttcatcagggatattggcctgaaatttgttgttgttgttgtgtctctggcaggttttgatatcaggatgatgctggcctcataaaatgagttagggaggattccctgtttttctatggtttggaataatttctgaaggaatggtaccagctcctctttgtacctctggtagaattcggatgtgaatccttctggtcctgggctttttttggttggtaggctagtaatttctgcctcaatttcagaacttgttattagtctattcagggatttgacttcttcctggtttagtcttgggagggtgtatgtttccaggaatgtatctgtttcttctagatttctactttatttgcatagaggtgtttatagtattttctgatggtagtttgtatttctgtgggatcagtggtgatactccctttatcattttttattgtgtctatttgattcttctctcttttcttctttattagtctggctagcagtctattttgctaaccttttcaaagaaccagctcttggattcattgtgtttttgaaaggtttttcatgtctctatttccttcagttctgttctggtcttaattatttcttgtcttcttctagcttttgaatttgtttgttcttgtttctctagttcttttaattgtgatgttagggtgtcggttttagatccttactgtttctgatgtgggcatttagtgctataaatttccctctaaacactgctttcactgtgtcccagagatctggtacattgtgtctttgttctcattggtttcaaagaacttatttatttctgccttcatttcattatttacccagaattcattcaggaggaggttgttcagttcccacgtagttgtgtggttttgaatgagtttcttaatcctgagttctaatttgattggactgtggtctgagagactgtttcttatgatttatgttcttttgcatttgctgaggaatgttttacttccaattatgtggtcaatttaagaataagtgctatgtggtactgagaagaatgtatattctgttgattttgggtggagagttttgtagatgtctattaggtctacttggtccagagctgagtttaagtccagaatatccttgttaattttctgtctcgttgatctgtctaatattgacagaggggtgttaaagtatcccactattattgtgtgggagtctatgtctctttgtaagtctctaagaatttgctttatgaatctgggtgctcctgtattgggtgcatatatatttaggacagttagctcttcttgttgaattgatccctttaccattatgtaatggccttccttgtctcttttgatctttgttggtttaaagtctgttttatcagagactaggaatgcaacccctgccttttttgcttattcctccattcctttattttgaacttatatgtgtctttacacgtgtgatggttctcctgaatacagcacaccaatgggacttgactcttcatccaatttgccaggctgtgttttttaattggggaatttagcttgtttacatttaaggttaatatttttatgtgtgaatttgatcctgttattatgatgctagctggttattttgcccactggtcaatgcattttcttcacagtgttgatggtctttacattttggtatgtttttgcagtggcgggtaccatttttcctttccatacgttttgcttccttcaggagctcttgtaaggcaggcctgatggtaacaaaatccctcagcgtttgcttgttttaaaggattttatttctccttctctttgaagcttagttgggctggatataaaattctgggttgaaaattcttttcttaagaatgttgatattggcccccactttcttctggcttgtagggtttctgccaagagatctactgttagtctgatggacttccctttgtgggtaacctgacctttctctctggctgcccttaacattttttccttcattttaaccttgggtaatctgacaattatgtgtcttggggttgctcttctcgaggagtatctttgtggtggtttctgtatttcctgaatttgaatgttggcctgccttgcttggttggggaagttctcctggataatatcctgaagtgtgttttccagcttggttcccttctccccatcactttcaggtaaaccaatcaaacataggtttggtcttttcacatagtcccatatttgttggaggctttgtttgttccttttcattcttttttctctaatcttgtcttcacactttatttcattcagttgatcttcaatctctgatatcctttcttctgcttgattgatttggctattgatacttgtgtatgcttcatgaagttcttgtgctgtgtttttcagctccatcaagtcatttatgttcttctctaaacttgttatcctacttagcagttcctgtaaccttttatcaaggttcttaggttccttgcattagattagaacatgctcttttagctcagaggagtttgttattacccaccttctgaagcctacttctgtcagttcatcagccttactctccatccagttttgttcccttgctggtgagaagttgttatactttggaggcattttggtttttgtaattttcagcatttttgcactggtttttcctcatcttcatggatttatctacctgtgatctttgatgttggtgacctttggatggggtttttgcatgggtgtcctttttgttgatgttgatgttattgctttctgtgttttagttttccttctaacagtcaggtccctcttctgcaggtctgctggagtttcctggaggtccactccagaccctgtttgcctggtatcactaggaggctgcagaacagcaaagattgctgcctgctccttcctctggaagctttatcccaaagggcacctgccagatgccagccagagctctcctgtatgtctgctgacccctgctgggagctgtccctgttaggaggcatgggggtgagggacccattcgaggaggcagtctgtcccttagcagagcttgatcactgtgctgggagatccactgctctcttcagagccagcaggcaggaacatttaagtctgctgaagctgtgcccacagccaccccttcccctagttgctctgtcctagggcaatgggagttttatctataagcccctgactggggctgctgcctttctttcagtgatgccctgcccagagaggaggaatctagagaggcagtttggctacagtggctttgccgagctgtggtggattccacccatttcgaacttcccagtggctttgtttacactttgaggggaaaaccgcctactcaagcctgggtaatggtggacgcccctccctcaccaagctcgagcatcccaggttgacttcagattgctgtgctggcagcaagaatttcaagccaatggatcttagcttgctgggctccgtggaggtgggatccgttgagttagaccacttggctccctgtcttcaccccctttccaggggagtgaatggttctgtctcattggtgttccaggtgccactggggtacaaaaaaacctcctggagctagcttggtgtctgctgaaatggctgccagttttgtgcttgaaacccaggaccctgatagtgtaggcacctgagggaatctcctggtctgcaggttgcgaagaccatgggaaaagcatagcagctgggctggatagcactgtctctcaccacacagtccctcatggcttcccttgggtaggggagggaattctccaaccccttgtgcttcctaagtgaggtgatgccccaccctgcttctgcttgccctccatgggttgaacccactgtctaaccagtcccaatgagatgagccaggtacttcagttggaaatgcagaaatcaccctcattctgcattgatctcactgggagctgcagaccagagctgttgctattgggccatcttgccagctgcctttctttgtttctttctttgtttctttctttgtttctttctttctttctttctttctttctttctttctttctttctttctttctttctttctttcaatagaaacaaaacataattcagttggtcacataacatatactatttgttatttaaacctggtaatgatcaggctgattggcacaattcagttgcaacatcaagaacatcatcatttatccagaaggtgtacttgaagtggaaaactaggctcttaaatggagatatggaatgtctatgtagatcaagtgtggtggctcactcctgtaatcccagcactttgggaggctgaggcaagtggatcacttgagctcaggagttcgagaccagcctgggcaacatggtaaaaccctgtctctgccaaaatataaaaattaactttggcatggtggcacacacttgtagtcccagctactcaggaggctgaggtgggagaattgcttgagcccaggaggtcgaggttgtagtgagctgatattgtgccactacacttcagcctatctctatctcaaaaacaaacaaacaaaagaaatgtatgtgtagcaaccatgtaagatgtaaaccaaaaagtgaagaaaattatatacagacataatccaaccagctctttataagccaaaatctactcagattgcttaatttgatgggcttgaaatctcatagtcaagtttaacgaagattgacagagatattttaggtagaaaacattaggtgcaatgccaaaaggcgttacaaactcaggcatgacttaatcaaatatgtggtagtcagcacatagtggacataagacgtccattgagccatatggtaggattgctgtctaggttagaagatctgtcttatgtgaaaatgtcaaacagagaaaggcaagagtgcagagaggaatggggaaagggtagtgtgcaagatcctctcccatatttataaattagaatttaagttctagttcataaatataattttcaaaagttgagactttagttgataagaacagaatagacatcaatactatgtttagatatacaacatgccattactattatcattgcactcctctgcccctaaagacagtattgtgatattctgggaaggcaagttaaaacaatagaaataaaaattgaataggaaaaataatgaaacttcttctagtgtgctgtttatggtaactggctccagagtgtaagattttaacctgcactcttactgacttctgttatattgcactgaggtattttgtgttgtaaacacaccagggtagttggacgtaattcaaagaaagcaatcagatttgagaaggatttagaaaagtgtggggaagaataaaaagaaataaaaacaatgccatagacattgaagaataaaaaataaggtcagaagttagtcttcatcaaaaaggtatgggtgatgaaataaaatggaattgaagaaaatccaaggaaaaaagttatctgatgctgaagaagttaacaagcaatctagcttcctgagttatttaaaattaggctgaataaatcaccaaaactaatatatagtcaaagataaaaaagaaagaacaatcattttttcatatccaatttctccacatacttttatctgttgtaactagagttttgccttgtttacaatcagagaaggcctattactgtaaagtatatttttccactagtattaaataattcaccggtattgtgcattacattttgtggagaataataatactaatcagtttcttcaagcttatcatcagtgttcctaccgaacacctcctaaaccattaaccactgttaattttcttttaccatagatagtaaccaatcaataattagcttttaataatcaaatgtcagaatagagccttaacttaaagctctggctgatagtgttcatttccattaaaaaaaatcattcttatttcctgaaaagggatgttcttgtcagattgcagatgagcatacaatttctcaaataaaattataaaaatgatcttcataacaaaatgcaagtgagatgtaactttctttaggaaaacttgattccttatactgtagtcagaatcgatttgcatcttctcttatatatccaaagaactttgagtttttaaaatcagattgatggttttgagttagctgttacagcaacatattacaaaattccaacagaacttccttctcaaataaatctcacccatgctcacttctctcacttagccaccctgttctcttccctggaagcaagcaatataaccttttttgagtatccctcctgatatggtttggctctgtatccccacccaaatctcatctcaaattatcatcccatatgttgtgggagggacctgtaatccccatgtgtggagggagggaagtgatcagattatgcaagcagtttcccccatgctgttctcctgataatgcatgagttctcacaagatctgatggttttataagtgtttggaagttcctccttcataacacttctctttcctgccaccttgtgaagaaggcacttaatttccctttgccttctgccatgattgtaagtttcctgaggcttcccctgccatagggaactgtgagtaaattaaacctctttcctttataaattacccagtctcaggtatttccttatagcagtgtgagaacagactaatatagctccagagatattcctcagtacacaaattattatactgtgtacatatgtaatttgtgtgtgtatgtgtatgtgtgtgtgtatatatatgtatgcatatattcctttctttgaaaaatggcaacaatctatacacactttattaaaatttgtagcttgtgtacagacacacatgtaaaacaaatacatattttaaagactattttaatatctggtcaatgtccttatcaatatgtagaagaaacctcattctttgttataggtgcatagcattccactgtatacgaggccatgtcttatgtggcctttgccttatagtagacatttattttgttgtcctaattataagaattaggaagacattaattttgtcttcctaattataagaagtgctacaatgaattacatagaagcagaatttcttggtgaaaggttttattcattgataattcagatagaaatttccagtcttctgtttccactaggaatgtactctttcttcattcaggttggagtcaacccctgcacatttcaccttgctcaaatttcttatcctgctaaaatatatatgcttgtacagagagatagatgataggttgccatttgtaaagccaggggaaccctagtttttaagccactccattcaggactgaggcaaaatttgaaattaagccatgtttaccagagacaagacaatgtgatctggctacagcttttgacctctcaaatgtttgcctttcctctccactcttgtactcttaacattgagagctaggatctagggaactgggatccaactctctcctgcttaaatattgttctggtcctcaggcctgaggttggggactcagctccccatctctagtttctgtctgataaccccaactagtatcccaacactcctaatcaatggcttgggtcatttttatggggagggaagtattttaagttgtaatcttgactatggacattggaaagacttaaataacatttcgcagaccactggatggctttttagttcaacaactttaattaaaaacctgaagacataaatcaacttaatgttatcttaaggaacttagttaaaaacaggttgacagagggaacattctattaaaaatgtgatcctaagacttagtgtgcttttccaagaaatctgttgatcttggctgtaagaaatttcaagtcctaaaagaggagtaatacttagacaaagaccaagtgtatactttaatacaaagataatttaaacctctttcagattgtatttcttaaaactgcaaaatttgcttgcttcattaaaaacgaggcctttcagactgaataatatagtgaatttaccattagcaaaagtgacactgaaatagtcattttcacatatttacaaaacttaagcctatatttaagaagactggaaaggaaacaattttatacaatcaagatagtataggagttctaaaattagttcagatggagggacactgtgttctttgataataacataaaatagttatcataaaattcagtatctaatgatgaattatgggccttaatgaaatactgttatagagtagattatattataaacccataggcaacaagtttttaagaaaaatgtatgaaaaatacttaattgagaaacctctaacattaaaatattttgctttttctgctggaatactaaagagccagcttgcagagcattgatgtttcaaaagagaaaaagttcatcagagaaaaaaatagatgcctattattggctgttgctctaataagcttttattagaaaataggttggcaattagttctgcgaaattgagcacatagctttgaacttgatggttctgctctgtctctcagtctgataaatatatatgagtatatatatttttcatcattggcaacaaaatatcactttggtcagtactttccttaagggcttggaaataaaacagtgcatttattaaattccttagggaccatgaccttcaggatatctcttcaaactctcacggttttaggagcagacacttggcatcttaaaggtttttaaaacagaaccccaatatcatgaaaaaagaaatagaagacatgtagatttggaaaatcaactcgtttcactaatacctgaatattaagaagggagtatatgctttgaaaaacttttccagagcattcactctaatcgtaaagatcagtgtggatcaccatgctgtgtaaagttaaaaaacatcgcactgggtgtttgagaacaggcacttagagttgcaatcaaaatgaaaacaaattagtgcaattaatttattgatttataatatccttttcctttgtggtgattatttaaaatattatggtctcataaataactggtttgaactgctctcatttctgtcttagattattgcaagagctttttatagtcttcctgcttctctcttgtgtcttttcccttaaaggcttgcctcaacacagcagccagaggaatccagttaagcccatggcagacaatgtcattcttctttcaaagcccaccacatctttcccatctcatttacagtgaaagcctgagtacctataagccccaacaagaccctcactctttcttctctggctccttttacctagtcactgacctcttcaaaggtctttagagacagcagacatgctctgccacagggcctttgcacctgctttccctcatacttccccagacatcctccaggctgactcctcttatccttgggatcagtgaggcttgttaccatctaggaacaaatcctgccttatttatttttctttgttatcataatttgcaacatactgaatatttatttactgttcttatttattatctccctcccctacaagaatttaaactcagtgagggcagaggctcttgtttgttttgctcactattgtattgttaatacttagaagggagcctggtacatagaagatgctcaataaacattttctgaattcttataagaatgaacactaagtgcctctgccttcatcatacaatgtcagtgttccaaagaccaccaggagcacacctgcagttaaattagtttactttatcagttattgtgggaagggagggtgcacaccatgggaagccatggggtgtctcagtaagagggtattaggaggaaactatcatatgatttaggttttggctgagtgacttggtgaagagtctaagaaggcagggattttctctagattagatgttgtcagaaagcagaggcgttcctgtgattgggtaaagaatagcagtcattcattcagcaagagagagggatgtttggtattttgtgggttgcacagtgaccttcttttctgatcttagacaatatttaaaagtggcctggctttgtctcattttattatggtctgagagtaaacttgtccagactggtattctgtgacattgtttaagagaagcattatgcagcctagctgtgagtgtagtactcacagtttctgaatgccaagggttgctcttttttttcttttaatttatcacaagcaagtaagcttctttggggaaggagtgagaagggagataggaataagtaggggataggagatagaggcttttttgcagactcttgtagctgtacatggtggtcctgtctccctcaaaagaacatccctcctgccaccttcttcactgtctccttcactgtcaggaggaaggggcagtgatgaggtgaggtgcttgagccgacctgaaataggccctgtctgtttgctgcttttgccacatttgtctctggtcagggtaagaagattagaactatgaaaccaaggtcaacatagtagcagctaaaccttcctcacttccttctactagaggaggggtcaggagaaagctacttccctttacctatggctttaatgagtatgtcatttcattgaaaatcatttgttcaggggcctttaaaatgtcttcacagaagtttccttgttgaaggaaaggaactagtccttcctatatattcccagaacagaccttacttctaaggagagaaacctgggcattaaaatttaagggacaagtccaggttaaattcctcattcacttctacctccaatatcttgctaactctttctaaacattgtcatttagaggtttgtttacaggagcacatttgcctaggcggattatggaagggggaagggagaaagaaaaggaaggttgctattgctggtgatatggttaactgtggataattgcacaggttgctatgctacaagaactagtcaagataaggcagagctcagcggtggggattttaatggcataggtggggtgagggaaagaggtctagggaagctctgaagcaaagggcacttttggaagggcaggcttggggaggttccttggtgaaggaaggacaagagaaacagagattgcatggtgggacagggaagggaaaacagtgtctgagaggggtcacgtgaggggatctcctcccaacaagccatatttaactaggagggcacaccagtgccctgacctggctgtataggaagcagaaacctgacatacagcaagcagaagacacgggcacaggattttacttatttattttgtcttttttggtcgtgcacccacacattttatcaggagctatgtctaccatctgccatgtaaggtgcacctccagttcaccagaacaaacagttcaccagttctctttcaactacagtgtcttccctgagacactgagaacaataataacattccaagataggagaagagaatcacttggtaactttgtaataaatgaaccaggatgttctatggtggtgatgagggagccgaccaaaggggaaacaatagtcagtggaaaactatgttttgaatgagaccaaagcaggaagtatctggcagggtagatttttctttttttggtacacaaatatagtcttttctaatgtaactcaattttaaatttaaagaaaagcttcttcccccttctattaatgaatgcatatgtaaatctatttttcttacctggaggcaaaatataataaaaaatcaaagagaaggggaagttttgagtaccacaatttttcttactcataaaattagattcccttgaaaatactattctcttcaaatcataatttagagctacagtatgatatatttcatgctactaagtggggtaatcttattcagctttgtgcatggaggagtatattcaataaatgaaaatatctacctctatagctcctaaatactggtgttttgtgtttatccatttacttaggccttcttaaatgtctttggaggaagttttgtgaattacttaaaatttttttacagcagtgtccaaggcctgagaaataccatgaggtttggctggtgacacctggtggttagacgtgataattacacacaacatgtagcacaggctttactacaagccacaaaagcaccttgtattggtccattctcacactgctaatgaaaacattcctgagactgggtaatttataaagaaaaagagagttaatggactcacagatccacatggttggggacccctcacaatcatggcagaaggtgaaggaggagcaaaatcacatcttacatggtggctggcaagagagcatgctcaggggaaccaccctttataaaaccatcagatggcatgagacttattcattatcacaagaacagcatgggaaatctcgcccttgtgatacaattacctgccaccacgtccctcctatgacagggagaataggggagctacaattcaagatgagatttggctggagacacagccaaaccatatcacttctctataaatcagagttcctggttgtaagcaaccaaaacaaaccttgcttacttgagcagaaaggcggtgtcccttgaggacaatatctccacttaacagtaacattatgggcatcaggttcagaatctggatgccccagcttgctgctccttgacactggaatttacgtcaccactggcaatgtcacctcagcctccttgaatctcaatatccaaattcaaagcctagattaggatgcatctaattggactgacgacagtcatagaccaataccaaacctgcaaggaaggctgggacattttggcttatttaatgaaatatgggctttgccttccaagatacttatggtgcagaattgactactgaggaaaggggtctgtatccggagcacacagccaaaggacaaatgtctaccggacaccttaatctcactaggcatcaggcataaccacaatgcattttcatcttaatgacacacaagactgcaaacgttttatgccatcaaaccctttgatgagcttttacaaaaataatttcatagtagttttacaaagagatgactaaaaaataacttgacaaagtagccactatcgtcttccctcttctactatccaaacacctacctatcttctctttctctctcttttttttttttttttttttgagactgagtctcgctctgttgccaggctggagggcagtggtgtgatcttggttcactgcaaccgccacctcccaggttgaagcgattctcctgcctcagcctcctcagtagctgggactacaggcatgtgccaccacgccaagctaatttttgtatttttggtagagatggggtttccccatgttggccaggatggtcttgatctcttgaccttgtgaccatctcggcctcaccaaagtgctgggattataggcgtgagccaccctgcctggctctatcttctcttttaactccagtgtcttccctgagacattctgttacaccaggggtttggtctaggtcctgttgcttgctgcagagaaagccaatcactgagtcaaggagtattgctggggaagaaggccttatttgggtgctgcagccaaggagaataaaggatcagtctggaatccatctccccaagcaactaaaatttggggtctataaagtagggaagaaaagtaactatgtgtgggaaaacaggaattaaggaagggtaagaaagaggacttggtcaacaggcaagtggtcagttaggcaatcatgatgagtgaggcatctggtgtctcattgtttagatgtgataatctggtaagtttcagttccttgaaacattctgggaggcttgatggttggtttaccgagaaaggaacccagataagacaaatataactttcttaagttttaccctgggagggtcaatttctaagtttattcagaagaaacccaaaacatctattctttgggatagttgggctggttttaatttcttgccactcaaatcactttcctttccattcctacctactgcttactccaagaagtaattgctccaataaattatcatgtagtacttgttatgcatttttattatttaaattttacatcaccttgccttccatataaagtgacatcaggcaagccttttcatctctctaagcctcagtttccccatttgtaaaatggaaatgtaattataagccttatgtagttattacaagtttaaaaaaaatatttacaaagcagttaagcacaatgcctgggatttgatgagttttgcaaaatgatggtaaatattatttcacatctttatctgatcatgaactccttaaaggcaaggactacatcttattcattttgttttctggacatggggtctggtgctccatgaatgtttgttgaattgcatttcctgcccctgaatagaagctaggtctctacatatgcttctatatctcaatttatttataggcctctttgagacctttaagtgatacactttacaaatagtcatatataataataatatctatttattatttgagtctttttcctcaaaactatgactaacagaaaattaaatctctccacaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaaggtaagaagcttcttgtccaatggtgggggatttcctccttatctctaaaaggacatttctttgttaattatgttctttgaagaattgatttcaattaatggtttgttatatgggagcataattcttccttgactagtcatgcatttagactcttcatttatggaaactgaattttgattatcttactcattattattctcttaaggaacaaagtaaggtgagaaagggttaaagtagataccagcaacgactacatttcctgcacaccaactttaactgtactcacttacaatcgggcattttggaaggttattgaaatgatcggcagtgagcaggttagacaatcaaaaaggatgttttgaaatggagtgtttgctcatacatgtggaagcagaattgtctagccacttaaacaaaaaaattctagggaaagtagtgggtattttaatctttgttttgttttttttttttcttcaagatggagttttttgttcttgtcacctaggctggagtgtaatgatgcaatctcggctcactgcaccccccacctcctgggttcaagcgattctcctgcctcagcctcccaagtagctgggtttacaggtgctcacccccccccacccagctaatttttgtacttttagtaaagacggggtttcaccatgttggacaggctggccttgaactcctgacctcaggtgatccaccctcctcggcctcccaaagtgctgagattacaggcatgagccaccgtgcccagcctaatctttggatttggataattttgtgtaacctttctacattgagaagactcaggacttgtggagggcttcacatgtgtgatgcagtgatgttttaaggtattgctggataccagtggtttaatatattttaacagaggcatttttcctttctccaccattacaaatttcaactcaccaatatctgttaaagacgttctgagttctaggcatcctaaggaggaggcatagaaaacacccaggtgagggctctacagtgaccaggtatctttggaacataaatggaatgtattcatcagagggagaaatgatgcatgtgtatgaaatatggtaaataccatacctccaacatcactcatgaggtgaaggaggaaggaaaaaaagtctctgttgtgaacttctattcataccacccagaaaaatcagtgaaaaataattgaatgaagaataataggaagtcagtaccgtctgaaaggttttaaaaagttatctaggccgggtgcagtggctcacacctgtaatcccagctctttgggaggttgaggcaggtggatcacaaggtcaggagtttaagaccagcctgaccaagatagtgaaacctcatctctactaaaaatacaaaaattagctaggtgtggtggtgggtacctgtaatcccagctactcaggagtctgagaagagaattgcttgaactcgggaggcagaggttgcagtgagccgagattgtgccactgcactccagcctgggcgacagagcgaaactccatctcaaaaaaaaaaaaaaagaaagaaagttacgtaaatctttataaaataatcttgactctggaatggaatcaaaatttaaataccagtttcttttgtaagacgtcttttctatatttgactcaaccaagttcctttctttagtgataataaattgacttttggaagaaacaataaactctgagggacaaaacgttcatttcaaaagatgaatttagactactgggacattctgcacattctgtgaacctggtataagcttctttttctatagctacagccacggaaatgctttctttcctcaggaaaaaaggagcaacagtttgggtttcatctcattctgcactctttttttccgagtggcaagctatttccaagtgttttaaactataagtgtacccaccattgtaccctattgactttaaaaatctgcccatgatttttttttttttttttagatggagtttccctctgtctcccaggctggagtgcagtggcgcgatttcggctcactgtgacctctgcctcccgggttcaagtgattctcctgcctcagcctccaagtagctgaggttacactgcatgcgccgccatgcccagctaatttttgtgtttttagtagagacggggttttgccgtgttggccaggctggtttcgaactcctgacctcaagagatccacccgccttggcctcccaaagcgctgggattttaggtgtgagccactgcgcccggccccgcccataattttttaaaagcctgatattcatttgtaccaaactcttaatgaccattaatggcttccatttctgattttcccaacaatgtctgaattttagaatgcacacacacatacagttaagattacaaaaaagattcactagtaagtagcaaatctcttaacctccctggacttagtgtcttagtgtcttcatgtacaaaatgggacaatattacctgccccactgacctagcaaaagtatgatgtaaatcaaatgagaacatgcatatgaaaacttgaagctctacagaaacctatgtgatatggctattacttttttaacagccatcaaagccttaaacttaaacatgggatatttaagagtggtatctcaggcaatagctatagcgtggggatatagaggcagtcaaacctcatttcagacagaagattgcctgcattatttacatataaatgcaacctagacataacctgatgctgtgcttttaaaacatttattatttattattagtttttcatttttatacatttacagggtgcaagtgcagttttgttacatggacatattgagtagtggtgaattctgggcttctagtgtacccatcacccgaaaaatgtatattttacccaacaggtcatttcttatccctcactctcctcccacccttgcaccttttggagtctccaatgtctattattgcactctgtatggccatatttacccatcgtttagctcctacttatcagtaaaaacgtgatattttactttctgtttctgagttatttcacttaaggtaatggcctcctgttccatctgtgagatgtgcttttaaaaattaacaacaggagtttccttgcctatagatttaaagatatttatccttgttattaattcatgctgtctccggtaaggcacaaaggcagctcattagtaatgctccagctccccacagtgggcacgttgcttacatgcactttgataagcgtcagggactgacaccgaagtgttgagtgaatcccctgagtagccctaccctctacttctgaaaccttgattcaggtccaaggatcatgtgtaggtgcaaagcaccctgtgccacactgggacctgggaggctcattttcagtacatctactttgttccttcttttttctgtaatgtgacaacaccactgtggctcaagctttcaggtggtcccaatctgctcccagaggcactttatctgtgactttcctagctgggtagtgcccttgattttctgatccccaaaacatagctgctttgtgattcattcagcaccctactgtctgtgaggtgacagtgaactaatttggtgagaaactgatttgaaaactaatttggaagaaactgacagcaacctcagaaggtgtggctttcaccagaaacatctgacgcttacatacttactatagaccaataatctataaatataaaatgtaaatgttatgtccttattctcctttgatgacaatgccttcatcaaaaggagagctgttagggatttctgccctgatcataccatgtgactatatgacaccattttcagggaagtttcaaagtgagcggagtgaggagttctgctcccttatgtctttgcccaaagagggagtggacgcagactcagcagagtctgcagtcttggtactgcagggatggctcctcctctgtccctgttcatcgtgccattgacaattttcaaaatcctttcatttatactatctcatttgagcctctcaaaacctcctctccttcctttcatgtcagctatgacctgttcaacagatattataatcatagggaatgaaaatggatgttaacctgaaagggaaattagtttaaaccaaaatctctttccttgttgaaagtcacaagacaattgcccagaaaaaaaaaaaaaaactttaaaaactgatattgtaaaacctttttttgagtgttagacaataaaagtgtcagataaagagacttatctctcaagtattaatattaagtgcccaatggcaaaatagcatttacagttctgcttttattttccaccaaatcacctaataacattttctagcgtttaattggtagaaattcacccttggagtaaaaggtgaatgcttagtatcctaaagagtggggtgagggaatgtgttgtaatttaataaactaggaaaccaactacatacattcaaatcttaatttgctccagaaaacggcctagatccctgttaatctttaaacattaaaacaataaccctttaagattataaaatcaaaattctctctgctaaaaccttacctttgtctgtcttaaccatattgcagaaaattccagcgactttaccatgactggatgagtcataaataaaacccattaggtcaggtacttagaaattaaacacacataatttcagggacaaatataaaagctggaccaaatcagagcctgcaagcccttaacgttgcttctttgcctggccttggaattgaaatgactatggggatgaagtgtcactggggcatgttgcaaaatggaaaaggaacctggttaacaggatcgcatttggagaaggaaaacttttggattctgtttccagggcacatacatatgacctggtatgtgggtatgtgcccccgatttatttcaattaaataatttctgataactatttacagcctcattgccttcaatataatatcctgcatggcaaaatatgtttttctttaaaaatatttatgtttttgcatatgattacagagtgtgatttttgagcattggtttattcagcatttgtgtcactctaagaaaatagaaaatagtatctaaggagtatatgagctcagtaccagccctgttatactgaactcagactctaatcctaatccctggtgggtttttttgttttttgcttttgaggcggagtctcaccctgtcatctaggctggagtgcaatggtgcgatctcggctcactgcaacctccgtctcctgggttcaaatgattctcctgtctcagcctccgagtagctgggattataggcgcccaccaccacgcccggctaatttttttttgtattttcagtagagacggggtttcactgtgttgaccaggctggtctcaaactcttgacctcgtgatctgcccgcctgggcctcccaaagtgctgggattacaggcgtgagccaccgcgcccagcccctggtggattgttttacattcaaattaataatgaactctactgtcttcaatctagcaagatctagtcagcaccataggagaaagtgctgccttgggagctgcaggcattgttatttggggagacatgaatttaactgcatccaaggtaagtcagtatcttgaaggtatatttaatgttttctattaaaagtatttctctgctttcttggagagcttaatgacctccatagcaaaccagctttagaataaatattccaaatcagtgcctgatacatagcaaaggctaaaaaatattgtgaacttttataaagatagtaatcataacactgacatttgatgaatatttatgatgcgctaaggttgtgctaagagattttttgagtcggatttgctcacttactggtcatatgaggtagtgactatcatcctcatttacagatggtgaaactagagaggaaaccaactaggttaataactatttaggatagttagtggtagagttggcattagccacagtttgatgatggacaccttgcatttaatgactatagaaaatgtgttatatactattttgagaggtagaaacaggtggtaactttttaattctccacaatgaagttactttttcctctacagagaaatcagctgaaaattatcagcatttaaaataagatttatggcggggcacggtggctcatgcctgtaattcctgcattttgggaggtgggatcacttcaggccaggagttcgagaccagcctgactgacatgaagaaagccagtctctactagaaatataaaaattaggcgagtgtgatgacacatgcctgtaatcccagctgctcgggaggctgaggcaggagaatcacttgaagctgggaggcagaggttgcagtgagccaagatgacaccactgcactcgagcctggttcaaagagtgagactccatctcaaaaaaaaaaaaaaaagaaaaaaaaaagatttatatggctcttcaaatttctctcagctgagatttttttttactccaggaaagattcctagttttccccaatccacattaatcacaatctcttccatatttccagatgcggtttgtttatatttctataatgtaatgcattttaccttgaatactggcacccttgacactttttgctaaattgaatttttttgcaagtccatgatgatctgatattattctcagaatttcacagtctcaatttgttgctactgagatagtgttcatgaaactgtttatgcctatgcccacatatgagaattaggtagaaactgagaggattaattcctgactttccaggtgtgatatttccaccccagtcccttggtggctcgtcagaagagcttcatcaggaaggtgggtgcacacaggtggcctctgtttagaacacgtaataggaaccatatacacaaaagttacttagccatataggttttcatgtgtttgaattgtattagaagtacaggacccaggacagttgatggaaattaacaggaaaatccagaaggctataatacttggtagaatggtggcataagatgatttgacaataaatgatggactatgattcaggctctaacacaaccaaggaaggccccacatacctgaatggtagctgagggcagcagttctggtacattcctaatttgggtttgttccttttccttttatacccattaacttgggagctagaaggaagaaaaaaagaatgtaaattgcagaaaggcaaggtctcatgtgctgattctgggggctatttgcaagttcagttgcttagcctgattataacatagtatccatctcctgcccctcagacctctcccctttctgatttgggacccttgttatagtgcccaggagcctacaagttcaacaactgaaccaagccattatgttttaatcaagaccaaagaactgtgctagaagctctaattctatcagtaccagcgagaaacactaaaatcgatttctttgtacatttctaccagggagaacacactaaaattgatttcttcctacatttctaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggcctctagcctagtcatttaaagaaggatgtaacttataacattttttttctcttatgaattctattgagagatattataagtagacattatgtatgtcacttaacataaacagaaacattattttatttgcctccagtctggctaggaaaccagatctggggtaaagtcaatgtacacttcctccttattggaatatttaagttgcatttaaactaaaactagtataatttagtcttttcatgaatgtacatacataaaattatacataaaaatattaaattattcatttcaaagactgttttttcaagttggcaatttatttaaggacacattactaagtaatcatctgatttaacagaaggggtcacctggtcaactggtccactgaagaggactaaatccagtttctattctagcctcgggttcacactaggtttctgtttcccacttggactcattaaatgcagaaccattcctggcatagcttctcatgaggggccggagactgaggtaagggggagccattaccaacttgcaaagcaccaattctaagatggcacttggagtccttccttcgtagaccctggcagtctgaacactgtcaaggctttgggataatattcatgcttacctaccctgacactgctgtagatctgggagctggagccatattagtaaagatgcagttggtgacttttgcaagcaaaaatcattatgtagaaaacatgacatttaaggggtccagaagtgctatggaaaaggaggcctatgagaaatgttagatatttttgctttccccttcccatgtatgactttttatagtgaatttagagtcattttgaatcaatttgaatcatggtttcactacgtatctagttgtgtgaccttgggaaatttacctacagtccccattttgttatctgaaatttagtaatataactccgacttcaattaattattctgaggagtaaatggaataacatagccattgcatacttggactccgctgttgatcctcaactgactttttttttttttttttttttttgtagtgatggggtcttgttttgttatccagcccggtctcggacttccaggctcaagagatcctcttgccttagcctcccaaagttctgggattataggtgtgaaccacggcacccagcctcaaccaactgttgattaccaaagtaatgggaaagtgcaggataaaacagggtcttgggcaatttctacttcttgatgctatattctgtttaaaatcacttatacgcattgtgtttttctcttgagagtcatgtttaattgataggacttccttcttctggagacaatctacttgaaaggtaaactcaaagtaagtaatgatgctgttgtagaagaaattatagttgattcaacctccttcttcacctctgtttttctgtgaaacatttgaaatccaggtgtgttcttttcaactgcgagtctatgcttgttggaggttattgacattgttaaggtctaatttctaaatgtaaaaaacataacaaaacaaaatgctgtgaatggtaggtagtattgcattgattagctttttaaaaaattaaacttatttctatatcaaagatgatacaatgaaattatagaaaatttgtgaaaatagaaaaaatgataaaggaaatcaccaataatcactataacataaacgggtaacttttggtatattactttctaatatttcttctaaagaccttttaatatgtttgtaatagtaatatatgcatatgcattttcacttacccatccattataagtagtatccgtgttatttcataaactttatagctattacttaaaatcatttttaaggccacataatggtctatcaactagatgtaacacaatttaattaacaattttctgtatgctgtgattttttttaaatgccaagcttttactatttagtcacttcatcagagaaaactttccagatcatccttctaattcattcattcactcattgatcagtttgtttgttaatcaatttattgagcattacacgttagtaggtactgcctaagctttggaatacatccttgaacaaaacagacaaagagtcctggcatcttggaatttacgttatagctcagagaaacatattaaacacacaaataagcaatttatatcatatgttagaaggggataagatttataggaaaaaatatagagagcagagtgggggagggagggatattctgtgtttaggcctcatcaagcaggtgcccatttgaacgaaaacttgaaaaaggagag

SEQ ID NO: 14048 - DNA, 11333 bp, Human
agtagtgccaagattatagctcactgtaacctcagacttctgggctcaagggatcctcccaccttagccaccctagtagctaggactatagattcccaccacgatgcctgctaatttttaaaattttttgtagagatggggtctccctgtgttgcccaggttagtcttgaactcctgggctcgagtgatcctcctgcctttgtctcccaagtgctgggattacaggtatgagccactgcatctggcctggatttccttcttaatacacaaagaaataattatttataaatatccattgataaagtgtttagctctttcagaggcttaattcatttttcaagtaaacacaatttactgtcagagaaataactactttgccagtataattcatttttttttcagtttaagaattaaataagtattaacaataattgcatattgaatctgattctccaagtataggacagcctcacttcttccagattatttcaatctattccacaagggtctataaggttagcactaaaagttgaagtaggtataatttgtctgctgttgtcatagattaacttctcttttggaaaaagccttccaggttcaggtctcttacccttccataccaggcatggaaatgtcttaccccagcctactgtgtatctacagcttaagtgtaacttcaagactgaattttttaagactcaaagaaacaaatggcaagttttttcctgtagtgataggtgaagaaatattttaggacacagcactttgtaagaattataaaatggcagtatttatagagatcttaaagataatcattagttgaatttcagtttgctcaagggccctcaaattagaggctgttattccatcttttcttcaggccaacattatctccttaagataatctacaacccttgtgaaggttgttcctgggtagagactgagaggattttaggaaaattcacgagttggggtttttttccctagtaattctgcaaaaatgtattattgctcagtctccttagggcaggtctaacacccaggcacatagttttaggccgtatcttattcacctttgtatctctagtacaaatattttcagatatgaatttgtttcaacttttggtctctgcagtgtcatttagtacagaaatataagaggtaggcagtgtatcttcctactataaagaaaaaaactaaattttttttttgttaaataatgtgtctcaggtcacttttaataaatactaagctagtgatttactactgctttccaggcactcttctgggtgctaggaattaattacagaggatttgacatatgttaaagctcttgttttttccaccatttaatctgtggagccttagtctttggattttaaaaatactttgaaacaccctagtatttataatctgccaaagagagagttcacttgttgaaaatcagcaataatttctatgtaagactaatagactttgtttcaactgttgatatggtttggctgtgtccccacccaaatctcaccttgaattgtagctcccataattcccatgtgttgtggtgaaagataattgaatcatgggggcggtttctcccatactattctcgtggtagtaagagctgatggttttataaggggaaaccccttttgcttggttctcattctctcttgcctgctgccatgtaactggtggtagtgagtaagatctgatttttttttcagcatccaaaatctttttattaagagggtaggatccaaggttagtttttgtagcctcggctggcctgtcggcctctgatgcactcgaacttccagcccttggagcagacatagggtttggtgtggctgtgcggggttcccgggccttgctgaaatgctggtacacctttcggcccttgcaaatactggagagcaggacagtaccgcagccctcgggggagtccaggggcaagatctgatggttttataaggggaaaccccttttgcttggttctcattctctcttgcctgccgccatgtgcctttcgccttctgccgtgattgtgaggcctccccagccatatggaagtgtgagtccactaaacctttttttcccttatagattacccagtctcgggtgtctttatcagcggcgtgaaaatggactaatgtagctgttaatagtcaagttctcaaaatcaattgtaaaagcacagtaaggaaacttagaaaaattactgataattctaccttctagataaccaattttgatgcattttaaatctatattagattatcctacatataagaagatacaagtttcatatattttattcacttaattataccaagaacatttttccgtgtcattaaaaatcttgtaaaccatttttacggctgcataagaattcatcatatgcatgtactataatttaggtaatctcttatttttggatatttaaaccatttcctttctattatcattaacataaataatactacctgcattttctattatttccttagaataaatcccacaatgagtaatgctaaataaaaggcatgatcatatttaatgtaaagaaaaaatattggccaggtgtggtggctcactactgtaatcccagcactttgggaggctgagactggtggagagcttgagctaaggagttcgagaccagactgaccaacatggcaaaactccatctctacaaaaatacaaaaattagccgggcttggtggtgcatgcctgtagtcctaactactccggaggctgaagtgggaggatcgcttgtgcaagctgtgagcctgccactgcattccagcctgggtgacacagcaagtccctgtctcttaaaacaaacaaacaaatttttaaaaacccaaaatacaaatacagtgtcttttttgggaaaagcttaggatgcctcttaaactatggaacatacaaaacacaagttagggcagaaaaaaatatacatggctaatgaaaatgtgggtataattgctactgtggtttcagaaacctgtgttaaagatgaatgtggtggtcagattgcaagatgtgtttgtaatatctgggcacagaggtagcacagttattgtgcaaaagaaactattcctctgaagctctaattttagtgattctatgtgagaactctggcctgcttgctcttttgcaatcttggtttgcttgaggtgtgttgagggctgactgaatgcaagagatttaaagaatttgtgtttctcacattctttgtttcagttgtagctgagactgtatctctaagtcatatatcatcagttctacaaagaatatgcattgcttccagcccactaattcccttttctaaaaaaacaaagaaaagaaaagaaagaaagaaagaaaaagaaggaaagaaagaaagaaagagaaagaaaagaaaagagagaagaaaaactcaggcctgtaatcccagcacgttgggaggccaagatgggcagacaatttgaagtcaggggttcgagaacagcctggcaaacatggtgaaaccctgtctctaccaaaaatataaaaattagatggacgtgctggtgcacataagtaacccagctatctggaaggctgaggcacgacaatctcttggaccaaggaggcagaggttgcagtgagccactgcactccagcctggcgacagaacaagactctgtctcaaaaaaaaccaaacaaataccccccacccccaaactacacaaaagacaagaatttccaagaataaaatcaagagatctgtactcacaatttatgacagtttcaattagaaaagtctgggttttatccttgttttcctaatattttcttttctttttctttttttttttagacagagtcttgctctgtcgcccaggctggagtgcagtggcgtgatctcagctcactgcaacctctgcctcccggattcaagcaatcctctgcctcagcctcccaagtagctgggattacaggcgcccaccaccaggcccggctaatttttgtatttttagtagagacagggtttcaccatcttggccaggctggtcttgaacttctgacctcgtgatccacgcgcctcggcctcccaaagtgctgggattacaggcatgagccaccgcgtccagcctttctaatattttctttaaaacgtcccctttttcaaaattttttcaaattcatggaaaagaggataggaattatggttaaaattagtactaactgatgacattaaccgattaataaccaattatgttcttaaaaactggaaatgatatacaccactagataaaataatcttaaatgttcattgactttatagaattctctcaacattactttttggtcacagataacttctgggttgacaaaagcttttctccagcgccatttcatacagcttttacatggctgcacatcactagcctgctttaaaggacggtgctcccagcccaaagcctcaggaaaaagaccatggctcaaaaagctctgagatgtatcctatccacctgaagagcctattgcttgcctgtatccctcccttctagtgacactaatcttctgtacagaaatcctagtccagcaaacattgctctcatcttcgcccatacacaacctatgtaaagaatggctttcctactctttgctggcgaacttcagctcccggattaggcatgccacctcttccaggtagctctcagcaacgcacttttccatcagcctgggtgtgcccctctgtgttcccatggcgctttgctttcagcgcttctcccaaattatgtttacctgtttattagactctccacctctgaagaccaggccatttcatttggctttttactgccacgtagtaggtacctgttcaagcttgatggaaggacttccccagcctccccacacatattatgtaaagtgatcgctgtctttgcttcctcctggagaccatttattttatttttttgagacggagtctcgttctgtcgcccaggctggagtgcagtgtcgcaatctcgactgactgcaacctctgcctctcgagtagctgggactacaggcgcgcgccaccacgcccggctaatttttgtatttttagtagagacggggtttcaccatgttggccaggctggcctcgaacttctgacagcaagtgatccacctaccgcggcctttcaaagtgctgaaactacaggcatgagcctccacacccgtccaggagcccatttatatgggagcctgcttctaaagattattacctggtgccagggtattttccagacctgtcctcacattcctgttaaacaggaggaagtgaatcgcgctccttttcatctaccttctcggagggtttatgcctccaatattaacctcagcacagccaaagaaaatcattccattccattgagcggagtcagaaacatgactaggtcacgatcacaaccccgtgtgtgccagggtgaccgagactgggtgactttatggtgtttcaacgtgtgggttttgactgattatattatgggttttccagtcaaaaactcaaagcagtggataaagcacttgcgacctaaaataagcaatggaatgaacaggaaggcgaaaccagagtttaaagcggcaggacaaacaggaaaaaggaagagtgaggcaggaagggtttaaatgcaggctcctcggaggacaagtcgccgccacacccctgtctgccgtcccgccagccgccctcacgcggcgcgggaaaacggtcggcctcgccctgggctcaggttctctccgcccgccaggcagtggggtttttttttgttttttttgagacggagtctcgctcagtcgcccaggctggagtgtagtggcgtgatctcggctcactgcaacctccacctcccgggttcaagcgattctcctgcctcagcctcccgagtagctgagactacaggcacgcgccaccacgcccagctaatttttgtatctttagtagagacgggctttcaccatgttggccaggatggtctcgatgtcttaacgtcgtgatccggccgcctcggcctcccaagtgctgggattacaggcgttagccactgcgcccggccccagccaggcagttttaatcgagcgctcacaaccactgagacgcagtgaagcacccaccataaaatcccaggaggccgaccgccggttcagactttttcttttctttaatccccgtccaagggatccgccctcaccccccaccccagccaccccaattccctattccctccccttggacggcgccggggaaaacaagctgctcgagctttatttcttcggtgcaaccaactcagaatgaattcctccgcccctgcgtgctcagtgagtcggcaccctagcagtgaactgcatttaaaacctcaggaattgagcgaactctcccagtggctctcctcaccgggatccccttccacgcctcctccccgtgccgcgcctcagtccgcactgctcattggccgcgtgccctgccaatccgatgcacgtcggctagggcaaagaccgcgaaaaagcgcgtacacctggctctgggagcgcgcgcctaacgccagccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaagttactgtcttggagttttcaattttccttcctttatattttacccatattcgtcttttaagatgttagtatgatgtgaaatttatctaaccaatcttgtttaattcccagatgagggtgctgccttgaattccaacaacttaaggggagaagaatctgggtaaacttcacccacccttaaatacagaaacctgacttggggtcttcctagtgtactcacactcctacaacttaagtgtccaaatgaaaattcacctgaatattccaggaaaatatgagctatattctggggttaaatgtaaaatgagcctttaacaaaagctgggcagaagttgtcttataattgccaaaggaaatatggaaacaaattaattttgtgacatacaggagcctgaaacaagagacagcaggcaagctttcaagtgacttaatagtgagtataaatttagtcaaacttgtttaattttctagtaaaacagctcaacttctgagcttatggcaaattctaataacatgtttcccgcagttagaattacttgggtagggaaacataattattattatttttttctggtttggggatcataacgtttttgcaatacttgccttaaatcactacgatagatttcttttttaaaaggcaaactgtactagatagtcttgtattttgttaatatacaacttgtccattttcctccatatccaatttgagattgttatagataagaatattgcaaccctttggtgatccactatcctggacttaatctttaaaattcacatccttcagagaaaggaattcatttttattttttagtgaaatgacatgactactcttttcttactctctttaaggagaacttgagagaaattcagtaaaaccaataggaaaatgcatagttaacctaatgtttttactgcacatagacgttttgatatctttccacatgatgcaggtttgcttcatgctgctcataagacaatagttatgaaagctttatcttcaatttagtagtggacccatctgtgtcattcagagagattaattttatgaataatggaatgagtaataattttaaaactagctaagaagttagcctaagaatactggcctttggtaatgaccctttcatacaagagttgactcttaagtacacataaggtgtttttttttttttcctttttagcaagcctcatttgggtaggggggaggaagataaatagccaacagtgaaattgcttcaacataaaaacctttttttttttttaaaggaaactgctttttatactctgaaaagctaaagataactccaatttatcagtgctggtgtcacattggtggaaatttttcagcaatgagcatttaagggtgtttcatggactacaggcataaatatgtgacaaactactatggtactacaaaatcaggttaattgtagctttagagtgacgtttactgtgagttttaccaagataatacccattctgttacccttttattagtcctttatttgttgaaagtgttcattccttgctctaacttcaaaatataatggagtccttctgtaaatgcagtttggtatgactcattttagacctcacttaagagattagtttctaaagtatcagaaaatgaccattggtagtttttgatcctacggcctgacctccggtagcttgctataatactaacatcaatctgggcagatacttcattttctattttgaaaagtaatttgtaaaactcaaattcttgagttttacattcttgagcattcttgagagtgtttcttatttaattctctcttttcaaatttaccaagatttgcatattaccaagataaagccaccaaagtagccattcactttccaggggtcagttgaaacttgtaacctgataactcctgggaactccttagcagatgttagatcagccatagtcaaataacagtggaaaaagtacttgatgttaggatggggctaaattacagtttaaggat

SEQ ID NO: 14049 - DNA, 30528 bp, Human
  misc_feature (1)...(30528): n = A,T,C or G
atgaagtggtatctcattgtgctttttttttttttgagatggagtctcactctgttgcccaggctgaagtgcagtgacacaatctcggctcactgcctcccaggttcaagcaattctcgtgcatcagcctcctgagtagctgggattacaggcatgtgccaccacgcctggataacttttgtatttgtgtgtgtgtttttttttttttggagacggagtcttgctctgttacccatgctggagtgcaatggtgtgatctcagctcactgcaacctccacctccctggttcaagcgattctcctgcctcagcctcccaagtagctgggattacaggcacctgccaccatgcgcagctaattttttagtagatttttgtattttttagtagagatggggtttcggcatgttggtcaggctggtctcaaactcctgacctcaggtgatccacctgcctcagcctcccaaagtgctgggattataggtgtgagccaccgcacccaactgactttcgtatttttagtagagacaggattttgccatgttggccaggctggtcttgaactcctgacttaggtgatctacctgccttagcctcccaaagtggtgggattacaggcgtgagccaccgcccccagcctcattgtgcttttgattggccatgtttctttttgtctgtctcttttcttttgtctttcatatatgtatttttcatatataaatacatgcatatgtatttatatataacctgtacccaaaatggatttgaaacatcctcttgtcctcgtatggatatgttcttcgtgttctctctctttgctcttgttgctgcctatctgtctcactgtgttatggaatctctgggttcatctctgtctctgtctctaccccatggtattatctgtgcatatcctctggtgccagctgttcaaacagggtgtggatctgtattcacactggtgaagggggcatctggcctttcatcttctgcccacctcccaccccagttcatgtgttttgcttctgcagacagaagtatgtgggtgaaccttgagatcaatctctccttcattgcctgggggtaggaggcttcctgggcggtccttgccctcctacacatcgcctacccctggaccatccatgctgttaagcattggaggtgatacctaggagtccttggttcccattttcctattagtgtgtacgtaaatgggcctcctcccagggcctgtgggacaaacccgtctggggtgctggggcttggatctgggggggaagtggtgtaagaggggcccctggcttaggagtcatttttctgagaagtgccaatgctttagggaagcggcttttcctccccctccctcttcccccccagcacacgttctctgcatcttgacctcaggtaaccctcactgggggaaggagggccagctgcccgtttctgctgcagtgatcccttgaggtggcactgtggaccctttcccctcaggactgtgggtgagaggccctccaaggttctgggctctgtccctgtctccccagcctggctgtgctatctgccacccccagcagtgtctgggccctgcttccaggtcatctctgccagccaggcatggtgccagctgtctgctcagctgggtgccacgggaaaatctccggcagcccaggttggggagctccacggggaatgcctgtgtgcctgttcttcagtgcccactcacctgtctttcttttttctgcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccagtaagtctgggtgtgggggctggggtgggaagggactgtggagggtggcaggcctcagagcttgggctctgggcacgtctgttctgctgtgagtggaaggcacggtgagcgacaaggtcttctccagttggggtgaccatcatttgaggtcttaaaaatgaaagccctatggcctataggctgatcatggtggttgtgtttgaagttgggggtggcagagggggagatgaaaccatgctgttctggcctgcagtggccctcgcacccctcttctgtgctctgctgttggggccttataaatagctccaaggactggacacacaggttggaggtgggtaaacaaacctcttgacatttgatggaaatggcagctctacctagagtgagagcagcacaccacctacgccccacccccactcagtgcctctgagggaaagggcttgaaggagcagaccgaggaaggctggctggaaccccacctctccccctgccagctccacccccggccatgctaggatgtgcttccctttgtggggaggatgagagggaggggcccacggtctagctgggtggatagggtgagtgtcccaggaggggacacttggcctggactctggcctcggacgcatgcatggtcttggcagggcctgtgttttccttgcctccaccctctgccatggaggtcacttgttggctgggcaggggtctcagtacccttcgccggctggccgagccaggtagtgggaggtggcggcagctctggccagctggcagagtccagggctggggcctgccaggccgcttacagtaactctggcccccagggcccagctgggcgccaggccagggctggggggaggagggagccggggcctggcctgggacgggagagggtggaagcagcagaatgggccatgggctgctggctggccggctggtcagctgctgacctgggaaacgtgtccccacctctcctggccagcagggactgcacaccttgccctgtgcacccaccacccctctcacggctgctggcaagctgcctggcaccactgccctatgtgcctggctgggctgggtcagtgcccccttctcagtgtgggggcagcgctctctccccggagccagggagtctctttgtccctggggcaggccctggctgggcgcctcactgcccgcactggctgggtgcccaccaccaccactgcttcctggatcgcctcctctggcttagctgtggccccctccctcccaggctccaccagccaccaggagcagggactctatgtctgtgtttctttgtgttccccgccctttatgccctggggccagggggcaggcaggtgctgcctcagtttctcctgccaccccttatcaaaccttcatcttctgtttctgctgtctcttctctccacctcatataggagtatgggatggatggagtctggggactctgattctggtctggtcctatagtctgtgttagtgatggggagaggccagcctctggggtttggggctactagggaatgcattggtgtatctttgtagaatattcactgcatttaaagggactgtgatttacattctggacttggatcactggaactagaagactgtctgcttcctgacagggtagggttttatttttatttatttatttatttttttgagacagagtcttgctctgtcaccgaggctggagtgcagtggtgcgatctcggctcactgcaacttccgccttccggaatcaagcaactcttccgcttcggcctcccatgtagctgggactacaggcgtacgccaccatgcccggctacttttggtatttttagtagagacgggatttctccatattggccagggtggtcttgaactcctgacctcatgatccgcccgccttggcctcccaaagtgctaggattataggcatgagccaacgcgcctggccatttttatgttttaagacagggtcttcctctgttgcccaggctggagtgcagtggcaccatcttggcttaatgcagtctcggcctcccagcgattctcatgcctcatcccgagtagctgtgattacaggtgcgtgtcaccacacctagctaattttttttgtatttttagtagagatggggttttgccatgttggccaggccagtcttggactcctggcctcaagtcatctgcccgcctcagcctcccaaagtgttgggattacaggcatgagccactgtgcctggctttctttcttttttttttttctcatagggtctcactctgtctcccaggctggagtgcagtggcatgatcatagctcagtgcaggcttgaactcttgggctcaaggcgttctactgcctcagcctctcgagtagctgggactacaggtgcgtgccaccacaccaggctgattttttgatttttcatagagacaaggtctcaccatgttgcccaggctggtctcaaactcctgagctcaagcagtcctcctatcttggcctcccaaagtgctggagatatgggcatgtaccactgcacccagctcagggtaggatttttgacgggggaggagttagggacctgcgacctggtgcctgtggacaacttgtcctaacccaggtgatggcaacagagttcccagacactctgtccatctggagcctgggctcattggagggttggaggtgggggctggggcctggccccatccttgcccatcctggccagagggagcaaatgctttgccttcccctcccctcaatgttgcaagcttcttcctctttcttagaggtgggtggggaaggcttcccatcctggtaaccttctccccaaatgtgggtggggtgcccacatttcaggcaagtgtagccttcttcggctttctccacccaggttaggcaatgcccccttcctgccccctccctctgtgagccttttggtttccctgcccctcccctctccctagtaaacaacaacaacttctctccctgcccagacccttagcttctgagcttctcactgaccttcctcttctctgggacaaggtgtggccatgggtctgagggagcctggcatctccctccttctgcagagccagggctgcctggtggacagagctcctgagctctgagtaggaaagcatggcagataaaattatcacatgcctggcctcagagatggaggcagtttagccttccctgcttgcctggccttagggctggtgctgagggtgaggcagttcccaggagaggtggcaatccatggtcctccattcctgcaggagcagtggtatgccccagtctgcccataccctttttgtaggaattcttgctgatgaggcttcctactcccattccccatccaacaaaggtgttgggtccctcctccccctcatccctttccccaggtggggaggaggcagcacattaggtggcctgggtgcgcccttcagagacctagtagcctatgggaccaacagaaaccctctccaggtcactgtggggagggctgtgtatttgttctgctacagccagggtgggagccctagagatggtccggcgattctccccgccccctaaactggcccctggggcttggtctctgaagactggtgtttactgtggaggtctcagattctgtgtgcactacgggtcagggctgtgtgtgttttgggggtggggtcacggttgggtgtgtgttgggaaggggattaatgacttgtgtgtattgggtgagagggttagagagctgagtgtgttttgggggaattaaatccagagctaaggagggagagtcagcctgtctgtgtgttggtgttggggctgggagggggagtgacttagggcacagagtgtttaaagaggagtggtctttcgtttgggttcttaacctttcttggctggaggggagaactgatctgcctttttttgttcaccctgggaattccatgggcaaaggggtctgactgggggctgtggagtaggcatttagtgctgagtttaaaacttggacactgggctgggcgtggtgactcatgcctgtaatcccagcactttggcaggccaaggcgggcggatgacctgaggtcaggagtttgagaccagcctggccaacatggtgaaaccccatctctactaaaaatacaaaaattaggcaggcgaggtggcacgtgtctgtaatcccagctactcgggaggctgaggctagagaatcgcttgaacccaggaggcagaggttgcagtaaaccgagatcatgccactgcactccagcctgggggatagagcgagcctctgtctccgaaaaaaaaagataataaaataaaacttaagacactggctgcgtgcagtggcgcctgcctgtaatcccagcacttttggaggctgaggtagggacttcagcccaggaatttgagacaagcctggacaacatagtgagaccctgcctctaccaaagagaagaaattagccaggtgtggtagcgtgtgcctatagtctcagctactcgggaggctgaggtgggaggattgcatgagcctgagaggttgaggctgcagtgagctatgatcacgccactgcactccagcctggtgggtgacagagcaagaccctgtctcaaaaacaacaacaacttggacatttatgtcacatacaacttgctgataacctctctgagcatgtttcttttttgttgttgtttgttttgagacggagtcctgctctgtcgcccaggctggagtacagtggtgcaatctctcagctcactgaaaccctctgcctccaggttcaagcgattctcttgccacagcctcctgagtagctgggattacaggcgcccgccactatgctggactaatttttttgtatttttagtagagatggggttcctccttattaggctggtcttgaactcctgacctcaggtgatccgcccacctcggcatcccaaagtgctgggattacaggtgtgagccactgcacctggccaaagacatttattcatttatttatttatttgttttagacagagtctagctctgttagccaggctggagtgcagtggcacgatcttggctcaccgcaacctctgcctcccaggttcaagccattctcctgtagcctcccaagtagctgggactacagatgcatgccaccatgcccggctaattttttgtatttttagtggagatggagtttcaccatgttagccaggatggtctcgatctcctgacctcccaatccgcctgcctcggcctcccaaagtgctgggattacaggcatgagccaccgcgcccggcttgttgttatttttttgttttgtttttgagacggagtctcattctgtcacccgggctggagtgcagtggctcgatctcggttcactgcaacctttgcctcccgggctcaagcgattctcctgcctcagcctcccaagtagctgggactacaggcgtgtgccgctacgcccagctaatttttgtatttttagtagaggtggggtttcaccatgttggttggccaggatggtctccatctcttgaccttgtgatccgcccgcctcggcctcctaaagtgctgggattacaggcatcagccactgtgcctggccgtgacccagaccctttgtaggtgggagctggagagaatgggatgctaacatctatagagcacctactgtgtgtcaggggctttgtctgtgttttacaaattttaatccctgcaatcctggaagagggacattatccccacttacacagaggacacagtgctgggggaggttaaagtactgcagaatcatgactgtaggattgtaaagctgggctgttttccaccatctacataggcagctttgagagtggattgtggggcacactcttgggtgtgggaagtgtggggggtggggcttagtgctgactgaaacccccttccccactgtagaggccctttctctgccttagaacctacctttccccggtagggggtgtagggaaggcccaagccataccccctcctctctgttttggatcctgaaggctggagagaaagaaagataaggggcctgggccagatctccatcctgtcctggaagctgtggatacaatctgttcacaccatccccacccccaaatctgcccgctgtagcccacgggagtttgcagaactcagcgggcaccctccccccgatctccagacactgaaggaacagaatgtaaaagccacagttcttattcttaatttgtttcaatttgtggatggaggcaaagaagttgcaagccatcaacagaggagccggggatgggagccccaaaagggtggctgcatgtttgcttcgtgtgcctagagactggggaatgcccgagggtctgggtgagccccagcagaaggcagaaaggaggaggttgtgtccttcccttcttcctatcctctgccacttcctcgctgttgcagtctgtgcatactgcctccttccctgcttcccactctttccctggacaataggagggacagcccaggcggagggacagcccaggcagagggacagcccaggtggagggagtgctgcctagcaatgcctttcttggagtccgaaatgtagagtcagacaaaagaacatgacatggagtttttaatgaaaatggggtccctcaccttttatctcccagcaaggataatgcacaggttccctctggacaagatcccagcatagacgcggggagggaactcagggaaggaagcccgtcttccttttaggtgggtcagggccgaggtattgtgtctaccccatgccaagggatgtgttgcttatggggctgtaccagtgcaggcctgcctgccctttgagggagtagtgtctgtgggaagaggaagtggtttccatctctaagtcattttggggcagtgccttcttcctcctcctcctctgtggagttggggcacagcgagggattgggcctcccagggttgactggaggccactcaacctttggctgtcagaaatagaggtgctcccctccccattttgacttctgggttgctggaaacctcaaccagcccacagaccaagggccttccatgggcaggagtcttaaaggacagttcttcctgtgtggccttgggcaggtcacccaagctctctccaaatctgtttcctcctccttaaagcaagacttctggctgggcacggtggctcacacctataatcccagctactcgggaggctgaggcaggagaatcacttgaacccggaggtggaggttgtagtgagccgagatcgcgccattgcactccagcccgggtaacagagcaagacttggactcaaaaaaaaaaaaaaaaaaaaagcgtgggcacggtggctcatgcctgtaatcccagcactttgggaggccgaggtgggaggattgcttgagctcaggagttcaagaccagccttggcaagatagcgaaatagcgaaaccccatctctacagaatataccaaaattagctgggcatgctggtgcacacctgtaatcccagctacttgggaggctgaggcatgagaattgcttgaatccgggaggtggaggctgcagtgggctgagatcacaccactgcactctagcctgggtgacagaacgagactctgtctcaaataaataaataaaaataaaaaaatagagcaaaacttctaatctctccttggctgggcgagttgccgttaggccacggtcgcctgcttcctgctgaggcccttggtgagtttcacgtacccagcaaggctgtgatagtgaggggcagggtagagctgggtactgtcttgggggatggtgccactctatactgggagccagtgtccacctggcactgggcctcatgatttcctgtttgttgtcccctccagatggggttggggacaggagggggccctgcctggcacaagtgggggccagtttggcctgcacctgctgagggcttactaaacgcaaagccctgagaaggagctgagggagggataaggctgagcaggatggggccccaggcctgcagacagctgccgctggaggccccccagccccagctgcgggccagagccttccttgtttcccacttctcccactgccccaggacactgtgttctgctctgacctgccccatgaccttgctgttgcccagaacgggcctcttgccctagcttctcctctccagctccggaaatcctatctatccttcaaggaacatcttgaatgccgcctcttcccagaaatcttcacagatgttcccccttgcttgccacactctgcctccctacttagaatgcctgtgggtccttatttattttttaacaacactcatctcgctacccagaagttgcttctcccctgttcctgccatgagctgtaaccatttgggacatcttttcctgaccacaaggtctttgatggcagggacagagtctcaggtcccttagcgccttgcagctgtgagcgcagagccttgctccatcatttgaaagatcccgaaggcatggaagcactctgtcctcttcgccattagtctcatccactgtcaagatttgcatacctgcccccagaccccagcattccatctgtagccctgactgcacttcagggccccacatccacctgtccagcagcccagtggacttctctgctttgcagtctcaggaacttcactgatgcgtaagtcacacacaagtctctttgctacctcttttcccataccccttacccccacccccccacgttatttgtacctttaaaatgtttattgaatccaccttcctctgtccatcagcacttccagtttcctaggccaagccacccttgtctgatgcctggactgctgcagtagcttttacctggtctctcttgccctcctataatccattcttcacacaactactggaaagatctttttacactgtaaatctgatctttcctttgcttggaacctttctatggcttttccttgcatttaggataaaatccaaaagccttactgaggcctataagcccccctggtctggcctgagcccacctctctagcctggtcttgtgtaccttttccttttgaattttgtgccccatgattctagccttctgccagttccttcaatgaactcatcaactgctgtaaccccagggcctttgcacagactcgccctttaactggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggaggtgaggcgccgccaggcgagttcagcgagagttcagccgcattgcattaggcaaatgaggcccggcctgggtgggggtgtgtgttaaggggaggacaccgggaccacccccctcttccccgccccaccacctcctccaccacggcttcgctcggccagggactgaccaaaccttgggggagcctgggagccggaactggtacaagggaggacgcccgcccctcttccgtccttgtcccctcgcagccccctcctctccctgtactcggcgtccctctgtactctgtgtactcctcatctggagcctttcccccttcctgcttctctcctctcctcccccttcccaggctgcccccacttgcctgtccacatgccgcctctccctctcggttccctgcgtttctcccgctgcagccggacgcgccgggaatgggttaagccaggggcggtgcctggacggggcggggcggtggaaagggggtggtgcccggaggggagggggcgcgcagagctggggtgggggggccgtggcgcgtaccaccagagaccgagcgagtcgccagctgcccctggcctggcgggggcggaaccgcgcgggatccccacccccacccggaatcctcgccacggagaatccctggagaagccccggatccccggctgggaggaggaagtgctcgttgacccccagccccgcgctgatcccgcccccggcctgcggacttggggagccgctgtactctgcctcggacgccacgagactctagacgggagtcccctcgaggtgaagccgctgagttcccgggccccgccaggcttccctgggagagccgacggaccccccctcccagcacacacaacttccctgcttttcaccgggactggcggagcggccggcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgccttcgaggggaaagatgtacgagagtgtagaagtggggggtcccacccctaatcccttcctagtggtggatttttataaccagaaccgggcctgtttgctcccagagaaggggctccccgccccgggtccgtactccaccccgctccggactccgctttggaatggctcaaaccactgtacgtaccggcctctcagtctgctgttgtagggggtgggagtgggcggtagggcttccactactactcgggggtgagagtcccggggtgtagtggaggtcctgtctctacctttcacttaacccgtgttgcccttgctggacaattgaaccctcccggccgcaccctccccccagtaaccctaagtgcaatttgtgttagattagggctgaggaactttgagagttccttctttcaagcaacattccttcatctcttgtttcacttcttccaggagaaatgaagcccaagccccttgcccccagtttatatcttcttgcctggaatccaacagcttcacagcaggctggagggtggggtaaaggtcctgtctgtgtgggtttgtctgctcccgggggaaggcccccccgccagatcccacttgccaaagcccgagggagagccccttcctgtgcgacagctgctgcccccagcccttgctcttgcgtcattagagtgggtgtcaggggagcactcagtgtctttggtattgacagtggggtgtggcagaaaggggcaacttcatcagacacccgtctgccatcctaaccttccatcttggcaaggggcactgggtccttatggggttgttgtcctggccccagacacttggctgtcatctttgaggctttcatccccaggagtggaggggagaagctgctctggtgagaagaatccctctccccctaatcctaatccggtttgttctctggggaatgagtttgtttttgtgggtctggggctgctctggaaatgaggactgcatcccttcccagctccgccaccgagtccttttgttaccctgacttcacttggggatagggccaggtcctgggctgtgccttcctaagaggggcactgatgagaatcctagcatcctggcagcctggtcactttctctccttgttgccccctgcctgggtgcaggctcctctgggaggaagggctctgtgcacactcaggagctcggagcaccagggtgtacacctgggcattttcctgcgcagctgtgaggcagtgtacactgggtgggcgggagcaggcgcaagggggttattgttagatggctcaggtttcttcccctcctgggctttgggctctttgctggaggggaagctcttccgtggaggatctcccaccttcctggacctgctgcctccctcctgcctgccagggaggaggggtggagtgggtctcgggggggccctggcagattggagaaggttgaagggcaaaggacttaccccacccctcttgctgggagaagagagacctgagatggacagacagcccacctctgccctcccagagccacttctatcccagcttttcctattgtcctgcccccgaccatttcctctagggccgaatctgctgtgtggctgtagacacaagagggaaggtatcacccttgactttggaagaagagagagtgagaggatgactctaggaccctttttctcattctcccagtgctggagcaagacccccctcccctagggggatagttggagcagggctgccagagtcaccccttccactgccttggccaccttctccagagggctggagagaagctgggatctgagaccttggtctccagcccctgtctcttcttagcccatggggacagctcagctcttcctggcccagaactggagagggaggaggatcacagagagtaggacaggcagtgtattggtgagcccttcccctaaaccactggacatggggaagtggagacctgtccccacatccattctggggtggggtagtagacctagaggcctgggtttccagttcccgtagtctgagcgtgggtgtgcatatataagtgagtgaggtgtcagtggactcgggtcctgaggctgtgaggttgggagtgatgggggtctgggggcttgccttgaggcacaggaaggacccggagtctgagggtggcaactagactcagtctagaatatgtggggccaatgccaccaccttggaagggtccccttgggtgtgtggaagtccgctggtgactggagctgcctccagccccctcttggggaattctccactctcccctttactgccactgaaggtgggaagagcaggttggctctgggaggaggtggcctgggttctgcagggccctagggacattgcctccctccccagagccctcatttcggtgcattagaggacaaggggggtgcacaggatgtggctccccatctgtctcccaccaatctccgccactcacacctccgcccgctcccagacgtccaagaatgtgaagcacgtggatgcccgtagttgggggagggggagacgcttatcaggcggccgctgggctaggggccttcttccgctgccgcggtacacccagagctacccccgcctctccccgggaggaggaaggacggtacagagggccctacgccccctccccaaccatccccaggggctgcgaggggagctgcggaggagcgggcgccagctggattgggaggggagccgctggccgggggcccggctgatttcctgctgatctcctccaggaaaccggccccttgtgcgagcctgcgaacggctcgggggcgtggggaatccggagtggagcgctctgcgccgcccgccctgccaggatggggagcgagggaggggcaccctggcagcgtcggcgggaggggacgcctggcttcctgggtcagttccagtcctctgttgggcgctggaactttgagctgagaaggtgtggtccttctctagcccgagtccttctgcaggaagaggagagattggtgggctgggcctctggggagggaggttagcagggatgggccaggcccgggcagtccctcccccgttggtgtccctccccactccacctgtgtgtgcagggagttatggccgtgtcctaactcttgcagaggctgtgaggattccggagttccccacacctccggccttggtccttgtacctcacctccttggactgctggctggaggcctggggaggtggggcatcgagctctgggttcaaagggcagagcagggaaacctcagagctgggttacctgggtgacaggtggggatgtgctggaggtagggggcaggctatgttacagcctccaaggcagtcaagctgccgttgggtgggctaaaaggaggccttgcccagcctaaactgtagtccttgcctctggtcatctctcccattctgccaaaaaataattttaaaaagcacattctctcagttccgtaaacaccctctgttggactttgctttagctccatgtttttatggctttttgccctctagtctgtcccaggccttagagctgtttacctctcatcctggtatcccccatgactccccataccctagctcccctcgtgacatcccgctctgtacccccaaagctccctcagtcctttctccctctccagtctggttcattttagaagtggggccttgggagaggcggggcccagggcaaacggtggattaggaggggtggggaggtcagtgccttcttcctctgcttgtcggaatgctgaccaagattctaggccatggtccccccaaccctccacatacccccttgcccttgatctcccctccccccaccagtctggattgtctattgttactgcttttacgtcttggaaaaagttagcacaacaaagggctgctttgtggctcaccccctctgcctcctggcctcacccaggccccccaaccccgcccccccagcagctgttctcaggcctctcagcctgtctgatttgcttgtctggcctggggagaatgaggtgggagaaaaccaggccagggcagttggtgttggagtgaagagcagacggcggtggggaggtcaggagagaatctgctgggctggggatggtgtgggcatcaactgtcccattgctgcaggctggtcttggggcagggaaggggatggggggccatagcagtgctggtcagccaggctggcctgggaagtggtgcccaggcactactaagagccaggaaagccctgccaaggttgttggcctagttccctgtcatcagccgcctagcagcccccactgtgtctgcaggtaaggggggagggtggtagcacatagtcagcccctggtgttcccatgcttccttcctctgtgccccaattttagggccatgtgatttggggctatgtgactcatgtctgtaaggtgcttgggccaggagctgtgggcacctttaaatgccagccagtctcatgtgccggagtttggggtagggctaggtaggattgtggaatatgggaggaggcagggatctgtctacctagggaggcatcctcatccatccttggccctggacaagagaacttgaacgttggtaggggcctcaggacgatgctgcgtggccccttgggaatctgggattgtcctggtcatagttcttatcttgcacccaacacccttagctgcccaggctttggacatggatagcccctacccaacccagccctgttctgcctacagtgatgggcatggagccagacactggggaggatttggccagtgagggctgcccctgctgtctgggtcacccctcctggctgccctcttggagctgaataacagaaggggaggggttagtaacccggacatagtattgaggccagacagacagagcattgatgggaacagaccccctttgtcatgccatctctccccagatggggggtacccagaataatgggcttttggggccctggggactcttctccctgtattcagggtatctccccctatctcagggagacacctcctactgtgcccagcatttgtgactcttctttgcaccccctgccttgggtccctggccctgggattgtttgggtggaggaggggcagtggctgctggcagaatggggtggaggggggagcggaagcagagggggcgggggagtggccggctttgaatatcctgttgaccccagtttcctctgcccccagcttatgtcctcttccctccctcctcttcaagcgttaactccttcctaactcggggggagaacggggccaggccgcccaggggcaggagctttagaatcagggtgacccccacccctactccccaagcacagtcacggcacacatacaaatgtgatggtttatcattgtatctttgtggttttgaaggtgggggtcctaggagtccagaggagtgatggggtgctggaggcttcattggcagcctcctgccctgagtctggctggggagtcccagttttcttaagacttgaatcctgccagcagtggtgaggctgggagaggctcttaggagggacggtgaggcagggtggagcttggtactaaggatggcgacctaggtctctaactgcccctcccctcttctctctctagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaaggtgagttgaaggggtcattgggaaggacagcttgatgaggtcaatgggatgtccccacttctgtgtcctgggagtgtgcagttggggggtgtccctgaagttgctgctcttctttctctgtggaagttggcagcaagcagggacacctaccacagtttccccacaggtcctcccccataaatgtgcagggctccctcaaaccagaggtcccctcctgcctcagctcctttccctgtctctatcctccagctggcagggcgtacgcctgctctgccaccgctgcccaggttgccatggtgagctggctgccgactggctcttggctggggacccaggaggcctcccccggcggccctgcctgaacctcaccatggcagcctggcaggaggcagttaggagcaggcaccctgccttagcttccccttcaggtgcccgggctgtgggctccccagtgtctggctggatttccccatcctcacgttaggtgccagggtgcaggtatacctggtccttagcagccctgcgcccggcttctcctcctttccctggggcctgagcctctgtgtgcgtttcttcctccagagattggggctcagaatcttcacagctttgggccttgcagctctgggctgctcttcagcctggagtagctatccccagatgtgggacggaggtcaagggcaaagcacaaggactcaggctgtgtgtctgcctgtcctgtctggttgttcctggtctgttcttcctctgtccgcctgtccctctggtcagcctgtatgtggagcccctggccagcctgggtctgtgtctgtgatgggtcggtgcacacctgtcttggtgaactcacatctttctgccttgctcctgagtgcatgtgtgtgttcgcctccatttctctggccagcccgtgtatctgcctcctggcctcttcgggcttgtcttcttttcctgtgttctgagttcaggggtgtgggttccagatccctggctgttgcccagttagccccatgtcttcctatttctgactcaccagcagccctgaggtcttttccctggaagggaggagtcaggtgtgtgctgtgggttgggggaagactcctgcccatcctgcagtgttgaggcaggtactgggattctcctgaggaggatccttttaggtgaatcattctccccagcttttctggcctgctcaggtaggcgatgggcaaacgcttgggggcagcagctggcctggccctcctcccctagactgagaccgtagccaggcactgctcccactgtgggtgtggacaacctgactccctcccctccatacccagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtgtgagtgccatagggcaggggccgagtcccgcctcagttggggtctcagatgctcctaaagaccaagggagcagggctctgtggatgtttgtgcacatgcatgaacacgcatgccgtggtgtgcgggctcacggttgaggatggtttgtgtgtagctgcaaggacctgtttgcgagtctggctggctgtgtgtccacgggcaggtctgtgctccgggaccgtgtatgtgtaaccattcctgtttctgcacgtctggctgtgtgtgcttgcgtatgtgtgtgtgtgtgcatgctccaggatggctttcttccaggccgtgcttggttttggggtggggctcagaggcataggcagtcccttctgattgtgagtcttaggggaggggcttgaattctgaggggtgcttggctggacttatgtgtgtatgggggggtggaagggctggcacaaggatccaaaagccattgtctagttaagcctgggattcagagttggaagaaagaattgggacttctcagatcccagaggaaacggggtttccactttgggctcagctgaggcctgatggagggagggagggaaaggctggacagggagaccctcttgtgttgaatcatgggtgttgccatggtgaccggtgattgatgatgtcagagataaatgacgctgacagacgcctccttgtctgcgtggccgttgccatggagcctgagccttgggggatgggatgggggagggggctgcaggaccccctagccctttgtggggagggcagtggggagggggcacgggtgagatggttctgactgttgcacgaagagccccagacaggaatggaggggactggagtgtcctgccacaggaggctgggggtgccttgtcctgagcccaggaagtggctcctgctgcaagagtgggtgacaactcaagacccacaagcctggaacccttcgcttaagggctgtcacctcctcctctctgtttgtgccaccttctgctcttttcatggcagaaggaccagggaggggaccccttctccctcccaccgccaactccccttctccctcccaccgccaactccccctctcccggctgctctgtgccccggagctgagcagctgccatttcaatagaattaaagcttccgaatgataaacgtcttgtcacagctgcaattttctcttcccaaattatccccccactctccctctccctctcccttctctcccctgcactttattgaatttgcagaatcgacatgagtgatctccaaattatgccagctacccccacctcgctaccccctccctgagcccctcccccaccctcccttcctcccgcgtcagcagccaccaccaccagccctgtgagtgattgtgtgtctggataatcggctggtaacgaccccatcgcttctttaaagccgagtggtgtgtgcggctcagcgcccctggtgatttgtcagctccccagctaatgggccaagagattctccccgccaggtcccccactctcaggctggggagccctactccccacttgccccaggagctgctcagagccagtcccaagggacccccagggagactgcagctgggagggctgggtgagtggaggcgggagaaggaccttcctggggaaagaggaggcagagcacctaggagggcaccgtcgcctggagtgtgagctggagtagacgcgtgggggatagcatgcggctggctatggggtggggtggggggtgtgtgcagggccacagctgtgctcatggggcttctggggcagaacttgatgtgtgggttgggtgggcatggagggctggagtgcgtggcaatgccttgcctgcccgtgaacgcgtgctgtgtgcgcgtgcttacaagcctgggtgacctcctcagcagctggcagctctctgtcaggctgggggtggacgaggccctgagcagcctgcagctgccctcttaaccccctctgccctccacagctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacggtatggctttcccccggcctgcagggtgggatttgcccagggccacagggccaggatgggcccctctcaggcaccccttcttgtgccaggcaagatctctgcgtccttcccttcccctctcttctccctcctcctgctgcctcttcccaaggagctcccaggaagtgaaggctgggtagagggcaggcctgtgggggctggagccaggctgagaaggggtgccatggagaagaaggccctcactctccctcctcccccagaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctggtgagggtctgcaccctggcccccaggcactgcccctgtgtcctgggtagatgtccttccagccagacagccaccctcctaaatgtctgtctgcaatcaacctgtccaaatgcccaccgcccaaatgtctgcccttcctctccccatatgtccacctgtccactcgtctccctgtccactcagccacctagcagccagatgtgcaggagctcacctgttcacccatacacatatccagccacccagccatccatccatttagccagtaataaagattcacgtaggagccaggtgcagtggctcatacctgtaatcccagcactttgggaggccgagcgaggcaggaggatcacttgaggctggaagttcaagaccaccctgggcaacatagtgagaccttatttctgcaaaaaactaaaaagattcacctaggatcctctggccagtgttcgagctgggtgtcaggaacccagcggtgaatgcaccaccatcccctctcttgaaaaccttccatgtgaggcaagagataagtcaacagaggttgcaaaactgtgatcaatgcttcctggagattgggggagggcttgtgactgcttgggcctgaaggatgatgtctcagaggaggtgacatctaggggtttgtagagggggaggtgagagggtagccctaactcaggagcaggaagtgaaagacttgctgctgtgaggccatgctgagctcaggggactgccgggcactcggtgaggtgagcccgagggtagactgggctggaggctggatgcagggggtgggggcaggaagaggtggtgggaactgccaaagcctaggctggagggagcactctccttcctgctgtccctgacaagggctcggtccacctgttccctcttggtcacctccagggtggggaacctgggatttgacgagactgtcatttctttttatgtttttcttttttgagatggagtttcactcttgtcacccaggctggagtgcagtagtatgatcttggctcactgcagcctgcaactgctgcctcccgggttcaagcgattctcctgcctcagcctcctgagtagctgggattacaggcacccgccaccacacccggctaatttttgtatttttgtagagacggggtttcaccatgttggccaggccggtctcgaactcctgacctcaggtgatcctcccgcgtgagccggcagactgtcatttctccatgggcacctctgaatgttgaggcgggtgatgggtgggaggtttagattgtgctgcctgcaggggctcccatccccatgccgtggatgcaggaggtgccgtctgggttcctgcaaccacattcaagccaatacacatttactgagcgcttgttgtgtacctcatcctgggagctgtaggcagcagcccagtgttccttagctcctagaaattctaggtcccctctacattctttgcatgtaggcaggatgacctggacctgcactatccagtacagtagctgctcaccacatgtgactctttaaatttaaattaattaaaattaaactcaattcagttcctcagttgcattagccacatttcaagtactcagtagacgcatgtggctggtggctgaggtatggatggtgcagacgtagaacctttccatcattgtagaaaattctatcagacagcattgctccggccacctgccaggtggtcctccgggagtgctggtgcggagtgctggtgccgagtgctcagagtgggttcgggttcagtccctgaacccaagcatcctctgcacccagatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggaggtgggcagggggcctgggtctgggggctgggctgggacgggggtgcagccctggagtctcttccagggagctctttcaggccacctctgttaggtatctctagagggcagggtctggtctgcaactacacagcaagggggccatgtggggcctggactcctgttcccgatttctgggcaacaccccttctagggaggttaagagtgagggtttgagggtcggaccaaccagggtcacctcctggccgatgcatgaccctgagcaggttgctgaacttctctgggcctccgtttctgtacagtgggggcggtaacggtctctagctcatgaagttgatgggaggattacggtggtaacagatactgtgcaggtgcccagagcgagctccagtgcttgttagttgctattttattgttgtgatttctgccatttcatctggtttccagaataacaggggggagtgggagcctgcctgggaaccctctccctgcttgaggatggcactgcccatttggggtcccatcccactaactgggctcagggagggtttggggcaccccctcaccctcagctcccgttgctcccttttaagggcctctgtaccctgcggcagcagagaccccatgccctgccctgtgtggggaggcgcctgcgagctgccctcctccatggcctgggcaggcacgccccccggtggccgaggctgggggtgcagctgtgttcccagctgctcagggggtggttctgcttcctcagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggtgaggctcacagacctggaggggtaccggcccccgacacctggcccaggcccccacatccaagccagcaccccatgtctttgtgccaggacaatacgacacctgtccccatctgtgtctaggctgaggtcccctagtgactccactttgccgaggtggcccgcctgtgtcacctttgtgtggtagttcagatcgtggctctggaaccagacacgtgggtgtgtgtccttgtgtgggtcactcaacagctcctagctacagtttcccttccgagggcggggataacattcgtgtttacagaggggtcgggatgatccctagcacacagcacaggggaaggaagggcttggcgtctagcccaggccggcagtctggccctggagccggagttcgggaccactttgccccattgccaccagcctctggacctgggggcttaagagagctggctcgtgtcaaagaactgaatcccaagaaagatgctaatatcagcagtattgatcttcccacctcgagccaggcttgctggggctgggggtgggagggctggcccagcgtgctgacctctgccccctcctttcctgcaggggctgagcgggtgatcacgctgaagatggagatcccgggctccatgccgcctctcatccaggaaatgttggagaactcagagggcctggacactctgagcggacagcggggggtgggggggcgnnnnnnnnnnnnnnnnnnnnccccccgccggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctacacatgcctccagccttgctgcctccaccccctcctcttggcgtctggtctgggggcttgggatgggtttcgtcatgtgctctgggcctgtgatggccaggaatgagcactggggccaaggggctggccagggcacccttccaagctgccttctgaggcttaccttgtgctggggtctttggagatgctgagaaggagaaagtcctgccccttgggaagccctcagtctggggatccacactgcccatgtcaaggagccccagtctgggagtgggagagaagaggaggaaagctgcccccaccttcagggaacccccagtctgagggaggaagccggagccacccctagacatttctggtccttgggaagccttcaccatcacggcaggaatgacagatggcacaggagctggggtcagggactcatagaaacctaacaagaggcctggcgcagtggctcatgcctgtaattccagcactttgggaggctgaggtgggcggatcacttgaggtcaggagttcaaaaccagcctggccaacatggtgaaaccccgtctctactaaaaatacaaaaaagttagctgggcgtggtggcgggcgcctgtaatcccagctattagggaggctgaggcaagagaattgcttgaacctgggagctggagcttgcagtgagccgagatcgtgccattgcactccagcctgggcgacagagcaggactccgtctcaaataagaaagaaagaaagaaaaagaaagaaggaaggaaggaaagaaaggagaaaggaaagggaaaggacgaaagagaaagaaagggaaggaaagaaaggacagaaaggaaagaaagaaagaaagaaaagaaaaaagaaagaagaaagaaaggaaagaaagaaagaaaaagaagaaagaaacttaacaagaacacaggattgggatggaagctgtgggggcctagccgggagggagtaaggcaaagggttccttctgctagaggctgcctgccatttctacattaaccaccaggtggcggcagcgccttgcttgactcaccggccgccctaggctggaggcaaccgcggggaccgaggcgcttttcctccagtaaatattttctaacatctttacgagtctgaaatgaaatctaacatactgtacctgtacacgtgatttcacagatcaatatgttgtcacaaccgtattataaaggataaattgaggggcagtgctatgtgtttcaatagattaatgcttgcccctcttttgaatgaatacatttggatttaaaagaaggttggaagccattctgtacaagaagcccaggaacattaaagagcatgggtggatgttggaataaaaatcggcatgtttgatctataataaaacaatgcaaaaaaagcccaaacaaaacccttaatggttttttctttatcttttcttttcttttattttttgagacagagtcttgctgtgtcacccaggctggagggcagtggcgcaatctcggctcactgcaagctccgcctcccgggttcacgccattgccattctcctgcctcagcctccccagcagctgggactactggcacacgtcgccacacccggctaatttttgtatttttagtagagacggggtttcactgtgttggccaggatggtctcgatctcctgacctcatgatccgcccgcctcggcctcccaaagtgctgggattacaggcgtgagccaccgtgcctggcctcaaaacccttaatgttttacatgtaaaacagggtttgggcccagggttttcacttatgccaatgtccagttggacattctaaagttgtgcctgaggctgggcgcagtggcgcaagcctgtaatctcagaactttgggaggcagaggctgacggatcacttgagtccaggagttcaagaccagcctgggcaacatggtgaaaccctgcctctacaaaaaaaaatacaaaaattagcctagccttgtagtgtgcatctgtggtgtcag

SEQ ID NO: 14050 - DNA, 5819 bp, Human
gtgaaactctgtctcaaaaaaaaaaaaaaaaaaaattcagagacaaataatagcaatgtatgaaactgatttggatctcaattgaaactacacaagttatgagacaactagggaaatctgaacaatgtgattggatatgatgattttaagaaattttttaaaggtattttgctttttttttttttttgagatggagtcttgctctgtcgccccgactggagtgcactggtgcgatctcggctcactgcaacctctgcctcccgggttcaagcgattctcctgcctcagtctcccgagttgctgagactacaggcgcctaccgctacgcctggctaattttttgtattttagtagagacggggtttcactatgttgcccaggttggtctcaaactcctgagctctggcaatccgcccgcctcaccctcccaaagtgctaggatcacaggtgtgtgccatcgtgcccggcatattttgcttgtttttaaaatacttgagatgcatatcgaaatacttaataaatgacatgactggggtttgtttccgaatagttcagacagtgggagaggaacagcgtgcgggaggtatagatgcaacaagactgatctgagttgatagttactggagttgggttatggctacatggaggctttattgtcctgttctactactgtttttttttttttttccccatcgaaaacaaaaacctaaggccgggcatggtggcttaaacctgtaattccaacactttgggaggctgaggtgggagaacctactgagaccgggagttccaggctgcagtaagctgtgatcacaccactgcactctagccagggcacccgagtaagaccctgtttctaaaagggtctgttgccctggctggaatgcactagcatgatcacaactcactgcagccttgacctcccaggctcaggtgatcttcccacctcagcctccctcccgggtagctgggaccacaagcatgcaccactgtgcctggctaatattttttatttttgtagagatggagtctccctgtgttgcccaggctggtctcaaactcttggcctcaagcgatcctcccacctcagcctcacaaagtgctggggtttgtaggtgtaagccaccatgcctggcctaaaattaaaatctttcaaaaaaaaaaaaaaaacctggtcttttctcattgggcttatgagctcctgaagttccctcacctttgcattccccactgtatcttggtactattcaatttgataactgttagatcaaaatctaagaggaagaaaaaaagctcttttcagaggaattacttgtagctctggcatgttgggaaggctgaggctgggccagatttgtaacctcagcaacatcttccatctcacactacaccctgctactaaggaaccttagggagggacacaccttctgctcgagagagaggacttggctgacagcccacctgccctgttactaaacagatggagagacgctgacagtgagtaacctatgattgttctaaaggctctgataagtgacaagctaagctctattgtggcagcttgtcacttacgaagctcaggaatgccatgtacttgtcaggactggggctgcctgtcagacaggttttatattgggcaaggctgtgtatgaagccaggcctccagcctacatttatcatctctaattatcaatagtcgtttaaagactttctttccttttttttaagagacagtctcgctttgtcacccaggctggagttcagtggcatgatcatagctcaatgcagccttgaaactcagggctcaagcaatcctcttgcctcagcctccagagtaactaggactacaggcataagtcatgcccagcttctttgaagactttcgttctcagtgtgacattacggaggatgcacaggagcctccaggagggcataccagtgtgactactccccacccactcgccctccacaacacagacaagaagtccaagctcatagtaatgtaaaaccatttgtttaattctaaatcaaatcactttcacaacagtgaaaattagtgactggttaaggtgtgccactgtacatatcatcattttctgactggggtcaggacctggtcctagtccacaagggtggcaggaggagggtggaggctaagaacacagaaaacacacaaaagaaaggaaagctgccttggcagaaggatgaggtggtgagcttgccgagggatggtgggaagggggctccctgttggggccgagccaggagtcccaagtcagctctcctgccttacttagctcctggcagagggtgagtggggacctacgaggttcaaaatcaaatggcatttggccagcctggctttactaacaggttcccagagtgcctctgttggctgagctctcctgggctcactccatttcattgaagagtccaaatgattcattttcctacccacaacttttcattattcttctggaaacccatttctgttgagtccatctgacttaagtcctctctccctccactagttggggccactgcactgaggggggtcccaccaattctctctagagaagagacactccagaggcccctgcaactttgcggatttccagaaggtgataaaaagagcactcttgagtgggtgcccaggaatgtttaaaatctatcaggcacactataaagctggtggtttcttcctaccaagtggattcggcatatgaaccacctactcaatactttatattttgtctgtttaaacactgaactctggtgttgacaggtacaaaggagaagagatggggactatgaagaggggagggcttccctcatcttcctcaagatctttgtttccacaaactatgcagtcataattgagaaaaagcaatagatggggcttcctaccatttgttggttattgctggggttagccaggagcagtgtggatggcaaagtaggagagaggcccagaggaaagcccatctccctccagctttggggtctccagaaagaggctggatttctgggatgaagcctagaaggcagagcaagaactgttccaccaggtgaacagtcctacctgcttggtaccatagtccctcaataagattcagaggaagaagcttatgaaactgaaaatcaaatcaaggtattgggaagaataatttcccctcgattccacaggagggaagaccacacaatatcattgtgctggggctccccaggccctgccacctggctttacaaatcatcaggggttgcctgcttggcagtcacatgcttccctggttttagcacacataaaaggagttttcagggaactctatcaagccataccaaaatcagggtcacatgtgggtttcccctttccttgcctcttcataaaagacaacttggcttctgaggatggtggtcttctgcatgcagttgggctgacctgacaaagcccccagtttcctgtggcaggttctgggagaggatgcattcaagcttctgcagcctaggggacagggctgcttgttcagttattactgcctcggagctccaaatcccaccaaagtcctgactccaggtctttcctaatgcacagtagtcagtctcagcttcggcagtattctcggctgtatgttctctggcagagagaggcagatgaacatagttttagggagaaagctgatgggaaacctgtgagttaagccacatgtctcaccaggaataatttatgccaggaaaccaggaagtcattcaagttgttctctgaggccaaagacactgagcacagcccagagccaataaaagatctttgagtctctggtgaattcacgaagtgaccccagctttagctactgcaattatgatttttatgggacagcaatttcttgcatctctacagaggaagaagagggggagtgggaggggaaggaaagagaacagagcggcactgggatttgaaaggggaacctctctatctgaggagcccccactggcttcagaagcaacttaccaaggggtatttaaagacatgaaaatttccagaaataccatttggtgcatccctttgtttctgtaatattaaactcaggtgaaattatactctgacagtttctctctttctgcctcttccctctgcagagtcaggacctgcagaactggctgaaacaagatttcatggtgtcacccatgagagatgactcaatgccaaggcctgaagttatagagtgtttacagcggtggcgatattcaggggtcatcgccaactggtctcgagttccaaagctctgatgaagaaacaagactccttgatgtgttactgatcccactgattccaggagtcaagattagccaggaagccaaacaccaggagttggggtggcacgtcaccagtccagagccctgccacggatgtaggcaggagcccagcattaggcaatcaggagccagaacatgatcaccagggccacaaataggaagaggcgtgacaggaactgctcgtccacatactggggtgtcccagggacagctggagagacagaaaggagaaaacaggctattagaacactgcagctatgcacactgcccactcaggccagaagttgacagcatcaatctttatctctttacaacatcagaatcctacacacaaaaagatttcttttttttttttttgaaatgtagtctcgctctgttgcccaggctagagtgcagtggcacgatctcagctcactgcaacctccgcttcccaggttcaagcgattctcctgcctcagcctcctaagtagctgggattacaggtgtgcgccaccaagcctggctaatttttgtatttttagtagagacggggtttcaccatgttggtcaggctggtctcgaactcctgaccttgtgatccgcctgcctcagcctccaaaagtgctgggattacaggcatgagccaccatgcctggcctttttttttttttttctttttgaggtggagttttgctcttgttgcccaggctggagtgcaatggcacgatctcggctcactgcaacctccacctcctaggttcaagcgattctgctgcctcagcctcctgagtagctgggattacaggcacgcaccaccacacccggctaattttttttttgtatttttagtaggaacagggtttcaccatgttagccaggctggtctcaaactcctgacctcagatgatccgcccacctcagcctcccaaagcgttggcattacaggcatgagccatcgcgcccagccaaaaaaaatttctaaaccccaaataatatcaggcaaaatgaaactatgtggaacaataacaataaggacaagacacggtccaatttatcataaaaggtttggcctgcacatgcaaataaaccaggtgattaacaggaaactcttgcaggaaataatgaaagcaagcctactatttgttaagtatcttctatctgctaagtgttttgtacatgttattatttggtggatattattatttccattttgagtaggaagcagctgaaacataggtttgaggtgacctgttcaagattgaaaggctcagaaattagtggcagagctctgcagcctctccacacactgcctctcaagggccccacagggattgccttccttttccagaagagaactaggatccagacaggcaaaatgacttgtttttcaaggtagaggcagaactggggtgagaacctaagtctccactcctctctgctttaggaaaagctaccatttagagctccctgtcctgactttgggggaaggaggataaaagaatctgtgtccaggatgggcaaattgtacc

SEQ ID NO: 14051 - DNA, 38969 bp, Human
tatttctagcactgtcatcgaagattaatttttttctgactcaaatattagaagctagaagctttttctatgactttatgtatttcctccactcatagtagctttgaagttgaattttcagtggaatggaacctttgaagtagaattttgaacagaatctggactgatatggggctggtcaaacggcacctcaataattatgaattaaaatatataacattttttaaagacattcaaagaacaaccaggtgttgagcaaattctaagtgcctgagccagctcccactagctcacaagagctaactgtttacacctcttatcaaatccacattctgaagcctcatatcagtgacctgacatcagccatgcgtggagtatttacaccacagaaatgggaaactctacaaatcagtcctttgatttcctccagagaggcagttaaaatgcaccagcactctgcttcctatgaataagttgaccatatatcacagcagtattgattgatgccagttgtacttctgacccatgattttcacttttgtccccacccttttctctgtcaaaagtgacagattcaacaatcactatagatatcaaggaaaataatataatggagatttttcactgcaagaaatgaagactgggttagaaggtaaagaagcaactacaaaatgtttatctttatgtgaagaacaggctcctggaagtagtacgagacttgttttgcagagcttcaggggacagcatgaggacaggaagatcttgtgaaagctatagggagacacatttttatctgagtttaaggaaggacttcctcatgggtaatgtcgagtcatcataaaataggaatagaatgcatttaggggtgaatgaggtcttagtccacgaaaacagtcaagtagagacggacagccatcttgaggggtgttgtggaggagctggggcaataaatgcttgggtgttaatgcctttctcatgattcatattgtgggttgaatctttctcatggcatttcttcactcagtcattttggcaatcctcagagggtctttgcctggtgctatgtgtgtttgggagtagatacaaggagaagaaaaaaataattcgctcaaattcacacaaaaaagtgacccaaaccaaaatccttattaagcctcactgttaagttttaaaatgatatgatgatcactaatttgagaggaactacatgttagccaacccatcactgatttatttgtgatttcagattttgaaatctattaggataatcaatttcacttcagcacggtttggtcaaagaaaggaaaatacatcagagggattcaaataactttagaatcataagtagtgtgagagatctacaggaggaaagtccgtttagcagtgagaacttcagacacttcctctatatcctatggtaaccaggcagttagaataacaggaagccctcaggccggcaaaaatggcacctgtgaagtttgtttgggtctatctgaaggcaggatttcagcaggggctgaggctgtacagaacaacttaaaattttcagttggataagaaaaatcggtaaaacttaaaaattgtattcatttcctaatgcctacgtggtattacatataagtcagacaattgttttctctatttcaaattactggattagtttgattattatacggactatcagaagaatagtggtacagcttttctccaagatcaacgcctttcatttgtggatcttccatcttacctgatacttctctgcccgtgtcttcagtactggaatttactccagtacttcttattttctgtttgtcttttcaccacccgaaaaacattactctcactcaccaaactatgtacacctttctttatattctcccaatcagacttaacaaacacttagatgacatttatttttgcctggtactgttttaagtgctttacaaatatgaattcatttacttctgctaagagctaatatatttctattatcttccttttacagaatgggggattgaggcacagagtgttaaaatagtgagacacaggattctaactggcagactggcactttatctcaattcttaactgctgtgttgcctctcactttaaaggtaagaaattaaaccaattttaacatgattctccgaaaaaccaatacttgcactccttcctccatgaaaatgtgctttatccctacgcatttttccagaagtccagctttctacttatacgtttatattttcataaactttgctacagagcaaattcggtgttacaaacattgcttccttttgttcacattttacacgtttactgcctccttaaatcattcaccttcactgtattttaggaaagaaatgctatttatatattttgtgaatccatagtctattatacattctgctaactaagaataaaacttgtctacttggttatttgagtctagagaatgattttcaacctggagtgactttgctcaccaagggacatctggcaatgtctggtcacatttttggatgtctctactggggtttggggtcatactggcatctagtgggaagagtttagggatgctgttaaactaaatgccataaccacaggtcatcttcccacaacaaagaattttctggccctaaatattgaggttgagaaacccagatctaggatattctgtgcatttaaaatgattccgttcagaacaatttaggtactttctcaatagtactgcaaaagctatatgaaaactatatgtatataaaaattatatctatctgtctctagctacattaacatatcaatctgctaggttaagtagactcaatttaaccatctggtgtttcatgtttgcttttgatttgtaaaagactcagacctataacatagccttaatgctaatatcattcttgagataaacgattataattgcagatttctttttttttttgagaaagagtctcgctctgtcacccaggctggagtgcagtggcaccatctcagctcactgcaaactccgcctcccaggttcaaacaattctcctgcctcagcttcccgagtagctgggattacaggtgcccgctaccaatacttgcagatttctttagtgttatgttatttagccactcatccatttttttaaagaattaagcattcactgtacaccaagcaatgttcttagtgaacaagtaatttagaattagattacaattaaattgtggattttaggacattttagttaacgtttactgaaaagtattatcacagaatttatattttctatagtttatgttgttttatatgattataaaagcaatgatttaagaattaagtgaagtattttacatgatgtggaaaaaatgagagaaaaagatggaaaagagttgattgaattattcattttcacctgattagttgaagccagtggttagtaacatcacatgcacaaaggacccagtggctgattcaaaatagtattccattctctccccatgattttacaatgaaactacgagaccaatcaggacaccttcttctttcttcttgttcaccaaaagtacttttttttttttttttttttttttttttttgagatggagtctctctctgttgcccaggctggagtgcggtggcacaatcttagttcactacaacctctgcctccccggttcaagcaattcttctgtctcagcctcccgagtagctgggactacaggcatgcgccaccacgcctggctaatttttgtatctttagtagagacggggtttcaccatattggccaggctggtctccaactcctgacctcgtgatctgcccgcctcagcctcccaaagagctaggattacaggcgtgagccaccgctacctgcacaagtagttatttttaatagcaatgacacacaagagtaattgcaggacatttacttaactaaaaaaatcagttggcaaaatcttatgtgaaaaattaaaacaaaacaaataaccatttccctgaaaaattaaccccacttggacctccacatcctttcccatccatcaccacatttttctaccccatttgacagcggaactctctgtaggctttctgcatgctttcaacacttcctgtcaccgtttttactcgtccctagtcaaatcaggcatttatctccaaaactctgttgtgacatctttcatcaaggtcaccagtgacatcacactgctaaatccaatggtcaattcttgtccttatcctgactgattgttagtatctaacacacatgatcactgactttttctttttcctttccttttttttgagacagggtctcactctgccgctctggctggagggcagtggcataaccagggctcactgtagccttgacctcctgggctcaagtgatcctgccaccttaggcactcaagtagctgggactacatgtgtgcaccatcatccagcttatgtatattatatatatatatttaatatatatatttatatgtgtatataatatatataatttatttaatatatatttatgtgtatataaatatatatgtgtatatatatttttgtgtatatatatgtgtattatatatttatgtgtatatatatatttatgtgtatatgtgtatataatatgcatatatgtgtgtgtgtatatatatatatatatatatatatacacacacatatatatatatttttttgtcaagacagcgtctcactattttgcccaggctggtcacgaactcctgggctcaagcaatcctctcgccttagtctcccaaagtgctaggattacaggggtgagacactatgcccgatcacactgccttttgcttgtaacactttctttacttcgtatcacatgtcacaatttttcctcctacttcaagcaattctttttctcagtcttcttagttatagcctcctcattttcccagacttaaattaggctgtcccaggccttcgtcattggaatccttctcctttctaactactctgactcttgtattgtttcatccatgttcatggttgcaattactctatgtacactgataacttccaatcttatatttccattctgaaattctcccctgagctccagactaatatattgtctccttgacatgttcatttggctgtcagaaagcatatcaaattttgcacaataaaacaccaattattgatttcctcactccaaaactccttttctaccagctccattatctgagtaaacagcacaagtatttactgtgctatttattgggtaatggttcatttttattttattatctttttttttttttttttgagacaggatttcattctgtcacctgggctggagttcagtggtgtcatcctagcaaacttgcagcctcgatctcctgggttcaagtgatcctcccacctcagcatcccaggcgatcctcctacctcagcatcccagatagctgggactacaggcacatgctactgtgcccagctaatttattttttatttttagtagagatgaggtttcactacattgcccaggttggtcttaaacttctgagctgaaaccatcctcctgcctcagcccctcaaagtgctggaattacaggaatgagccactgcacctggcaagtaatgcttctttacaagaaacttgctccctctctaatctgaaatttagaggaagcaaatgaacaaacagcaaaacaagaccagcatgttgaaagaacatctaaactttgtccttggagtcactactgaggtggctgatagtctttctgggggcatacgcttccttgaaacccaaatgaaatgatgttgggcaagatgctgtttgccataggtatagggttacatagtcagacaaagtgtgcatttgcatagaaaaatctttgctgtcacaatcacagagcacctacacttaagaagaacacacttggaagaggttgtacaagacctagaggtgtcagtaagagaaaatgcagccttccaggacaataagaaatttaggggtaatgtgtggccacttttgtgatatggaaagatttttattattatataagcttccagaggtttgatcagaaaacaaagatgtaaataggcatggaagaaggctattcttggttcttgttttctgtccgccaccattggcaagactatctactatgcgtaggcatgggaaccagttaaagaaagtgtcgattcactagagcgaagctgagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaaggtaagatcgtgttgtggattaaaagtgttccaagcttgaactaattgcttgtcggctcttttaagctcatcctttttgcatgtatccccgctaatatgcatctttatgatgctttttttggctcagcagtcatgctttatggaggcatgctctatggctgggaataggttttctttctctcatatatctctggggaatgctgagccaaacagattaaaaatgtcagtgccatttgcagatccattaagggaagtaacattcagagacagagggagactaaaaggatgatgacttagccagctgacataacttactgacgtggagcaacgtggaagaggtgaatctttcatttcctgtggaaaacagtcattcataaaaccatcttttttgtatgtctttgtcactcttccactgttgcaaagtgacagcaaagtagcatcgcaaatttgaaactgtgtaataaaatacgttgacatcaatttggaattacatcttcacaactaaaaatatagacagaaatgccgtaaagactctttagaaaaacaactgctaaaaggtaacttcaataaataataagcccttcaagcattgaaatctgactaagtataaaagcacggggctttcgaacttttaatgtttttcttctgctcattgctttctttcaatttgtaatctggactgttgctatggagtaaataacacctactacattccatgccttcaggtttccatttcactagaagaagtggcacaagttgaaggaaggcagcttatccatgtgaaaattctaagacagtatagatgcctggccatgggtttagccataaatgacttacttatgaaacatgttaagcttttctgtttaaaatccctcccctgccttttaaaaaatttcccatgaatcttgaaataatcctgagaattcagatggagtgcgggtattttttctaattgttgctcagaaaatccttgatccagtctgagtgttttgttatcattgagccatatgcagaattacaaaatgaaaatgaaaacaggtcagctaaaattaagaagtcaatgcaaggagtaaaggcacagataataccaaaacatgagtcaggatgatctgtcttgttggcctgacaaatatggctcaaaattattttttttaaaaaagattagaagttctgaaagtctacaatctgcaaggtagagaccaaattggctacgcattggcagtgtgaccttcccccaaattactaagcttctctctgcctccttttcaaaagcctttactagtatctatatcttagatattatttaatttcatttgataattgtgtacctgacacacaaggagcacagagtaaatggagacaattattgttagctccattttagagaggagagaaactgatagagagagtgatagggggttaatagctaagctctcagtaatataccaagtggtgcaattccaaagatacatgttttgctctcaagttaagaaaacacaagccaattgcaattttgtgatgaggaagatgggatacagttgcaatatcaaagctgcctctgacaactaataccagccctgacctgcttctgccatggttttctgacctgcaatatttaatcttcagctttcagacatccacattccaccctggaccttgcctgtctggtaagcccaatctctgcaggtcagccatgcagctgaggtgagggaaggtatgttgggatgggctggcatgaggagtcatgggggtcgagaagaaagttatggcaagagacattcttttgtgcgtgcatagtttaacagagacgaataatgttcattttgatctttattaagaggtggcctcttaataggccacccccttaataggcctcagaatatctgctttaaagtggctttttcctgatggtttcttctaccattgttacagtagctgcctcaaatcagccaaagcagaagttcctattttgcttgagagcttaggcttcaggcaaaaactactgacatttatgagatacctagtattttacaatgctatctggttaaattcttataattgtccttttaaaaagacagagaacacagaggtaaaataactgctctgagttcacataggcaaatgttggagacgagattcaaacagaaactagactgactcaaaaatcaaatctaagtgatgaaagtaaaggtactgttttgtttgcatcacttaataattcatctggaatcacaagtcatgataagaacctaataagccatatcatcaaaacctgagcttgggtcaccttcaagatgcaacacacccaacatcacagtagattcaggggcaccctgaaacacaagagtaagaaacagaaacatctatccttagagactacccttgtagccattctgctgagttgtatttttttttcattgttgcttagaagatccttgatccagtctgagtgttttgttttctttgagccctatgcagaattacagaatgaaaatgaaaacaggtcagctaaaattaagaagtcaatgcaatgagcaaaggcacagacagtaccaaaacatgggtcaggatgatctgtcctgttggcatgacaaatatggctcacaatttttttaaaaaaaaaattagaagactcaagtcttttgactttactgagaagatgaagtctgacactgtttatttccaatcttcttggaaagactttcaccactgtttatctcataaaattggagtgctatttaccagttaataagaaaatggcataacataaaacctttaaatactaatgttaaaagagaacttcagagttttctagttcaaccacctagcaaactcatgaagctcttccttaaattcttcaagttgattatccaaattcagagttaacactcagtagattgcttctgttgtaaggtactaacaataaaaacattcttcatgatacagacattaaatctacatccctgtaaaattcataagcagattctagccccgccctttgtagcaccatagagcagggcccctgtctctactgcatgaatacagagtattcgtaactgcattcaagggtgtgaaccaattgcagccagggccatgttttgactatctcagcatacctagatcacagtacagggaacatagctggtgttcaataaaagctttgaatatgcgagtatatatcacctttaatagtttcttctctgttttttctttttcctgatttcagacatccacattccaccctgggccttgcccgtctggtgagcccaatctctgctggtcagtcacgcagttgaggtcagggaaggtatgttgggatgggctgacatgaggggtaatgagggtcaagatgaaagttaaggctagggacattcttttgtgtgtgcatagtttaaaagacaaatcagtcattttgcatgttgatatctataaatgaccacatcaacatatctgctttaaagtggccgtgtcccagtggcttcttctaccactgtcacttttgaaggagggtcctgttccactccttcatcactatagtgacctctattaaacaaaagaggtaccaggaatcaaacattacatttcagatgtgaaatatctcccaataaaccagcattcactacttccactgggaattctctgtggctagaaaactatttttgttgaatctttgccttgattttctgggaaagatatatttttaaccccattcaccttcctccctccctttctccttgcccgtttttgctagccctctgagcttgacattgataactgtttagtataatcagttgcctaaatttccctgcttgtgagtttctccaatccctagagctgagggcatttgattccacacgcacgtccttctgctctgggccgtgggatgggtcattcctagaactcctaagtgagtggctctaaaactcatctcaggtgacttagcgagcatttcttgcagtgagttctgctctgaacctgtgctccagtcctagtgactgagtgttgtcttttcctgagttcaggtccaaatagccaccatcactctgattccatgtccaacagttccttttattattaaggcttaaaactttagtaataaaatgagataaatttctcatggctttttttccccaacatgtattatcctgtgaccctgaataaatatcccaaactagttaagattcaattctttatctttaaaaaggggataatattgatcccttgttctcagggtaactgggagaattaaacatatttcatgggcataaaatgcctggcatgtaagaagtgtttctctctggctgataattgttatctgattatcctctctcagtttggaggtcctaaaccccagctccatatctggatctgttacttttttttgccatacctatttgatgcagacttcttagctacataaatatctacatactgcctattatcccttttcctaacttccccaacactgggttttcccctctttctcttccccctgttctctcactgggggcctgttaagctgattaaataagccctgcccctctttactccctgttccagcagctcaactgaatttccgtcctttcacagtcatagctggatgcgtcccaagaacagaaaatgccacactccagtgggcaatcctaaactcttggctttcgaccttagaagtctggccactacattgcctttgaatccacatgtgtcagatctaataatacttagttgaagatttactatcttctccctaaataactgctccctgccactgggatgatcctctcagctcccagccccacaatctgctagcatggagctgtgaaagctgtattccatcagcaaggatctcccaaggctaaaagacccagaaacctggccatctgcacctacaatgtcaggagatataccctcttcaaaggggaaggcactgcttctacttaaacagttctccattgtgatgacaatacatactttaatcctgtaaagtttctccagacacgaagatggaaatgtgcttttctgcttcccagtctcaggcattcttttatctctaatttgacatgacaaacagactctccatcgtcacctgttatggtgtgaatgtctcttcatttcattaatgcagggctgccactgacataaagggtttttttgttttgggtcactcttctgtacccctatccttcccatatctaataatcaccattattatattaaaaggcaaatgttctgatcacagcttgatagtgtccttgaagtgaacaggacgattttctgtctacccagtgaaaacagcctttggtccttcacagtgatttcacagacaacctagagcctacgaggagactggaatgttgatctctctcaggtcaggaaccagacttacacacctacacacttcgtgcgcgcacacacacacacacacacacacaaactcatttccggcatccagtctttataatgagagctagttcttcagtaagagtccagcttctggctgcagaaggaattaatgccaagataatcctgtgtactttggatccacgcagtaggaagcttcatgcttgctgctttcctcaggatgccctgtgacatcacccacactggattgtttttccttttgtgttaaaacactttggcttcattccaaagggtgtctgaagacaacaagccttccctccagtctacccactggccacgtaatcccacaactggaaacattcttctgcatgaaaaggcatcactcaattagctctcactcagagcacccctcccatgtctcagcttcctttgacctctttccttgccgatgttttagattcttaatggtttggtctggtggaggtctgctacagtcacttgatacttgtacttgtgtcccccagtgtgtatatcaagggctgatattataaggagagtgagtagatgcatctcaggaaaaattaaaaatcacttcagatgctgaaatagttcactacaaccctggtgtctggagttgcagggaataggatataatctcctcaattctagaaaacatggttcaagctgtatacaaaagatatacacatctgagggtatgagtgtgacattaaccattatgcaccactcacaccagttacagagatctgggttgcaatgctagtttttttgcttagcttgttaatttgcaaaacacaaaagatataatttgcaaaacacaaaagatataatacaacctgcttttcaagatggctattaggattatgggagagtgacacagcactgagccccaaaaagaggagatggagctgggctaaggggaacgtgtcactaaaagcagaagtggggagcacacagaaaaaccttgattagcatcatagattgtctgcgggctggaccttcaaagttgtaccacgctgaatacttggttgcactattagacttcctggccattactgcttggatagctgagattttgattagtgctgttctattaaactggtagtaaaatatctttggggaaaggaatggggtacatatgctcgcagacaggcaaggtcactgatatggtttggctgtgtccccacccaaatctcatcttcagttgtagctcccataattcccatgtgtgtgggagggaccagatgggagataattgaatcatggggtagtttcccccatactgttcccatggtagtaagtctcacgagagctgatggttttataaggggaaaccccttttgcttggctctcattctctcttgctgctgccaagtaagaagtgcctttagccttccaccatgattatgagacctccccagccacgtggaactgtgagcccattaaacctctttttctgtatataaattacccagtctcaggtatgtctttatcagcagtgtgaaaactaactaatacggtcaccaatctcaatgtgttgctttcatacaaagaacattctttgattcaaatgagaagaatatacatcagagtggtcctgctcaggagaggaagtggagaccccctttgcttgatggcacagcatagatgatgtgttgccacactcaggtgcccctgggaccaagaacccgagaaccaagtatgagtcctggagggctaggggttgatgggcagggccttgcactccttttggttttcacaaggttttagcgacatttggccaaatatgaataacaggacaaatattccttcagcctattatgtcttctctcgtaaatgtttctggataagggagctggcatgggcatattcacaagttgttgacaatctgtctttgaggactggtttctaattttttttttttttaatgagggcatccagtctatgtttctaggggaaaattacatgagatttgggagttcaaatgccaatgatgtttataattctcagctaaaatgccagtatttctttcccttgtcttgaactctatgaatgaaaaaaaaaaatagtgttggtttatagtataatccttccagttatgttttaaagttctgcagtactcccaaacccatcagttgaatgatcttttcataaatattatctatcatttatgtgtacaaaatggcattttgattaagttaaagcaaaaggtaattttattaccagagaaaatattcatctcatccctgtccccttctctaatcaacctcaaataaaacaagaccatgtggtctacagttaaaattgttataaataatatttaattaaatcagtatctaaaattattgatttttaaatacatattggaaatctttctccatgtagccataccatacacattcttggctaagaaataattttgttctggatgcaggaaacctacttgttcaatgcaagcaccactcaaattttcataggcagattatctgccggatgaattagcccaaggaattaaaattaaaattcctaaacttccttctgctcaacaacccagaatgttttccttggttacatctttctcatctgatagcttgatttcaagggaacaaaaaatcagttttaatggggcattcttttcaaagcaaataatttattccaagtcaaatgcaaattgatttctcactattttccttttatggcttatctatggcaccaacttccttcattcgcctagaaaatcaagaagtaaccacccaagccaaataccagggaagcatctttgttccttaaatgctgggaaaagtcttaaccctagtcacctttcttttggatctagcagcgtctttctcactttgatattattccaccatagaagtctatattctcaaagagctgtactgacagcagggctgtggtttacttggcaagactgaacttctcaagggcagtgatactgctcataattcttaatcatagtcttcacaatacttcagatatagttgaatgttgattgaatttaaaaatacacaaagatgtgtccatagttttttccagtcccttactgtcattggtgtatttggctgaatggtacagaaactcttcccgtgaaggtttaaacaccttaccatcatggtttcagggaaaagtgctcccatcttccccaaactcagttcttagttgcccatcaacatgaatattccagactgagaaatactgggaaagtatcacttttctttttaaggaaaatattactaacttgggttgccgctgtgtgtgtagacattcatagataataaaattccaaccttccaaatcaggacaggatgattcgttattcttctatagcactatcatggagataaaaagtgtgattggaagagaaagtattaaaaaaaacatggaaattcaagattctatcaaatacactaactcctgtcagctctctaaatcttctattatctgtagtaagtggtaatgcttccctgctaagaggccttgagaaggcacacactaatagaaagttaatctcatgtgacaagcaacatatagcttaaggtattgtctcaagatgctatctatctggatcttcctaggaagatcttttgtcttatattttaaggccttcttaatttatctatatccacagggaaaatgggaattgagacatcagccaataacacttactttattttcctttccaataaagatgtcctgaattttcattgcaacagcttaaaacagaaacccaatcacttaaaggtcaaagaagttgtagacactatccagggagtttctggtctacgagtaaatcacatctgtgagttcagtgattcccagcagattgaatagactaataaatagactctctgtaaattgccaaagaggacagtttgcaggcagtactcacaaatgggaaaatagcaacagagagacaggagttggatttctgttggcataccgtaaatgccaaattttgagaaggtcaaaagtcatgacacatatgccttccacaaattacatttgttttgaaatgcacagttaggttcaaccaaagcagctcccatacaaaactacatgggagctactaaagattagtcataggtaacctggcattcagaaacaccatggagagtgttatcattctgttgagaaacacaaagcaggtaactagtacaaaatgacttctattcttagcaatacttgtagttcctctgggcagttctatcatgtctccttgaaggtaatgaaggtcaaggcaattagatgctaaaacagaattctgaaacaagtctgggaaattgccaattttataattaatggcgggggaaaaaaatgccagttaactctctccccatttgggtctacacttgaaagatgatattaatctacataagataattccactttccattcgttatttggtttggctaagactgtagtcatagctacatgcactgtgattaaaaactaaacaataccacctagtatgaaaggaggtttagaaacacagcttctttttatcctcatagcaatccactgatgtgcattttcagatgggcaaacagaggctcaaagacgtcgattagttggtgcaaacgtgcacagtcttactagcaatcaagcaggtacttaaacttaaatccttatgtatcagaatctaggtctcaatttttgaaacttaaggtctcaatcttcaaaatgcataagaatcaattgaggaccaatcaaatcaggattggggtgaaactcaagaatctacaagtgcaagatgttctcttagaatctgaaagaaaatagttgactacactttaaaaaacaccactatactatactgcttgtagggatatctacatgaggtgttggaggttatgaatatgtagcttgaggttatgcctaaatagctggggacagctatttaggcaaacctgcatcatgaatacataattgccctcctcagaactcattcatttaaaggaccatttacttgagttttgtacatctagcaatagagacctcaaagtaggaaagttgcagaatagcacaatttttaacattttctttccaaagttattgaaaatattaagataaaagaaagattgttaaaacagacattgttacacaagccaagaaataaaggtattaacagtttaatatggtttggaatgggaaagagacaaaaggaggcaccaaaaaggggaaatgcatttggtgcccatttaatgctaactctgcttcatccctgatttgttacccactgttttcatgatttctccaattgctctccagtggccaaatgtgatctgactccctcttctccctcccacctccttgttttaaatgagatctggttttacttagatgaattaaatgtcactatatttgtttttgtaaattgttccagcaaaaattacagcatcgatggctgactttaaatgtctgtacgactgtcctgccttgctgggctatttatagctgccttttaaaaagtctaataaatgcttttagattgctattgatttgtttcccctttacaaagcctcagaattaatattcttcaaagtattaactgaaaacaccttttttctttctgcaaaagtcatgcatgtttactgttaaattttagagaatataagtatgtgaatagaagaaaaaagggaaaactaatcacatcaaaattaacattttgttgtatatgattctgttttttctccatttttaaatatatttaaacttaaaaaattttattgtatgagagtttttatagccctgtttttactttcatttaaaaggcccacatttttttcccgtcactcttctactccattacttttaatggctatagagtaatcatatgattgtaccattacctatgaaatcaacctctcatttataaaatagctaattcacatccagattttgtcactacaaatagccctccaatgtagtcgtgtctttgtattcatccgtaataatttctttagaaaaaaattgctgagaacggaattgctgcattggaggttgtaccagattcatagactattgtcacacatagctagcttacctccagaaatagttcaaattaaatgtatacatttgaatatatctttaaagtgacaatataataacacattaatattgggggagtcacatttctagtaattcaattatagccttaacaaatttaattaaacacttttacacaaacagacacttttcaaaagaagacatacaagcagtcaacaaacatgaaaaaatgctcactatcactaagcatcagagaaacgcaaatctaaaccacaatgagataccatctcacaccagtgagaatagccattattaataactttaaaaacaacagatgttagcgaggctgcggagaaaagggagtgcttatacagtgttggtgggaatgtaaattagttcagccaccgtggaaagcagtttggagatttctcaaagaacttaaaacagaactactattcaaaccaacaatcctgttactgggtatatattcaaaagaaaacaaatcattcaccaaaagtctcatgcactcacatgttgataaaggcaccattcacaatagcaaaggcatagaatcaacctaagtgcccatcaatggtggactggataaagaaaatgtggtcaatatacactatggaatactacacagccataaaaaagaacaaaataatgtcctttgcagcaacatttacgtagctgaaggccattatcctaagtgaattaacacaggagcagaaaaccaaatactgcatgttctcacttaaaagtggaagctaaacattggatactcatgaacataaacatggcaacaacagacaccgaggactactagaagggagagcgggcagggcttcaaggtttggaaaactaacctcagcatcacaccaaacctcagcatcacacaatatacctgaaccaaacctcagcatcacacaatatacctgaataacaaacttcgacatggaccccagaatttaaaagctgaaaaaataataataatataaaatttcatactgaactccgttatcagtcctgaggaagacgataacataaaaacaagtagtatcacctttgtgttttctgtttataagctggtatctgcaacagggagatgtaggataaatgggtgtttggagaactgtcaacactgatgtttttatagtcttaggagtactaactctcttatgagtgatgaaatttccttgaggataaatatcatctttgtattattcaattatttattcatctatttcttcaaaatataattagtaagtgcctatatatcacatattgctttagctgttagggatacagtggtaaataagacaagcatggccctcgtggagcttacaatttatttcacagaacaatctaatcaacaaaaaagttaatcagtagcagaaacatccttgggctttagagcagggtgtggcaaactcttctgtaaagactcaaagaaactaggataatatttaaggtagtaaatattttaagctttgtggaccacatggcctctgatgcagctactcaactttgtaagtttgtgtgatgtaggggagggaagactttccctctagcctcaagttcagtaattcagtagaacttatgattgttcagaacttgagtctataaaataagctgacaagaggcagattttatcagtccattcttacattgctataaatatctgagactgggtaatttaaaacctaggtgatttaaacctgttttaaagaaaacaataacacagggacacagagaggggaacatcacacactggggcctgtcgggggttcgggggctagggaagggatagcattaggagaaatacctaatgtagattacgggttcatgggtgcagcaaaccaccatggcacatatatacctatgtaacaaacctgcatgttctgcacatgtatccaagaacttaatgtatcatttaaaaaaagaaaaataaataaataaacaaataaatgctgaaaaaaaagaaaagatgtttaattgggtcatagttctgcaggttctccaggaagcataatgccagcacctgcttctggggaggcctcaggaaacttacaaaatggtggaaagtgaagggggagcaggcacatcacatggtgaaagcaggagcaagtgagagagagaattgaggagggaggtgccaccatttttaaatgactagatctcataaaaactcacaatcgtaaagacagcaccaagccatgagagatgcgcccccatgatcaaaacacaaaacacctcccaccaggtccccctccagcactggggaatacatttcaacatgagatttgggtggggacaaatacccaaactatattattctgccctggaccaccccaaattttatgtccttctcccattgcaaaatacaatcattccttcccccaaattcccaaaagtcttaacttattctagcattaactcaaaagtctgaagtcttatctgagacaaggcaaatcccttccacctatgacaggttagttacttccaagatacaataggggcattgtacaaacaggcgttggataaacattcccattccaaaaggaagaaattagtcaaaataaaagctctacaggccccacacaagtttaaaacttagcagggcagtcataaaatcttaatgctccaaaataatctcctttgactccatggcccacatccagagcacgctggtgcaaggggttaggttcacaaggccttgggcagttccacgtctgtggctttacagggtttagtccctgagactgctgtcacaggttgttgaatgcatgtagcttttccatgtgcaaggtagaagttgctggtggatctactcttctggtgtctggaggatggtgaccctttgtcacatctccactaggcagtgccccagtggggactgtgtaggtgggctcccacccatgtttcccctctgcccttccctagtagaggttctctgtggaggctccacccctgcagcaggcttctgtctgggcacccaagctttcccatacagcctctgaaatcaagtaagaggctaccaagcctcataactcttgcattccatggacctgcaggcttaacaccacatagaagtcaccgaggattatggcttgcactctctgaagcagcaactcaagcaagctgtgtctggggccctttgagctaaggctggagctggagtgacctggatgcagggagcagtgtcccaagtctgcacaaagcaacagggccctaggccctgcccacaaaaccactattttctcctagacctttgggcctgtgatgggaggggttttctagaagatttctaaaattcctttgaggccttttcccattgtgctggatattagcacttggctcccttttagttatgcacatatctctagcaagtggttgctccacagcctgcttgaatttggctccccaaaaagcctttccttttttgccatgtggccaggctgcaaattttccaaacttttacactctgcttcccttttaaatataagttccaaatttaggtcatttctttgctcttgcctctgaacataggcagttagaagcagccctggtatatcttgaacaatttgctgcttagaaatttcttctaccagatacctaaattatcactatgaagttcacacttccacagatccctagggcagaggcacaatgcagccaagttcatgcatgagtcacctttgctccagttcccaataagttcctcatttccatctgagaccgtgtcagcctggacttcattttctgtatcactattggcattttagtcacaaccatgtaacactaagcaattccaaactttccctcatctttctgtcttcttctgagtcctccaaactcttccaccctctgtctgtcattcagtttcaaagccactttcgcattttcacgtgtctttgtagcaatgccccactctcagtaccaattttctatattaggctctttttgcattgctataaatacctgagactgggtaatttataaagaaaagaagtttaattggctcacggttatgcagactggacagtaagcatagtgcccgcttctgcttctggggttgcctcagaaagtttacaatcatggagaaaggtgaagggagagcaagcactccacatggtgaaagcagaagtaagcaaaagagagagagaagtgtctggggggaaagagagatgccacacacttttatatgaccagaccttgcaagaactggtcgtggtcatgaagacagcaccaagccatgagagatctgtctgcatgatccaaaccacctggccccacggcaaccccaccttcagcattagggattacaactcaacgtgagatttgggcagggatagatatccaaactgtatcacagattaacaggagaaagtgtatatgcatttatcaagtgcattttcttttataggaaagaaaagtgaatactcaagaaaccagttagacttaaaagcttattaccctctctttataagggagaagagagtggggatgcagacaagttagggggtataaatgatttgggggaagatgatggggtccatagaagaagaggtgacagtctgtgacaaagtttgtctgggtgtggcatgaacttccagttaccccttctgggatatgagttaatctctggttgataaaactggaggatggcaggggtatcaatgacaattaagaagttctttttggaggatctgtccctaggcagataagaggatcccaggagaaagactctgcctgcatctgttgtcccacagaaactccagtttaatgtaatcagctaccaaagtggcatattttggggtggcatttcctgaacattttcaggaacaatatgtagccgcagaccttaaacaatggtctggctgtattccaataaaacttcatttacagaaacaactcaatactcagatttggccctcaggctgcagttttctgaccccagtgtttgttagtgaaaaaggaagatacggtgaagatctctacctatcacagaacggtgagaagagtagtaggaaatactttagagagagggccagatgttagatgtatcaatctgcttaccatacagattatgcaaattattctaattgcaatggaaagaaactggagagttttaagcaaagagtgacatgttttggctttgttttaaaagagggctgcgtgtagtgggtcacacctgtaatccgagcactttgggaggctgaggccagcagatcacttgaggccatgagttcaagaccagcttggccaacatagtgaaacccctagtgaacattttgctgcttagacatttctctactgaaaaaaaaaatacaaaaaattagctgagtgtggtggcacatgcctgttgtcccagctacgaggttgaggtatgagaattccttgaatctgttaggcagaggttgcagtgtgccaaaattatgccactgcactccagcctgggcaacagagcaagactctgtctcaaaagaaaagaatagaaaatagactgacgtgtaggaagggcaaaaataggagacctcttaggaagttgttgccatggcctactgaagacagtggttttgacaacagtgagaattgagtagatttaatatctacttagaagtgaactaaagggcttgctggtagttgacatgatgatttaagggagagtcatgagaccatatgcttgcatatcggatactttttttttttttgagaaggagtcttgctgtgttacccaggctggagtgcagtagcactatctcggctcactgcaagctccacctcgcaggttcacaccattctcctgcctcagtctcccaagtagctgggattacaggcacccgccaccacgcccagctaattttttttactttttttagtagagatgtggtttcaccatgttggccaggctggtctcgtactcctgacctcagatgatccacccaccttggcctcccaaagtgctggaattacaggcgtgagtcaccacgcctggccagaatactttttaaaaaggtacatgtaattaaattttcactgatttttgttgttgatattgttcaagcaacagaaattatccctggttaacaccagcagaagaaaacattattggaaagataacagtttggcttatagcatcaaatataagaagatacaatctgatttgagcagaaacaagaggaaaggcaaaataacaatcctgtctcagagactgcctcgtagggagctgtgacttgcctctctctttcaacacctagatgtacaccacctcaccactggcctcttgactgcctgccattcccttaaataacaggagtcagtaactctgcgtcgcttcctcaagattcagcctagttcgtgaagttctgattggccactcctagatcatgtggccctgccgcacatgaagggtgagaaagcactgtaatgagaggtggcttctgataccttctctggcctcatcctaatcccagtcatgatcatctcttacctcattgttgaaacagctttctggtttacctccctccttctgctcttaaatttcccccaactgattttccaatggacagccggcatgatcttgttcaaatgcaaaagttatcatgcaatgcccttggttcagatatttcaacagctttcactgttcttgggagaaatatccaaatctttacctacgagatattttatgctctggctctctctttctagcctcaattctccctcatttcaacccatgcccacactcaggtctttggaaagcatgtcctatgcacctttgaaaagatattgaaaagataacagtttagcttatagcatcaaatataagaagatagaatctgatttgagcagaaacgagaggcaagaaacctttgcatgagtcatgcagcctttgcaaatattgttttctctgcctgggaaacatttttgcttcctcttcttattgagttaattcctcttcctctttcagattatagcttggacatatatctctcccagactagataaggccctgtatgataagctatcagaggagagagatttattgaagttaagggataaggatgactataaataaaagagagcttcccaggtgctagctattatgcgctttcattttatgtcatttattcctcataaaaacattttgagacaaattgactattgtccccatgatttcaataaatacaatgaggcttacagatgctgattccatgcagctaagatgtggcaaaaaaaaaaattataataatgagaatccaagtctttgatcttcatattcctgccctttgactattctgctgttagaccacattctggagcttggactgtaaccacggtagcagaaggagagatacttacatttcaggtttagaaatgattgctctggatgaaagaggcaataaatgagttgaaaggctgttatgtaaaccaggtgaagccaggtgagagatcaggaaagcctgcattcaatgataaaatgcagatgcgttcctgtaatgataacttcttatggaaaccaggtcttaaaattagcttagaaagagggaggctgcagccaaatcacacctatcaatagtgctctcacttaacaaccagatagtgactgtacctcaaacaaacaaaataagatagggagcaaggtctgagttgagagcattttaacctaaggctcggaatgaagagctcactctgaacttgaatgtcaggccctaggccaaaccttcttggatggccctggttcaatagtaacctccctccttgctccaggcccttctccatagtatcactttcttttgtgtcctccatgatagttactgctatcagagattgttcctttgtatggttttcatgtttgttgatacccgcctctccaatgtaaactgcaattctgttttccggtgcctaaaagtggatgggtctgtcacatagtaggaactcattttttaaaaaaaaactgaatgaaaagaaaacaagaatgaaaataattagtagcaactactcccaaggggaatgtagaggctgttgggggaagtggtttccttatacaatgaaaggaggctgagctgtggtcttttacaggaacatcagatctcgtgttatctgacttctttgccaacccagatccagctcaaggtaaaaatctaagcaacttgggctaacatccaaccaagacagggatgggcaggctgattttcaagataagaataagagaaagtttcagaaccgtcttagtaaaacatgtacacacaatttaagacaaagaataagcatgataatcaccttgtggatttctttagcctgttaactttgctaatcttgtcagtcctgtctcctttaggctcgttcctaaagtaatacatagcaaaggagtaagcagtgataaaatttttaaactgagttgaatagatgggtgtgtgtttgtgtgtgtgtgtgtgtgtgtgtgttcagatatgggtgttgacaacaaggagcaggggatctcccatgtagtgatggttgtaaaaagaaaggaaagttggctgggcacagtggctcacatctgtaatccaacactttgggaggccgaggctggaggattgcttgaggtcaggagttcaagaccagcctgggcaacacagcgggaccctatctctaaaaataaataaaaaattagccagccatagtggcacacatctaccgtcccagctacttacttgggaggctgaggtgggaagatggcttcagctcatgagatcaaggctgcagtgagctcggatcatgccactgcactccagcttaggtgacagagcaagatcctgtttcaaagaaaaaaaaaaaaaggagaggaaagaaataaaagtcaccttgtccctggggctttgaggaactagtgaaaggacagaaaagtggcccaggttgctttgtggtaggaaacagtggcactattcctgagcttagatagaaatatatactgggaaccacaggctctctgccagtgtcctgccagtggagcaccctttgagagagtgaaagcaagtgttctgatattctacagaggatgaaactcagttctcatggtgttactggaaaaggctcctggtccagaccccaagtgagggttcttggatcttgcgcaagaaagaattcggggccagtccacagagtaaagtgaaaaaaagttaattaagaaaacaaaggaatgggccaggtgccgtggctcacgcctgtaatcccagcactttgggaggccaaggagggtggatcacgaggtcaagagatcgagaccatcctggccaacatggtgaaaccccatctctactaaaaatacaaaagaaattagctgggcgtgctggcaggcacttgtagtctcagctactcgggaggctgaggcaggagaattgcttgaacccgggaggtagaggttgcagtgagccgagatcgcaccactgtgctccagcctggaggcagagcaagtttccgtctcaaaaaaaaaaagaaaaatagaaaacagaggaatgaaagaataaagaatagctactctatagacggggcagagcattcccaaaagcaagaggaggaacatgcccaccttgggtgcaatgcttttatatatataagataacaaagcaaaaaaatcatgggggagatgtgctttactacaagagcttttgacaaataattgttaattcttgtgtaactacagtcttctgcaagaatttatattattatctttaaagtgaaactgattcttagtttaagaatgcttttgttcttaagatatcaggacatcaggacatttcctgggtctgttaggtcgtaggtctgttcagtaaacacgattaacttattctcttaactgtaaatatcctgttaactaagaatgcctaacctcctggggaataaaacccagcaggtctgagcttcattttacccagctcctactccaagatggagtccccctggtttgaatgcctttgacaatggggttcagattcaaacaataattattgaatgactcttgtgtgcctggcacattaaaaggtggcttcccattcattatctcattcaaacttcacagtactttggtgacataggtatcataaccttatttcatgaattagtaccatgaggctcagagaaaagttatttccacaagatgcccaggaagttgagggcagacctggaactggggtccgcctcctgattcgggccctctctgcaataccgaaaaccattttattttagactatttattagattggtgcaaaatcattgtgattttaagttttgcaccaacctaatattaagggaatttgatttctaaactcggtaacttaaaattataatttatattgttttggtgcaatcctgacatccagaaccatggagaaacgtaatcccagattctacatttcttctacttctttataaaacagcatttggggagaggtaggatttataatcagatgtagatactacttaaggaaaaactgggctagaaacaggatctccagataacgttactagtgatgctgatacactggatttcttcccagctccagctttcatttagttgtttgctcataacatattataacccctttctatagtaaactggcacaaggttttcttaaattgattcaggaggataaattgtaaagttatatcaggagaggggtaaaatccacattcaccaaaatggaggattagggttaggggttagagctgagagggagaagagatcagaaagggaagaaaaggtgtaggacaccctgctctggggatgagaagggaagctgagaatgccattgacttgtcaccaaaggagaaactgaagttagagagtcagggagtatttggagaagcgtggacagttatctagtaggttctgggtaaagcaagagttcagtggccgaatgaagagctccacctaagcgggtctgaatgtcttaggaggattccaggcctcaggctcctgcataattctacggcaagggcaagaagttgtaaaacaggttttgagcaaaatagccacatagactaatttggcctggcattgtcctaactcttaatacctctctctctctgctcctcagcacccaaagcccacccatatgtaccaaccaactgcaccttcctctaccggcctactcttcatctaccctgggtcccatcctcccgtctcctcctcctcctccctcagagctccacctaagcctgtcttcaaaggcaatgacctgcatacagaattaggccatctcttctactctccaccccatcagctctcaaatttccaccaaaacttatctcatcttatagttgtcaggaaagcaacttgaataatgatgacttcatgtgttaactacctcaggtcctttacatggtaaagaaggcactcattacctcaaacaccacagacattcagaattgtgttttctgaagaaattttagaccttttttgtggtgcatctcaaagtatacaaagcacacacttcatattaacatatcatgttaagtagatgctagaggaaagatccagttttatcaccagtgtcttaaccactgtgttgtaccctcggcatgagcttacctttgaagagcaatctacaagaggagtttacctggtaagtcgctgaatttgagaggaggtggcaaaatggcagaggaattgcttcaaaatggatgagtctgattgagacgcttttgtatactggaaacggggacaaataagcaggatgtgcatttgttatgttgagaatgttccttgctgtgtttatagcttatttgaaatgtactaaattattaaaagtttctccttaaatacaaagatttagaaagctgaggcctaaaagtagatcctactggtcacagtagattaagaaatgtttctgtatctgagcttaagacaatgagtaagatacgagaaaagtggttatcagggttggggttactgacccttctaacttcccctctctcagacctcctcgtgggatgaagtaaatcagggagtctctcgctgctttcctcagtgtctgtgggtatttaataaacgttgatggaaacgcttcaccaacctgagtgcattgcctctcttctctagcctcatctataaaagaactctaagtcatttctaagccaagaaacggctgtgcttttactacctttgtcattattatatgtcagaatagaccttacctgattcagcgttttccttcgaacttcatattctacagctttgtaatgatagttgatagtaattttcatttgcaataaaaaaataaaagtttaaaccaatgaaatagctgcaagcctgctgtatcggttcgaaccccaagagcgcggtaacaaacaccacaaggcggtgtggagcaacacgctgttctaatgagcgcctgggtacagacgggctgaggtctacaatggcgtcagcaccaaatgagtatgcggcaggggtttataaagtctcctgtaaacaggaagtgtctcagtctgatgtaactgctacgcagtacgcggacggcctctctttccgtcttcagcgggtacgtgtcttccgggcagccctcttcctgcttctgctatcttgctgacgcaggctgctgactcaagtggtcttgagccttgggactgggcctgagaagggaggagttattcaccctccaccccgcagcttccaggcccagtggaaagtctttcaatagccaccatcagtttctacggagcaacatgtaaaaaattacaaaagtaggaacattgcaaatgctttctcatggcggaattaatggcgacaagaaaattacgaaagcatcgaagcacttttaaggctgagttttaatcctaagaaacacaaatgctaaatataaaattccagtcaatcaacaagtgctagcctcgattatttaatggtaaacagttgggaaaaagctcaaattaacacgaaatactaaataagagactaataaatatttcatctagttagtgtgacaaaaaggcctccataaacttctttgctcattgggtaggctgagaaatgggtcagattggatatggtttatttggttacaattgatcatttggcctaaagacaactgtcttttaaaaaatgcgttatttatatcgttggagagtcaagaaaaggatgagtgtatagacctaaacagaatctgaatgcttgcctttggctaagttgaagttaatgatcacaataatgaaccacatcaggaaacatggtgagcttggggccgaattttcagttgtaacttgtacctctcaaattgttacattattcaacaatacattttccacacactcaaatttgttcacttgtaacttgtattaattgaaaattcattcactttggaaggtgttttgaaagaggcttgtgtatagcagttgctggtacccctggaattcaaaatgatgccaactgaatgccatttcaaataaaacctttcatttatttatttatttatttatttatttatttatttatttattttttggcagaagaaaagagcagagtcacacagtagctctcgatttatgaacagtgttttctaactctcagactcccaccgtgtgtgtagttcccttgaaggaactaggttggacacatttaacaagaaaataattgtatctctatatctgctttttaatttgaaatcatatggacctttgattatacttcatcccattctcatgcctcctatgaccagttgagagggtggacactgagaatcctacagcagcttcttctgtttgtaaaatattgttcaatgacaagtcagacagatagaaacctccaaagcatggtggctattgtggacaaaatttgtgaaaatattttacattggaccttccagtaagcattttcgcagccctaggtcacatcttgaaattatacaattggatccccccaaattgggttgaagtgctgacaaacgagaggatgtaacagatcaaaactgatctggatgatgggtgagtgaagtgcaggcagatagaggacagagataaacccatacatgccttacgggagtttgtggctttaagtggagtccatccttgtaagtggtgcattaaacaaagagtttattgtaaagtgggcctgatccctggaggaaaagaaaattgattctttttcactggagggaagttaactctttctgtccttttgcagcagagaaggtgctgaacacatatttagtgatgaatttccctggttagttccaaggggtctttatgtcaggaatagtatttattcatactgcattttctatgtaatagagaggcaggattccctaaagtcccccgttataatcccttcatcccatctagcacaggtagactgtgaaaaacacatattctaatagttactaagctgttaaaattggctacaatacttttatttttgtttgttttgcacaggagtaactcaagatgattttgatgttgcagttttaaatttcactttgacttgagctgggaaatcctttggcctattataccatggatgctaaaaatggtaagagctgcatgttctgccttgatgttttcaagactgaatttggagggagaaaaattattttgcctaaggatgtccgtgaaagtatcaggaaaacactgaaaagccggagagaagggttcaattgtagcgtgctccctttaagagggaaacgagattagcaactttggcaaatttttgggactctattcagagggaaagagaagagctgccagtgtcaaaaaaaaaaaaaaagaaagaaagaaaagaaaaaaaaaaggatgaatgttatgagacaaagacagaggcaattttacacctttctgaaagcttacctgggagtagttttaggtccactgaggttaagaaagatgcatttttttttcttttctttcaagactaaaggtggagttagggggaaatgagtttaatgtgaagtagtactcctgtcagttctgtttgtcctgggaagtatacaaggaagaaaagcctccgtggaagagagagcaagcaccaggtgctgaaggtgagggattacctattacactaacaattatgaaagttacattatgatatgaaagtagaaactctttattgcatccttcttttaaggaaaaacctgatttaaacagttaggaagcttatgactgctagacacatatctgaattgaattttgccttttcatattagcaattactttgttttctaaatgccctcatgcaagaatagtttacaaaaataaagcagatttttttttatatcaggtcagaaaagttagtgaggcatcatttgggataatcacagtgtttacccaagccttattcatatataaaaatgttattttctctaattgcatattttgcctctataatgactggttaaattctaaactgaaatgagtaatcaatactgtgcacctaatgttcagatgaagtcgtagctattttagatggtatgacactgctccaaatttggcaaattgctataaagatggacattgaaagctaaaaagtgtgtttttgttgttgttgttttttaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttccctttttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctactgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaactgtgtgcatatacctatattttcagtggtataagttctctttgctgatgtggtcagaattgggtacagtgcaccaaaaataagaatgctgcttcatagaaagagaacataggcagcattgtaaagcatttttatgggttttttaacagcttgtacaacaggtatatctgaagtaaaaattagttgcttctgtaagtatcacaagcaggttctatgtaaaatggcaattctagtttcaaatgccctgccaataacgagaagttggttgaatattttttcttatgccatccactttttcccccaaaatgaaattattcaatgaagttaaatagatttaaaatgaattgtggcatcaaggtattgctctaccatgtgctatagtttctgaagggggccctggagaagtgagtaagactaaggagagagaagaaaatattattttcatgtgccaccagattagtgagtattatcaagtgattgatgcatggatttaatccccacaataacatagtaaggtggattttttaaatttccatttcatcgactctcccatcatcttcttttccctaacaaattcctaattggaaaacaatgtgttcgggtttataaaaaaaaaaaatacagctgtatttccagtcccgatgcaggttgctggagggtagggttaactggcatagttctggcacataagatgttagcaggaatctatgggtgcggcttttatgaaagcttttaagctgacttggctggctcatgccctgttcctctccctgctcacctttctctccatctggacctctaacttggtagcttatgctcttgaagccaccttgtaagaatgcaaatcaaggacaccccctacaagggaaaatagaaaggtaagaaagactgcagccctagattgcacatctccagacgtctttttcataagtgaaaataaatatgatttctaattgacacagcaatatatctaagggaaattatccaggaaacaagcctggtttaaaaaaaaaaaaaacgatgcacagcttaggtccaacttgtacttgtccatgacagttgatggagttgatcactgtggaaacagctagctttctttcttgcttttttctttctttctttcttttttttttttttttgagacagtcttgctctgttgcccaggctagagtgcagtgtcatgatctcagctcactgcaacctctgcctcctaggttcaagccattgtcctgcctcagcctccccagtagctgggattacaggcctgcaccacacccagctaatttttgtatttttagtagagacagcgtttcaccatgttggccaggctggtctcgaactcctgacctcatactttcaaaggagttgaggacatgccactatcgtaagacacacacacaaaggattgcttttggcctggaaatccctctgagatgctggtggtggagtgaccttgataaaaggattaaccaggcccactgctcttttgcttctttcttccccccaacataaaatccacagaaacctggataaagcaggcactgtacaacttgggcaaaaaataaaactgctaatactgtctcagaccctctatccctcaccaagaccaaacttcatccatttagaatatttgagaggatttttaatacacacaaaggaatccagatttttctttaaatatttgtatttcatcatttctgagtgggccaggacatgtgctgagtggattctctgggccacttttatgtaaatttttaggcaccagattctactcagtttaatatattctatctattagtctcatcagttacaagccttgattcttctgttctgaatgttctgtaaggcgtgtgcaaagtcctgtgtcttttaaggtaagacttgcctgtggatatctagaaaccacgcctattcaccctgcgtactctataaatcacaaagccctgactcaattctaaaatcagcgtggcctctctctctctctcactttcatttttaaagga

SEQ ID NO: 14052 - DNA, 18744 bp, Human
gtttggtgggggggcaaaagtagcaagccctccacccccatgaactgcagcagtgacacagctggggacatggaggaatgggggagggctcctggaatgaggaaggttcaaaccctcttgccagggccttggtttttaactttgctcttttgtagaatgactctgaaagaaaaccaataaaatgcacctaagttatcattgctggtgtctgaagagtggtccgctcatagcccagccccactgccaagtgcaataaggctgcttctgcattcaatctgttgcaatattacttgtcacttagcttctggaaaacttcacagtgcatttttgcattatgaaaatagtaataacctcatgaatcttgtgaaagggactcggggatccaccagggtccttgagccatgtttagaacttttcctccctgttccctttcaggtggccagaatacagaccttggtgggtgggagccacagccactcagagtaaagctgtaggtgaggatgcacagggcattgcaggctttttagcattcttggccctgcctgctattcatcaggtcccactcctctaacagcttgtcattcgaagacccaaaacatcccctgtaaagttagagctgcttacctgaaacagaaggtgtctggaagaaacttctttcttgctattttggcatttgcaaagcagccattatctaagaaatatcactagtctttcccgacatctcccttgaaatcattttggctcaaatggagatcagatcaagctcaagatactcccatggctttccatactattcagagtgaaagcccaactcctttctgtgacctcaggcctcttaagatctgacctggttcccactctgatctcaactcctattactatccagcaagtgccctccgttccagccatgcttttgccccagagcccccccgccctccacagggaggactgaaatggtcttctcacagacttctatctggcttgccaacctcatcttcacattcatcttgcctgaccaccctatttaaaagcacttcgtgctgtgtgtcggtgttatgttctttttgaacacatcacaaacattgtttaattagctttccgtctctccccagttgtgtgacaatgagggccaggatctttgttttgttcccagtatccccagtccctaggtgctcagtaaacatttcctgaatgaagggctgtgtgtggcagcagagctgggacaggaaatacaagctagcccccaaagcaaggtttaggaggcactgtggggctcttctcgcttatttcctacgctttgcagtgatcccacccttggctggaagccaagttctccagcggacttccttaaactgaaccctaggaagtggagccacacctggccccctataaacgacccagagcaaggttactgcttggtctttgggaggaagttcagaagaaagtctttggccgtattaatagtgttaggttttactgtgaccatgtcattctcagggatgtttgtatatcaaatactatttctggagaggactgaaacccaaatgatagcacttttggcctgtggaagagatgaagctaagtggggtggtaaattgtggtcaaattctatggtgaagtccatgacaagcaacatgccgtcagcgtaaatacagcgcgggtcctctagcacaacagaacccctgacatccactccattccactactttggggagtgatgaagaaagggagagggttggggtcgtcagcggcggatccacccctccatcaacccccgcccccgccccgctccaggctccctggcccgacaccgcccacaaactaaccacttgttttgtccacgccccctcccatgggcacgccccaggccttggccccgcccacctactccggctggacttgtgcccggccctgccccttgcgaccggccctcgcgccggcctcacgttcaggctccgcccccggccgcgcctccctccttccctttccgacagcgcgggaacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgtaagtcctcgcccgcggccccttagcaggtatgggaggcggggggctgtcgggggaccgacacacacagaggtgaaataagccccttcagcgacggcctgccgcgcaccctatgagcaggggcacccttcactgagcacttgctgtgtgcgggacatcgaggatccgggaactcgaggcacacgccttctgttcgctgtaaggtatagtgatgataagtggaggcaaatcacttttgatcgcgtacttccatctctaaaaaactggactcgtacgtccagtgtaagtatacttatgtataaagtgtacacatgtgttaaaatacgtacattttaaagtacaaaaatagatacttaaaacgtgatggtggaatacgtatccgctatcctggtggctgtatgctctgcttttcaaagcataacgttcactttaaggcaagattgctttctctaagaatggtaactgtgaatccatattttagtgttcttgataatttctggctcttggatgacattgaactttttttttaacctctctgtggctgacgaaggattcctactaggagcagaggtgtcggccctgccattttatttggttgtgtttctgttattgatattatctccaattttttggcaggcattcttttaagccacgtgcttatttgtgaggacaacttttgcttaaaaaaaaaagagtacagtatctacagatgcacttaactagcaaagttaactaaaacacacagaaaaatgagtgggtgaggtgccatgttcagctcctagtggggccagccttccactcctcttggatacccctcccccataatttatgctggaaaccatccagatgctaaatatttctaatgcttaatttcttatgttttagataaataggggaaaatgggagttccaatattttcttcctacactccactttgaatttctttcaggagatgggtcaggagaacttgtctgaatccccaaattggaagctatagaaatgtttgcccagctatctggcttattctggatagagtaaggagagggcagggccttaacctggggcccctggatagaagagtatttcagcacaattgatttcctttataatcctagatattttatcaaatgcatttaacactcattctgatcacaggtctctggcactaaaacaggttaaaatttcctggagtagggtcttccctatctctctacccccaaatatcctccccaccacaaattagccatcttttaaacttaggttttttttgtttgttttgtttttttttttgacggaatcttgctctgttgcccaagctggagtgcagtggcgcaatcttggctcactgcaacctccacctccagaagaagcaattcttctgccccagcctcctgagtagctgggactacaggcgcgtgccaacacgcccagctaatttttgtatttttagcagagatagagtttcaccatattggctgggctggtctggaactcctgatccacccacctcgtgatccacctaccttggcctcccaaagtgctgagattacaggcatgagccactgcgcccagcccatcttttaaactttgactctagtttttctctctcacatagtgtctatattccacaaagaaatagttgtctttttttttctgcctcacatcccaagtgcctctgtgttgacaaacggccctgcaaaattatgcatagggaggagtagagacgtgaggggtggtgggctagatgctgccatgacttgccacaccacgcctcaggtcacgtaggatctgggtttgtgcctcagcagaattacagatggttacattgcatcatgggcctctggagctctggggaatagtgttgaatctattttaagaaaagctgggtgcttgcaggacagagcattggttctgcttaaactcctggggctccaaaacaaaagatcctcatcccccgtctttcccctttggctctgtgcatactgtttggaatctgtaaagtgattccttctgtttcaagtttcatctctgggaagccttctgtgtccacagcagctcttgctgatctcagcacacttagagagttaattcattcaataaatgcgcaacaagtgcctgctctgggctggcgctgtgctgagtcctaggacacagaggaaggaaacactaccttcaccttttaggaactcacaatttggtgaaaggaacacaagagctggacagatgactgaccccgagagttccaggggattgccgagggcagccatagggctgcaagactaagcactgcacagcatcctggagtattatttttacctaaaatttgggaaagaacttttttcttcttttgtgtaaaacaagcatgaatctattatagagtaggttccaatatgaattttgagctgaaacagatgacagaggccaaagaatagggcctgtcatatgatagatattcaatgaacacttgaacagttctcatctttcatgttgtccctgtctccatccactgacttttttttttttcctttttttgaaatagtgtctcacattgttgcccaggctggagtgcagtggcatgatctcggctcactgcaacctctgactcccgggttcaagcgattctcctgcctcagcctccccagtagctggaactacaggcgcatgccaccatgcccgtctaatttttgtattttttttagtagagacggagtttcaccatgttggccatgcaggtcttgaactcttaaccttgagtgatctgcccacttcagcctcccaaaatgctataattacaggtgtgagtcaccacacctggccaacatccactgactcttgcagatactgcgtgccagcccccatctgtccaccgccatctagcccccagctctgcccagtctgccttgtgctcccttcagccagacacttaactgcttgctctccctctgctacccaggaaaccactgttgctgcgattgccccggatatgccagaggaacctgatgtccctgctgatggccgttcggccatcgctgccggaaagtgggctcctctctgtgctgcagattgcccagcaggacctagcccctgaccccgatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggtactttggtagggagactgggtttagagtgatctttcagcagtggtggctttatccgtggggaaggctgcttgggacactttttcccaatggagttgactgtagttcctggaggaagaaggaggaaggtagggttgggggaatgtagcctccactctacagactcttttttttttttgagatggagttttgctcttgttgcccaggctggagttcaatggcatgatctcagctcaccgcaacctctgcctcccgggttcaagcgattctcctgcctcagcttcctgagtagctgggattataggcatgcgccaccacgcccagctaattttgtatttttagtagagacagggtttctccatgttggtcaggctggtcttgaactcctgacctcaggtgatccgcccaccttggcctccaaagtgttgggataacaggtgtgagccaccacgcccagccactccacagactcttaaggaggggtagggaagggagttattggaggtgggaaatgtgtcctaatgatctataatgtggggttaaagggtgccaggcaagggagaggctctggagccacccctgctaccccgtcatatgtgggtgggaagaatcatgacagcatccagtctgcccctgcctcctagtctgaggcctgggtctacccccatttgggttggatgcagaagacaattctagacagctaggtttcacatggaccttgtctagtttgggttcttaggcacttttcaagatagagacttcatgttcttgactttttttttttctcctcgagacagggtccctctcttctcccccaggctggggtgaaggggcatgaatataactcactgcagcctcgacctcctgggctcaagtgatcctcctgcctcagcctcccaagtagctgggattacaggcatgcaccatcacgcctggctaattttttatatttatttttgtagagatggggtctcaactagttgtgcaggctatcttgaactcctgggctcaagtgattctccatcctcagcctcccaaagtgctggtgtgagccaccgcgcttggcctcttgactttcttgaatcatctttgccagctagctcccactgacctggggccttttcagtagggggagccagaaccgggcttggggtcatgctgcagggggagggacgtagcagtgactgggctctcctccacaggaccagcttcccaggctgcagcagctgctgaagaccttggaggaggtgactggccccacagtgctcaccatagcctttcttccatcttctacccagaccccaactatgcccaaggaaggcccaatgcagtgatatacaagctggctgggggagggggactggagtaaaggtctgaggacagtctctgaaggagcttttcttgaaccaagtgtagacttaccatctaaccccaggtaacttcctcttctctggtagtgccttccaggatctcaggccactccttctgccacctgaaggggtggcttcagtgacttgtcactgagggctctgccagccctaacatgagatttgtctccccaggggttagagggattggaggatgcccccccagttgagctacagcttcttcacgaatgtagtcccagccaggtgagtccagatgactgcctggctctgaggttacattctctgtcccttatctttttctatttaagtttatgttttcctacctcatgtgggaaatgtgggaggggattttgttgttttctctctcagcgataggggtcaccctgtgtagtatcttttagcccttggttccttcccctagggcagctctcccagactttctttgccctggagtatctttgccctgctctgtctgctgtccagttgcttgagacagcctagcagaggcagagtgcatgtcccggtgtcctctctccccccgcactctgtaagcagatggacttgctgtgtgcccagctgcagctccctcagctctcagacctcggtctcctgcggctctgcacctggctgctggccctttcacctgatctcagcctcagcaatgctactgtgctgaccagaagcctctttcttggacgggtaggtgtattgggaggtactcagagtgccaaggacaatggggaagagcaactgggccctcagaagggtggtacttgagagaggggattcccagccttgtagacatctgggctgtttgggcagcctggggcaaggaaaggatgcctgcttaactggcagggcatggacccccaggccatctacccacatggcatctaacttttttttttttttttgagagagagtgtctcactctgttgcctaggctggagtgcagcagtggcgtgatctcctgcctcagcctcctgagtagctgggatcacaggtgccttccaccatgcctggctaatttttgtatttttatttatttatttatttagagacggagtcttgctctgtcactcaagctggagtgcagtggtgcaatcttggctcactgcgacctctgcctttggggttcaagcgattctcctgcctcaacctcctgagtagctgggactacaggcacccaccgccacacctggctaatttttgtatttttagtagagactgggtttcgccacgttgcccaggctggtctcgaactcctggcctcaagtgatccagctgtgtcagcctcccaaagtgctgggattacaggcataattaagccaccatgcccagctggcatctaacttctctttgggcaccagaacccttctagaagctgatcaagggactttcagggatttgggaactgagcaagagaggtatgtatcttttccaatgggtgggtccatgtgagttctaaataaaagaacttggttttttttttcctttgtaacatgtatcatcatctgaaatgtgcatttgataaatgctgttgaaatgaagaagaaaataattaattttttcctccctgttggctgtagatcctctccttgacttcctcagcctcccgcctgcttacaactgccctgacctccttctgtgccaaatatacataccctgtctgcagcgccctccttgaccctgtgctccaggccccaggcacaggtaattctggaaccagccccaggcccagtagctctgccctcagtgttctcagcatccttcaccccagagtggccctggcaggagttgggtattcagtgattaaagatgcctgctgcttccctgacaatgcccctgtaacaggctgggcattctgttaccgcctccctgctttctgctgtcttctgccatttccccccagacttccccttctgctgtcctctacccaggtcctgctcaaacagagttactgtgttgccttgtgaagatggagtccctggagccagatgcacaggttctaatgctggggtgagtgtgcaggcctccgtgctgtccccactgccacctgttcccccaggctagagtgacatcacatgtgttgggccctgcagggaaggcttaccttctctaggaagccttatgtgtatcatctcactccatcctctttctcctttatgagtcctctttgccttttgttctcacgatgcactttctactcctagttattttttaggggatccttgtgtctcactaccaaatactttgttgtcagctcctggggctcttgaggttgtgacctccctggcagttgtatgagctctgcaacagtggctgctggggctggtgccagcatcaagaaggctctgactacccatttttttttggcggggggtggggggtggggacggagtcttgccctgttgcccaggctggagtgcattggcacagtcttggctcactgcagcctctgcctcccaggttcacgcaattctcctgtctcggcctcctgagtagttgggattacaggacccaccaccaagcctggttaattttatgtatttttagtagagacgggatttcaccatgttggccaggctggtcttgaacttctgacctcaggtgatccacctgcctcggcctcccaaagtgctgggattacaggtgtgagccactgtgccccacccctgactacccctttgttggctggggatcttggctgtccccagggccttgccctgctgtgggagttggagcagcagatagatactcaggcttgggtgggaggccaggcatttttcactagggcctctgctttgcagacagatcttggagctgccctggaaggaggaaactttcttggtgttgcagtcactcctagagcggcaggtgagcaggctgccctggggaagagtggacaaagaagtgctgcagtccttggaagcacacggggttcctgggtttctgagtccttcagtgcatggagggtcaagcaggacagctgccctacagcagctgcctgagacagtgggagagccctgggccatgcaaagctggtagcagagagctgagcacatggtcacttcagctccacctcttaccagctgggggggccttgggggtgggatttttgatgtgtgtgtgtgaatttaattttatttttgaataggtaatagattcatatgttcacaaatttttttttttttttagatagagtctggctttgttgcccaggccgaagtgcagtggcacaatcttggctcactgcaacctctgcctactgggttcaagcaattcttgtgcctcagccacccaaataactgggattacaggcgtgcgccaccacgctggctaatttttgtatttttagtagagatagggttttgccatgacctgaggccagaactcctgtggcctcagccacccaagtaactgggattacaggcgtgcgccaccacaccggctaatttttgtatttttagtagagacagggtttcaccatgacttgaggccagaacttctgggctcaagtgatctgccctccttgacctcccaaagggctgggattaaaagcgtgagccaccacgcccagcccatatgttcacaattttaaaagctcaaaaggatacagtgaaaaatattccccttacttctcttccctaaccatccagatttccctccttagggctaaccagtattaccagtttcaggggaatccgcccccctccagagataccatctatatgtggaaacatgtctactcttactttccctcctacttttttggaaattgcaacacaccaaactcagtgccctgtaggttgctttttttacttcacagtatattttggtgatttttttcatatcagtacctgaaattctgcctcatttgtttatatcttagataactgacctaacttctttttttttttttttgagatggagtctcgctctgttgcccaggctggagtgcagtggtgcgatctcagctcactgcaagctctgcctcccgggttcacgccattctcctgcctcagcctcccgagtagctgggactacaggcgcccaccaccacacccggctaatcttttgtatttttagtagagatggggtttcaccatgttagccaggatggtctctatctcctgacctcgtgatccaccggcctcggccttccaaagtgctgggattacaggcgtgagccaccgtgcccagccctgacctaacttctttatgcctgtggtttcctcatctacaaaaggggagatataatattaatagcacctaccatataagactggagtgaggtttaaatgagataattggtgtaaagtagtcagaatggtacctgatgcacagtgtttattaaataataataataattattattttttttgagacggagtctcactctatcacccaggctggagtgcagtggcataatctcggctcactgcaacctctacctcctgggttcaagtgattctccagcctcagccccctgagtagctgggattacaggcacgcaccaccacgcccggctaatttttgtatttttaatagagacggatttcaccatgttggccaggctggtctggaactcctgacctcaggcgatccacccgccttggcctctcaaagtgctgggattacaggcatgagccaccgtgcctagcataaattattattataaagagacaggtgattaaggtggcagtgtctcttgggccctgggtcctttatatctttaaccactgaaccagatgagggatccttggcttccccttggtcctaatctgagcctttgcaatggtagccaccattttctgagacctgtgtgtcttatgtgcattatctcatttaatccttttcacagtcttccgttagatatcctgagcctcattttatagatatggaaatggaggtttaggttggttaagttacctgcccagggtcacctagctaggaagtggtggagttgggaattgaatccaggactggctgaatgaagagcccaagcctttcttgtgattactgctccatctcccaatgtgtgcaggtggagatgacccctgagaagttcagtgtcttaatggagaagctctgtaaaaaggggctggcagccaccacctccatggcctatgccaagctcatgctgacagtgatgaccaagtatcaggctaacgtgagtattgatagggccttggggctggtcctgctggcagggctgccctgggcctgccacaagggtgtatgaatatgtatgtcagggataaaaccctgagtgctggccaggcacggtggctcacgcctgtaatctcagcactttgggaggccgaggcaggcggatcatgaggtcaggagttcaagaccagcctggccaacatggtaaaacctcatctctactaaaaatacaaaaattaactaggtgtggtggtgcacgcctataatcctagttacaagggaggctgaggcaggagaattgcttgaagctgggaggtggaggttgcagtgagctgagatcatgctactgcattctagcctgggcagcatagtgagactccatctcaaaaacaaaaacaaaaacaaaaaacaaaccctgagtgctagccagagaaacaacaagttcaagcccaggactggggaatgagactgcttaggagttcattcatccagccaacacttctttaggccagatgctgtgtggggcactgggaaatcaacagcgaccataatgcaatccctgcccttgagttgaccccgtcacctaaccccaggctagtgagaggggagaaataaaataaacagataacagatattagaagtaagatctggtaggagccaggtgagaggtgtgcaaagggcatttggtggcaaaagaagaggagcaagtgagctttgtttgtggttgggaattgggacgggcttcctgacttttttttttttttttgagtcggagtctcgcactgttgcccaggctggaatgcaatggcatgatctcggctcactgcaacctctgcctcctaggttcaagcgattctcctgcctcagcctcccgagtagctgggattacctgccaccacgcctggctaattttttgtatattttgtatttttagtagagacggggtttcactatgttggccaggctggtcttgaactcctgaccttgtgatcagcccgcctcggcctccaaaagtgctgggattacaggcgtgagctgtcgtgcccagacttcctgactcttaaaaggtgaatggtagtcaagagccagagatgagaggaagggcatttcaggaaaaagatacagtgtgagcagtgagtgtctgaggggatctgcaagtagttcattgtggatggagcctaaaaatgtgagaatggatggtggtgggggataagattagagagctaaagtactaagagctattatttctacagtacctgccatgtctcagtcatggttcttttattaaatttaatttttcaaaaatagagacagggtcttcttttttttttttttttttttttgagacagagtctcactctgttgcccaggctagagtgcagtggcgcatctcggctcactgcaagctccgcctcccgggttcacgccattctcctgcctcagcctcctgagtagctgggactacaggcgcgcgccaccatgcccggctaattttttgtatttttagtagagatggggtttcaccctgttagccaggatggtctcgatctcctgaccttgtgatctgtccgccttggcctcccaaagtgctgggattacaggtgtgagccaccgtgcccggccgagacagggtcttcttatgttgcccaggctggcctcaaactcctaggctcaagcaatcctcccatcttggcctcccaaagtgctgggattacaggcttgagccaccacacccagcctcaggcgtggctctaagccctttacatatatgaacttgctagtttattccatgtgtcagccctgtgagagatattcttttttttttttttttttttttgagatggagtctcgctctgtcgcccaggctggagtgcagtgctgcgatctcggctcactgcaagctccgcctcctgggttcacgccattctcctgcctcagcctcccgagtagctgggactacaggcgcctgccagcacgcatggctaattttttttgtatttttagtagagacggggtttcactgtgttagccaggatggtctcgatctcctgaccttgtgatccaccctcctcagcctcccaaagtgctgggattacaggtgtgagccaccgcgcctggcctgagagatattcttattattccgtttcatagatcagaaaattgagactcacacaggttaaagtaacttgcccaaggtcacactgccaggactagtagcattttttctgtacgtcatggtgaggagctgtatatatgtatgtatgtatgtatgttttgagagacagagtcttggtctgttgcccaggctggagtgcagtggcgcgatcttggctcactgcaacctccgcctcctgggttcaagtgattcccctgcctcagcttcccaagtagctgggaatacaggtgtgcgccaccacgcccagctagtttttgtattttttagtagagatggggtttcacaatatgttggccaggctggtctccaatgcctgacctcacatgatccacctgcctcggcctcccaaagtgctgggattacaggcatgaaccatggtgcccagccaggagctttatttttaactttatcttgaaagtcaggtattctgggctattgcctttgtacccttatgtcgggggtgttacaggcccatttgatgatttgatgtagaccctcccagaaagatggaagtatgaacatgcttctgttgcacagtttcaggggagctcctgaatcctctggagatctaggcagaaggacctccaatgtgaggcatcaggagtcattcaagggccttcaacctgggagtaacttcatcagatctgtactattaagaagcatctggcttctgtgaggagtgggattggagggtgaagatacagggcctgagacctgtcaggaggttgtagcaacagggcagaaagagaaagtgtgatccaaaaggaaggtagctgtcacagtagagtgtctgtgaacctcagttttctcctctgtaaaatgggagggtcttgaggattatatacagcaatgcatatatatgatgtatatgtatgtttgtatatggattgatgcatataaagtgctgccacatagtaaacacacaatgattgtcaactgttactaatgtggccggcttagtaaattgtgcagctagtatttggctccaggtctacctcgttaaccatggtgaaataatgagattagattgctcaggagtctcctcctctttccatcctcctggcctcctctctcctcaatagagcccctggggtagtcgggagacgggagggatcagttgctggagtcctgacatgatttttccttctccccagatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgtctttttcttttttttttttcgagtctgagtctcgcactgtcgcccaggctggaatgcaatggcatgatctcggctcactgcaacctctgcctccccagttcaagcgattctcctgcctcagcctcttgagtagctgggattacaggcgcatgccaccatgacccgctcatttttgtatttttagtagagacgaggctggtctcaaactcctgacctcaggtgatccgcctgcctcccaaagtgctgggattacaggcgtgagccaccacgcctggccaatgtcttattagaagcagtaccttccttcccatgaattctgggtattgagcccatccgcaccccctccacttccctgctcaatgacaaggaacatctttttcctggtgaggggaagggtgtagggtatcttattcaccctctgagggccaaataatgtgtaataccacccaccccatcctataggagctgcccccaccaggcaggggggtaggtgagaatgggcatcttaaaggtgggagtgactcagtctggagttcgggaagggttttgggcagatgaatccgaggagagatctgaagggctctgggggttactgtggctaagaggatgagacccattggacagaggaaagagcagagaagacaccttatgggtgtgcagtgctgtgtgcctgttttacatccttgtattcctgtagcacctggctagacgccttattcatagcagtcacacttaaaacgtagatgttatcaaattaactatcaagtgaaagttcacttaaggactttcccagctcttcccctctgcaggcgttgaaaggacaggaacagaactttccggacacttcccttaccacgagtccacgttagagcaaggtgctgagggagggaggtcgggccaggcttccttttgagaacataagctggtgcggagggcgcgaggggagaggggtttgagggacaagcgtgccggaatccacgctgtcagtgaacatcactgggctgtaccagtacgtgtgactaccgaagctcgagccccgaacccagccgcttccctaggggtccagcagcagcgggcgcgaatcggcacattaccgggggaccgcggggcgctcaggactgcgacaactctgtgggttaccgcgccggcctagcggcccagcgacgccccccagcggccagagaaggccgcgcttctcggggttggcccacccaaccgctctgcgggtaggaccgaggagcaaagcattatcgcgagatcagggccactatttgagcgcatgcgcaagacatgctagtctcttttccggttagcgcggcgtgagaagccatgaggtgagttggtcctgaaagccctatccgcgttcatccgcgccttcaggtgccccgccgagggttcggatcctgtaggccgcgccgcggacccttgcgccacctgcgccgcggggcatttctcaaggcgggtcggcctgcgggtcgcccttcctaccaggtccgatcactgagagcctccctcttccaccggggcttgggtctgggtctgagctcccgtcgctctacttggtgtccggaatctacgggggagtccgccgtgggccgcccgcccgtctcgaagcctagacctcggaggcttccaggcagtccgagcgtgtggactccgcggccctgagcgccctgtcgcttctctcccgcagcagcaaagtctctcgcgacaccctgtacgaggcggtgcgggaagtcctgcacgggaaccagcgcaagcgccgcaagtgagtgccgaccctggggcacggcgcgggtggcgagggccggcgggtgcttaacccccctcctctctcgaaggttcctggagacggtggagttgcagatcagcttgaagaactatgatccccagaaggacaagcgcttctcgggcaccgtcaggttggcaccgttctgatcccacccagccctcagtgcccccgtgcttgcccctcccctgcaggctcccgctgagccgg

SEQ ID NO: 14053 - DNA, 4411 bp, Human
ctgagagccaccacaaagctaagggcaagtaagggctgaactttaaaaatgtaaacttacaagacaaaaggctcttttcagagccacccaccatttctacggaagaactgagcactctgttctccaaacctatcagaaatttgtggccgagttcaagcactgaggccattactttcctattgggtaaaataaaagtattgaatcaggcctagtaaatactatccaactgctaccttataacatgaaggaacctccttaattgtcccctccccacaaactgtcctgggtctttaaaaaacttggggccgggcgcggtggtttatgcgtccttagcattttgggaaactgaggcaggtgggtggggaggggagaaatctctagggacctggagttcgagaccaccctgataacgagacccctgcctcttaaaaaaaaaatgactgggcgcggtggctcacgcctgtaatcccagcactttgggaggccgaggagggtgtatcacaaggtcaagagatcgagaccacccaggcaaacatggtgaaaccctgtccctactaaaaacacaaaaattagccgggcgtggtggcgagcgctactaaggagacaggcaggagaatcgcttgaacccaggaggcagaggttgcagtgagccgagatcacgccactgcactccagcctgggcgacagagcgagactccatctaaaaaaaagaaagaaaaaaaataccaggcgcgaggccctcgcctgtatttggcggactgacagcagaaggaacacttgagtcccaggaatttgagatttcagtgagccatgacctcgccactgcactccagcctgggtgacaaagcgagaccccgtctcaaaaaaagaaaaacaaaacccaaacaaaagtatttctggtgatcatttgctcctgtgaatataataaatgttaaactaacctttttgttgtctttatgggtctttatcaataccagaacctggtagttctttgatcagctaaaatctccatcctaataaaatgctgttgtcagaactacccagattcactggcaaaaatctaatcactgacccaaacctgtaattccgcgcatgctaatgaaattaagcaataatttacataattaatccaatcagccattggattgcattaaactcagttaatgaagaggtcagataccatttattggtatcatttagtcaagcacctatcaaactccttccccacaccacactggacaaaactaaagttttggtgttttagagaatgtgccagcctaagtttaaattgtttttgttctgggtcttggtacagtcattaaaagatttaattaagcagttacaaaacggaactactttttggaaatactagcaaatacgttgttctactgtatgtatttttacacgatccgaaataggaaaaatgacccattggaaatgagtttaagactacgactgacctacacaaattctaggtcagattatcttttcattgggggaatcttaacatgattggttgaaaacaataaataaaagtggcgcggaggacgagcgcagtggctcacgcctgtaatctaagcactttggaagtccgaggcaggcggataacttgagatcaggagtttgagaccagcctggccaacatggtgaaaccccttctctactaaaaaaaaattagccgggcgtcgtggcaagtgcctgtagtcccagctactccggaggctgaggcggaatcgcttgaacccgggaggcggaggttgcagtgagctgagatcgcgccaccacactccagcctaggcgacagaattagaagccgtcaggtaaaaaaaaaaaaaaaaaaaaaaaaaaaagtggcaggaaccaaatgaagatagtattaacaaccaaccaggtttttcctacaacagttctgaccaatcaggatcagatcatcgttataaattctggtagaagccactgctcattcagctgcttgctttcagagcatagctttctcaactatggcccggacgaagcagacagctcgcaagtctaccggcggcaaggcaccgcggaagcagctggccaccaaggcagcgcgcaaaagcgctccagcgactggcggtgtgaagaagccccaccgctacaggccaggcaccgtggccttgcgcgagatccgccgttatcagaagtcgactgagctgctcatccgcaaactgccatttcagcgcctggtgcgagaaatcgcgcaggatttcaaaaccgaccttcgtttccagagctcggcggtgatggcgctgcaagaggcgtgcgaggcctatctggtgggtctctttgaagacaccaacctctgtgctattcacgccaagcgtgtcactattatgcctaaggacatccagcttgcgcgtcgtatccgtggcgagcgagcataatcccctgctctatcttgggtttcttaattgcttccaagcttccaaaggctcttttcagagccacttacattctcactgaggatagctgtcacaccattggtcgactgtcttaaatcaactttaaagcagggataaactggcggaaagtcgtcaagggttgttcattctgattccttgcagtgtcctttgtcttctaagacggtccttttcacttgtcctctgtgacccatctcacaagggtctcactttctccgaggaaagtcagcaaatctatatccaaggtcaatccgcttcaaggggaaagccaaagtccttcctgcacatgctgtcctttggggatagcatctccagaaccccataactaacaattagattacaggttaaatgagatgccatttttaactgaaacgggcactgcccttgggtcccctggaagcttgctgaaaatcacggacatgaggccggttgatttagcacatagacacgggagacttcaaaatgaggacccacccaccaatgagatacagaagtttatatatcaccttgagattatagaaagagtgcaagcttggaacctgggaaaacagattataggagggagaaaggaagagacttggctagcaaggggggcgggtcttgttatgtagatgaaaacacatagctagtagtcctcagaaaaaatagatggtaaatgtctcttgtcagggtgggcgtggtggctcatgccctccactttgggaggcagtggaaggaggattccctgagcccaggagtttgagatcagcctgggtaacagcaaaatcctgtctctacgaaaaacaaataaaaagaaaggtgggtgttgcagcgcacaactgtagttctagctgctcagaaggctgaggcaggaagattgcctgagcccacgagttcaaggatgcagtgaactatgattgcacaattgcactccagcctgggtgacagagcaagacagtctcttaaaaaataaaaataaaaaaggatcagactctcagttaatctctcctagatccaggaaaggactagaaagggaaagcctggcaacaaatggaaatttcccccacaaaagactgatttgcagggcctcatcggtctccgggccctgaggcagccatttcaaaatagggcaaagaaatatcttttggggtaaaatatttttatttccttcactttactttcctcaagagactgctttaaaggttaaatgcagtaatatattctagggccttggacagtgccccagaaaacacattaggtacacaaaaaatatttattgaacctgattttatctctgaatcttagtttggagtggctcttgtgggagactaaaatatgccaccccgaagtatactttgtcatatttcaagatggctattcagagaaactgcagaaataggaatagctctgaaaagctcttttttgtaaaagaattgtatacctatcaaggaaatctacattagtaaacagtggatgcaagtactggctttctctgaggctccctttcctgcctaaagaggaatctaagactgactcaaaggagagaaaactactttgtcacaggctgtcagctattctgcgattacctgagagactttatctacataacaagaaaacctttgcctttcctcccctggtgcctttgcccttcctccttcaccctcctacaacatgtgtcaccacctcctccaaacccccagaagtctcaagaccttttttctttctgtagtctcagaatggcataaaaacgtcaattatttggcccttctgagagagaaataatatagggtggtcacaagagaatagaagattccatgcagtagtttcacatgactagcaaaaaggaaactgttgaaatagctgcacaaactaggagccaaagagaccctgaaaaccgaaatgtttgccaagctggctaagtcctacttgacccaacatggcactggatttgacctagctttcacctgggaccttattatacactt

SEQ ID NO: 14054 - DNA, 22683 bp, Human
gcaacatggcaaaatcccatctctacaaaaaatacaaaaaaaaatagtcatgtggtggtgcgtgtctgtagtcccagccaccctaggagactgaggtgaaggatcacttcagctggggagggagaggttgcagtgagccaagatcatgccactgtgcgccagcctgggtgacagaggctggtgtctcaaaaaaagtaaataaataaaataaacttagatttcagtaagctatatttgggctgatttcgaattagatccaagttagaggcatcccttttagctgtgagaaacagctgatggcactaaagatgtttattgtatagaagaggaaacatggagcaatcaaatagttatcttcaaatatttgaaagtctgttaggtaaaataggaattcaacctattctaaactgttctgctttctgttccagaaagcagaattagaattcatctattcattcagctagtttttttttgtttttgtttttgttttcttttttttgagatggagtcttgctctgttgcccagggtggagtgcaatggcgcagtcttggctcactgcaacccccgcctcccgggttctagggattctcccgcctcagcctcccgagtagctgggattacaggcatgcgtcaccaagcccagctaatttttgtatttttagtggagacagggtttctctgtgttgtccaggctggtctcaaactcctgacatcaggtgatccgcccacggcctcccaaagtgctgggattgcaggcgtgagccactgcacccggctctagtatttattaaacacctactctgtcaagcaccgtgctgattcagaggaagaagttagaaggaggctgacttaagttcctaatagttaaagctttccaaaaatgaaatgaaatagactcaaagatagtgagttgtctgttctttgtgcaaacagaagtcaaactacttcttatcttggatgttatagagaagcctcatggtattgtatgggaaattggaccagataattgctaagatcttttcaaattctgtgactgagagaatgaaacggttcaaagacatagtttgcttctcactggtataatttatagtttggataaggctgagtagactttctctcagtggtcatagtaatttatagcttttattgtgttttagagctttcaaagcactttgtattcagcattcactctttcaaataacagttgtataaggggagatggggctactgaggctccaaaagagatgtgccttgccactggccacaggctatgaatggcagatttgggactaattcccaaaaatccagactttcactttcatgtgattctcaaggccatttctcctggaggctgaaccagtttataatgggttcataggaaatattaaaatttaatacagcgggaggtggaggtggaaatatatatatgtatttaattatatatctattacatatatataattaatacagatttccacatgctctgtaggactctatctccctctgagactcccccattcttcccagatactgagggagaccccatgggcgcaaaaccctattagaaagtgaaatttgggccaggtgcggttgctcctgcctgtaatcccagcactttgggaggccgaggtgggcatatcacatgagcccaggagttcgagaccagcctggctaagatggcaaaaccccatctctactaaaaatgcaaaaattagccgggcttggtgcacatgcctataattccagctacctgggaggccgaagcacaaaaattgcttgaatctgggaggcagaggttacagtgagctgagatcgcacaactgcactccagcctgggcaacagagcaagaccctgtctcaaaaaaaacaaaagcaaaaaacaacgaaagtgaaatttgatagtaggatgcaagaatcttgctctctgtttggtattctgttacctacatcctggccactaaaaagtgagtatccacaccctttctcattaccctgggtcaggagagaattgccaagcggggtcggaaactcgtggactatgacagtgcccgacaccacctggaggcagtgcagaatgccaagaagaaagatgaggccaagactgccaaggtaaaacaaaaacaacaacaaaaactggtaaactcttcctgttctccttctccccatggtggtagcaggtggctgggccaacatgggtataggaaattataaattcagcatccagtgtcctaaaggaaatctgtttcttctgacactgatgctgtaaggatagtcagagtcttgaggctggggagggcatggtcaggggaagaagagggatggctcctaaaaagcctagtgcctaaaaaaatgcagaggatgaaggaggcatgctgtagtactgggttcagaattgagggagattgtcttgtctcttttaccacctaggcagaggaagagttcaacaaagcccagactgtgtttgaagatctgaaccaagaactactagaggagctgcctattctttataataggtaatgactgaaattcagaaaaggtgcctttgcttcacacaaggcaccttgtgtgccttgacagtaagtagataaaagtgttttagatttaaattcccacactgccccgccccctttttttttttttcgagacagggtctcactctgtcacccaggctagagtgcagtagcactcaatctcagctcactgcaacctccacctccctagttcaagtgattgttgtgcttcagccacccgagtacctgggattacaggcatgtgccaccatgcctggctaatttttttttgtatttttagtagagatggggtttcaccatgttgcccaggctggtctcgaactcctggcttcaagtgatccccctgccttggcctcccaaagttctgggattacaggcgtgagccaccatgcccagccagattttccacatttaaagagaaatctaagcagaaactccatttgtatccttttttctttttattgtacaagagatgcattaatagaattatggtcagaatattttatattgtcacttattagtgtacataggatggagcctttttaatgaacacatgtattctaaaacattatgtgactcctaattaaaatgaaattgaaattttattttttattttattttattaattaattaatttatttattttgagacagggtctcattctgtcacccaggctggagtgtggctcactgtaacctatgcctcccgggttcaagcaattctcccacctcagcttcctgagtagctgggactacaggcacgtgccaccacacctgactaatttttgtttttgtttgtttgtttgttttgttttgagacagagtctcactctgttgccaggctggagtgcagtggcacaatctcggctcgctgcaacctccacctcccggattcaagcgattctcctgcctcagcctcccaagtagctgggactacaggcgcgtgccactaagtccagctaagtttttgtattttagtagagatggggtttcaccatgttggccaggatggtctcagtctcctgaccttgtgatccgcccacctcagcctcccaaagtgctgggattacacgcgtgagccaccgtgcctggccatttttgtattttttgacaggtttcaccctgttggacaggctggtctcaaactcctgacctcaggtgatctacctgccccagcctcccaaagtgctgggattacaggcatgagccaccgtgcctggcctagaaatgaaatttaatacagtttctttaaaagtatacctccttgattcacttacaggagaattccattaatgtacatacaggcgcagaagtcatcctgtattgcataaagggaaagaataattacttactgtaatagttataattagatagccttatatttatatagccctttaaaaaattattcaaagcccttttatgtctcctcagcccttcaagagcccaaatcagataactccatgaaactgttaaactttggtgtcagcctgagctgatattgtctcccctggccttcctgctcctaagaatcacgtgtgttcctggcccagctctgatgaatccagatcccagaacatcctgagtgtgggatgtgggatggctttctttttttattttttaaaatagagtctcgctctgtcgcccaggctggagtgcagtggcacgatctcggctcactgcaacctctgcctaccaggttcaagcgactcttttgcctcagcctcctgagtagctgggactacaggctcatgccaccacgcccggctaattttttttttttttagtagagacgggttttaccatgttagccaggatggtctcgatctcctgacttcatgatacgcccaccttggcctcccaaagtgctgggattacaggcgtgagccactgtgcccagcgggatggctttcatttaggagccttggtggctggttttggcttaagtcctactttgtatttcaaacaaagaactcctttcccatgccttactcgtatgtgtttgtggttttgcttcctaatagtcgtattggctgctatgtgaccatcttccaaaacatttccaacttgagggatgtcttctacagggaaatgagcaaggtgagaggtgtctggccaattgaggctcctaggtgtgttttctagtaaatatgaaggtagccttgacttacatgatttctttaaatatccgtattggcaccacagattttggcttttctctcatgatgaaataagagcacttgattgtgtacttaactgtattgaaacacatatatacactatccgagggccctcttcatctcccttaacaactgagtaagtgtgtccaaatttgagctttagcatgaataaaggaggttaggcctatagaaggaaaaattaaaatggggaaccccattgtgaaatatctatctattgttgctggggactggagagggcagtgtttaaggacaagtcagtttctcaggtggttggtctcaaataagactaatcctgtcagtgacaggcagccatataacataatttatgaagtcttttctagtcctgggattccaagattctttgctactacaacatttatattagttatattcacaaacagctatacatactactctccatagtttatttggctaaagtatgatttgcctagttaatattaaaaatgaggttttttggtttttttttttttgagacggagtcttgctctggcacctaggctggagtgcagtggcgcaatctctgctcactgcaagctctgcctcccaggttcacgccattctcctgcctcagcctcccgagtagctgggactacaggtgcccaccaccacgcccagctaatttttttgtatttttagtagagacagggtttcaccatgttagccaggatggtctcgatctcctgacctcgtgatccgcccacctcggcctcccaaagtgctgggattacaggcatgagcctgtaaaatgagttttacatttttaggcgcctggcctaaaaatgagttttcattccctggatcacctgtgagaagctagaacctcaaatcagacatcagttatggaccctgccttgagacagctgccagtctgatggaagaggcagaacttagaacacagagagacagggaagagggggtggcgggacaggaccctggactctaatgctagacagatgaagaggaattcacatcagaattgaaagggggaggttttattttgggaagctgtctgaaggggaggggagaagggatatgccactctcgggttcccagttggctagcatccccttctttcttattggctctagctgaaccacaatctctacgaggtgatgagcaaactggagaagcaacattccaataaagtctttgtggtgaagggactgtcaaggtgagcagcatccaagacttttttgcttcgcttgtcctgtgtgtgaatgtattcaacatcctcatctccagtccagaatcctgacctgtcccttatgtgcatgtgcgtgatgatgtttgttgtttgtactatgctcctatataaaatattttgctttttactaaatatatatatatatatatatatatatatatatatatatatatatatatatatattttttttttttttttgagacggagtctcactctgtcgcccaggctggagcgcagtggcgcgatctaggctcactgcaagctccgcctcccgggttcatgccattctcctgcctcagcctcctgagtagctgggactacaggcgcccgccatcacgcccggctcatttttttttttttttttttttgtatttttagtagagatggcgtttcaccgtgttatccaggatggtctcaatctcctgacctcgtgatccgcccgcctcggcctcacaaagtgctgggattacaggcgtgagccaccgcgcccggccactttttactgaatatttcaaggccagacaatggtggctcatgcctataatcccagtactttgggaggctgaggcaggagaattacttgagatcaggagtttgaaaccagtctgggcaacatagtgaaatctcatctctacaaaaaaagattaaaagaaaaaaaaaattagccgggcaaggtggtgcgtaactgtactcctagctactcaggaggctgaagcaggaggatcacttgagtgcaggagtttgagggtgcagtgagctatgatcatgccactgcactccagcctggatgacagagcaagaccctgtctctaaaaaaattaataaaaattaaatattttagacataaccgaacgtataaagaataatacaacaaatagccatgtacctaccatcaaatttaagaacttggctgttgtaaatatagctgaagttcccaatgttccttccccactcactttttctttctgaccccactaaaggtaaccgctatgttacatttagtatttatcatttctatgtgtgttgttttatgtgtgcatgtatgtttcacacataaaataatacgcatggaaataactaaatgtaatactaaatgtaacatgcacacactgtattgtttcacacatacatgcacacataaaatattgttttgcatgtttttggggggttttttttgttttttttttttttgagacagggtcttgctctgtcacccaggctggagtgcaatggcacaatcttggcttactgcaacctctgcttcccgggttcaagcaattctcctgcctcagcctccagagtagctgggattacaggcacatgccaccacacccggctaatttttgtatttttagtagagacgcggtttcaccatactggccaggctggtcttgaacttctgacctcgtgatccgcccgccttggcctcccagagtgctgggattaccggtgtgagccaccacgcccggctgttttgcatgtttttaaactttatataaatggacttatactgtatgtattgttctgcaacttcttttgttctcttagtgttgtttgtaagattttttgttattgctacatgttgttataatagctctgctgtttcctttctatagttgttactgtatgcctacttcatgatttatttatcctcctgctagtttggggcatttgagttgtcttctaggtttttgctattataaataatgttgtgatgaacatgttttacatttgtccctgtgaatattatcaagagtttctttagggtctatacttggagcaggattgttgagtcataaggtctgtcatggggcttcttgacctttaatgagatatttccatattgctctgcaaggtgataattccagtttaccacccatcagcagtgagtaagagccctcatgagtccacattctcactacatgtgaaattgtcagacttattcattcttacaagctcatgagtataaaatggaatttttttgcagttttaaatcatagcttcataattgctagtttccttgagcatcttttcatgttattggccatttaaggttcctgttctgtgactttcctatatatcgttttcccatttttcaattgggttgttgaccttttttaaaaaaatcgatctatgtaagtttttgtgccaggcacgatggctcacgcctgtaatcccagcactttgggaggccgaggcaggtggatcacggggtcaagagatcgagaccatcctggctaacacagtgaaaccccatctctactaaaaatacaaaaaaaaattagctgggcatggtggcgggcgcctgtagtcccagctactcgggaggctgaggcaggagaatggcatgaacccgggagtcagagcttgcagtgagccgagatcgcgccactgcactcccgcctgggcgacagagcgagactccatctcaaaaaaaataaaaaaataaataaaaataaggtggtttttttttggctgatatattctagattctaatcttggatgctcaaggataagcatggcatccagcacatagcagctacttgatagatgttatagttgattcttgttgttcatggtagttttgttttataaagttgccatactcactgaacatcaaaacacaggtttctgtgagcccctggtcacaacattttcatcaaccacccaacatataaccttgttttatgtgagtttctgtttaaagataccttatttaatatatattattaatttattaatattgaactcacaaccagcagcattgtaactcatgcctgaatgaagcttacctaataatacatgtattttctctggaaggcacatcacagtctttttgcacttagcactacagcttgggggccatttaaagtagcaaaatcaccagcaaaaagcacaaagttaggaaaacatggtggaaaggacatttgtttacagtttgagaacggaagcaagaaggtagatgattgccttgttagacttcatctggaaagtgcatgccaggcaactcattcttcaccacttgggcatctccaatagtgactgggaaagtgccacaagtattgatttgggggttccaaataaataagtaggtaattcacagatatgaaatctgtgtagttcaactgtatatcacccattaatctttgccccagaggaaatatttgcgacattttgcagtgtttctttccagtctctttctctgtacatatttttacataattgagttcatgatatagataaaattttggcctttattcatttcactgtataagtgttattgtaaattatgcaaactttctaacattttaaattgctttattcttttttttattacgtgcatcgtaagttttgcatatttacattgcttctggtttttagccgttctgaatctgaacaccttccttttttagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgagagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggtaagagtagttctggttgggtatttaatttaattaatttatttatttaagctagggtctcactcaggcgtccaggctggagtgtagtggtgcgatcacagctcattgcagtctcgacctctcaagctcaagtgatcctctgccaacagagatagggtctccttatgttgcccagactggtcttgaattcctggcctcaagtgatcctcctgtcttggcctcccaaagtgctgagattacagatgtgagccactgcacccggctctggtagggtctttatatccttttataacctccatgtaggtatctttactatagtcagaatactcttggacaccttttttggttttggggattgtttcatgtcttcatagctattaatttagtaatctacttttagggtaattgacttttttttgtttgtttgtttgtttgcttttttgagatggagtctcgctctgtcacccaggctggggtgcagtcatgcaatcttggctctctgcaacttctgcctcctgggttcaagtgattctcctgcctcagcctccagagtagctgggattacaggtgcacgccaccacacccggctaatttttgtatttttagtagagacggggtttctccatgtttattttttgttttgttttgttttgtttttgagacggagtctcgctctgtcgcccaggatggagtgcagtggcacgatctctgctcactgcaagctccgcctcccgggttcacaccattttcctgcctcagcctcccgagtagctgggactacgggtgccggccaccatgcctggctaattttttgtatttttagtagagatggggtttcactgtgttagtcaggatggtctcgatctcctgaccttgtgatctacccgcctcagcctcccaaagtgctgggattacaggggtgagccacctcgcccagctggtttctccaagttgggcaggctggtgccgaactcctgacctcgtgatccgcctgcctcggcctcccaaagtgctgggattacaggcgtgagccacctcgcccagccagtaattgacttctataaggggcttatctctagtagtgttaatgagcagattcttactaatttctttcttttcctccaagttctgggagttcctagtataaagaacctttagttgaagccgggcgtcgtgtctcacacctgtaattccagcactttgggaggccaaggcaggcagatcacttgaggccaggagttcgagaccagcctggccaaccaacatggtgaaaccctgtctccattaaaaatacaaaaattagccaggcatggtggtgtctgtagtctcagctacttggaaggcctgaggcacaagaacatgagaatcacttgaacccaggaggcagacgttgcagtaagccgacatcacatcactgcactccagcctgggcaacagagtgagactgtgtctcaaagaaaagaaaaagaaaaagttaaaaaaaaattaatacaaaataaaataaataaataaataaataataaattcaaaaaaataaaggaccaatagttggaatcctgagctttaccttctttagtgggggcaggagggtgggtctcacttcagttcattatacctgtgactatggtaaatagaccctgaaaaaaaatggcagcaaatttccagggtgtgtcttctctgatgagaagacctagaagcaggaactcacagagggaagtaaagcaaaaaggacagccttttgaaaaggctgctccttacttgggaggctgagacaggaggattgcttgagcttatgaggtcgaggctgcagtgagcactactacactccagcctgggcaccagaagtgagaccctatctcaaaaaaaaatttttaagtcttgaaaaaaaattgagagatgccaacccattgaagagcaactagttctgtgaaggatctgtaaatcaagtcatactcttttttttctttctttcttttgagacagggtctcactctgtcacccaggctggagtgcaatggcatgatcatgactcactgcagccttgacctctctgggccccagtgatcttccctccttagcctcccacgtagctggtactacaggcgcatgccaccatgcctgcctcatttttgtatttttggtagagatggggtttcgccatgttgcccaggctggtttcaaactcctgggctccagtggtcctcccatctccgcctcccaaagtgctgggcttacaggtgtgagccaccgtgcccggcctcaagtcatattctagtcacattatatggaaagactatcatatagggatttgacttgttctgtgacactccagagggcagaggcagaaactacatataaagacttttttttaagatacattttggaacaatacaagaggaactttcaacaattagctcaattttttaaatgggatgggaaaaaagtattgtggaagggcaaaggagacacaaggggctgatcaaaaaaaatatgggatgggccgccttgaaaattagttctctttccttgatgttaagagctaagggccgggcgcagtggctcacgcctgtaatcccagcacttcgggaggctgaggtgggcggatcatgaggtcaggagatcgagaccatcctggccaacatggtgaaaccccgtctctactaaaaatacaaaaagtttgttgggcatggtggtgtgtgccgtaatcccagctactcgggaggctgaggcaggagaatcgcttgaacccaggaggcagaagttgcagtaagccaagattgtgccacgttgcactccagcctggcaacagagcaagaccctgtctcaaaaaaaaaaaaaaagatctaggatagattatctccagtcaggtacattgtagagaggattatggtgaaatgtctgactagatggcaacaagatttattcattctacaattacttactgagcccctacagtgtgcctgggacttttctaggaggtggggtatgacagtgaacaaaacaaaataccctgccttcctgaggcttatattttagtgcggaagacagacaaaaaaaaagaataaataaaattacaatctagtaatgataagtgatatgaagaaaaattaagtagggaaggacacagggagtgggagctgagttgcaagtttatagagcagtcagcggtgacatgtgagcaatgaagaaggctagcacatgagccatgtgtatatccgggagaagtgtgtgagatttctgacactcgttagatcacaccaccctactactgcctgtgtctgaccaaggctacctcgggagcctcctgatatctgagaggagctaatatggaccaagggcacagggatggcccccaggtggaaggtgtgggactctctcctccattgttcactttgattcacaggttgcttcagagcctggagaggcaaagaagatggaagacaaggaaaaggataataagcttatctcagctaactcctcggaggtactaaaagcctaagtcatctacatgatgatgccctatttttttgtacattaaaatttatttttctttttccagaagtatatctttcagaggccttcagtcttgattcacatgaagcactgagggccctaacagagcaagatgtaaaacttgtcctggccgggcgcggtggctcatgcctgtaatcccagcactttgggaggcagaggcgggcggattcccaggtcaggagatcgagatcatcctggctaacacggtgaaaccccgtctttactaaaaatacaaaaaattagccgggtgtggtggcgggcgcctgtattcccagctactcgggaggctgaggcaggagaatggcatgaacccgggaggtggagcttgcagtgagccgagattgcgccactgcactccagcctgggtgacagagcgagactccgtctcaaaaagaaaaaaaaaaaaaacttttcctaggccgggtgcagtggctcacgcctgtaatcccagcagtttgggaggccgaggtgggcggatcacctgaggtcaggagttcgagagtttgagaccagcctggtcaacatggtgaaaccccatttctactaaaaatacaaaaattagccgggcatggtggcatgtgcctgaaatcccagctactgaggaggctgaggcaggagaattgcttgaacccagaaggcggaggttgcagtgagccgagatctcgccatcgcattccagcctgggcaacaagagtgaaactctgtctcaaaaaaaaaaacaaaaaaaaacaacttttccttaagtcaggctcactgatgcaagcctgtaatcccagctactcaggatgctgaggcgggaggatcacttgagcccaggtgtttgacactgtagtatgctacgatcacacctgtgaatagccactgcactccagcttgggcaacatagtgagatcccatctctttaaaaaaaatttaataaaaagatttgggtgcagtgcctcaacctcccaaggtggctgtaatcctagcactttgttgggggctgaggcaggtggatcacttgaccccaggagtctaagatcagcctgggcaacataggaaaaacccatctctacaaaaaatacaaaaattagccaggcgtagtgtcacatgcctgtggccccagctacttgggaagctgaggtgggatcacctgagcccagggaggtcaagggtacagtgagccatgatcacgccactgcactccagcctgggcaacagagtgagaccccatctcaaaaaaagattttttaaataataaaaatgacttttccttggtcagtttctagtctgaggcagctgtgctgatggagagagataggcaggacatgtggagagtgaataagtgcaggatagatgcggggttttgagtaggtaagcatagccacttctcatttttctgcactgaaaagagcaactcaatggttgaattgatttcaatttgattttataatgtattatatgattttagatggagacagtaatagagtgactttttgattgcctctggggaatgataaaacaagcttgcattcttggagtcatctttttgaagggaggagtttataggagccaagactctttctgaccattttaagaaacaggctagtaacactgtcctccctggaaaagaggtacaggatacactctccttccgcctgagtctgtctccttatattttagatttataatatttccttactcttagcctctctggtgggattgctttggtcatcagctaaggagaaatatttttcctgtagaattaagcaactagagcatcttagatcctagcctattcgtgtcatcaatcctctgaagcctgtgtatgctcacttcccttgcagatgcattataaatcatattttctctcaggcagaattatggacatgtcacatgtaaaaatgggtaaatataaatataactgggaaaaaacatagccatttttgaaaaaaaattactgggaaaaaatctgttcttgcttaccatttgaatcatctcagagagatggaaggttttgataactttccgggaggtgatgtaacatcacctctgagctaattcatgacctggaaagggaggagggagtaaaaagaaagaaaatgtccttgaaggagaaatcttggaatttcaagtggctatcacactgttagaaattggttctgttggccaggtgccatggctcacacctgtaatcccaacactttgggaggctgaggggagtggatcacttgaggttgggaggttgagaccagccttgctaacatagtgaagcctcatctctactaaaagtcaggcatggtggtgggcgcctgtaatcccagctacttgggagactgaggcaggagaatcgcttgaacctgggaggtggaggttgcagtgaaccaagatcacgccactgcactccagcctgggtgacagagccagattccttctcaaaaaaaaaaaaaaagaaagaaagaaaaaattaaaaagaaattggttctgtttttaaaatatgaatttatagtttgtaaattaaatttcatgttttaaaaacttattttaaacctcacagggtcttcccctagcatagcagtttctaggcagggctttctttctttttttttaaatttatatttttagagatgatctcactatgttgcccaggctggagtgcagtgggtattcacaggtgcaatcatagtgcactgcaaccttgatactcctggcctcaagtgatcctcctgcctcagcctctcaaggagctgggactacaggtgtgcacccctgcatgtggtctagactgggcttcctacaccttgggttcccatctcagaacctaaaatttttcccaaagaaattattttaccacttgcttctcctaactgcgtgtcatgaattaggatcacttaagtgtgagagttgcagtacattcttgaggacggttcatctaaaagtggcaggtagtaattttaagacctcgcactcccttatagatacacatccacaccatgtcacacagattacatggtgtttgatcatggaaacaactcaggaattcaaagacctggtttcctgtcccagcaagtctttttaccctttgaatcttagtttattcatctgtaaaagaggatggatgaaagcctttcccgatgccttcaggctctggtgaaacaacactgtattttgccctttgtaatagtacaaatactgagacccttgtaaagtataaggcacagaagacacttctatgctgagaggctggaaaggttgagccacctcttactggcagaactcttctctttgtagggccaagaccagcttcaagtctccatggtaccagaaaacaacaacctcacagcacctgaacctcaagaagaggtaagaccagatatacagagaatagattgggcattagattgacaggggtttgggaaaaggctggaatcttcaccacaggctacaaggggaatccggcagtgaaccatacccttagggcagtcaagcaggtgggaatcagaggaaacaagaatgaactgggacttcgtggtatctccgtgcccattttcctatacttgaccttaaactggccctatcttctaggtatttatttaattaaatctcaaattatttcaaaaaggagttaaagaggttaagatattttttttaaatgcaaaaaggtcatattatacagtaatgtgttgctcaacaacaaggatatgctctgagaaatgcattattagacgattttgtcattatgtgtggctgtatggtatagcctattgcttctaggctgcaaacctatacagcatgttactttactgaattctgtaggcagctgtgacacagtggttaatatttgtgtatctaaacatagaaaagtacagtaaaaatagcatatagaaaataaaaagtgatacacttgtatagggcactatcatgagtggagcttgcaggagtggaagcttctctgggtgagtcagtgagtgagtggtgagtgaatgtgaaggcctaggacattacttacactcctatagactataaacactgtacacttaggctacaccattaaaaaatatttttcttttcttttttttttttttgagacggagtttcactcttgttgcccaggttggagtgcaatggcatgatctcggctcaccgcagccttggcctctgggttcaagcaattctcctgcctcagcctcctgagtagctgggattacaggcatgcgccaccacgcccagctaattttgtacttttagtagagacggggtttctccatgttggtcaggctggtctcaaactcccgacctcagatgatgcacctgccttggcctcccaaagtgctggggttacaggcgggagccaccacacccggccaaaaaatattttctttatatccttattctgtaagctttattctgtattttttctgtttctttttaaaactttttttgttaaaaactaagacacagagctgggtgtgttgtggcatgtgcctgtagtagttccagcgatgcaggaggctgaggcaggaggatcacttgagcccacgagttcaaatacaacctgggcaacatagctagacaccgtctataaacaagtaaataaaaacacgcaaacatacacattggcctacggtcaggatcacccatatcactgtcttctacctttacattttgtcccactagaaggtcttcagggaactaccacaaatggacctgtcatctctggtaataacaacgcctcttcctgaaggatctacttgaggctgttttacagttaatgttttttttaaataagcagaacttttttttttttttttttgagatggagtctctctcggtcgcccaggctggagtacagtgtacagtggtgcaatctcggctcactgcaacctccgcctcctgggttcaagcgattctcctgcctcagcctcctgagtagctgggattacaggcggtggcgccaccatgcctggctaatttttgtatttttggtagagacagggtttcaccatgttggtcaggctgatctggaactcctgacctcatgatcctcccgcctcagcctcccaaagtgctgggatgctgggattacaggtgtgagccaacgcacctggccaattagcagaactttttttttaataagtaggaaacacactaaaataataataaaaagtattgtaggctgatgtggtggttcatgccagtaatcccagcactttgggaggctgaggcaggcagatcacttgagaccaggagttcaagaccagcctgaccaacatggtgaaactccatctctactaaaaatacaaaaattagccgggcatggtggcacgcacccgtaatcccagctacttggaaggctgtggcatgagaacatgagaatcacttgaacccgggacaaagaagctgcagtgagccaggattgtgccactgcactccaacctgggcaatggagtgagactgtgtctcaaaaataatatatatagaaaaatatttttaaaagcatagtatattaaatacatcaagtaatatagttgtttattgttatcaagtgttatgtactgtacataattgcatgtgctatactttttacaactggcagcactgtaagtttgtttataccagcatcatcacaaatatgtgagtaatgtgttgtgctgtgatgttataaaggctacaatgttaacaatagctgccacatcactaggcaatagaaatttttcagctccattaaaatgttatgggaccacctttgtatatagagtccattgttgatcaaaatgtcattatgcagcatgtgaactgcatatatatatatatgtttattatattaacatacacacatatacacaacatacagcagaaaaactcagaattatatgagacaggatagtgatgtaaaatggagccatgaattaggcaagtataaaaaatgcattctataaaataagcttactaaggatgaccatgaaattggttccagactttctaaaatccaagaagagaaaaacctgatcagttaacccaattcacaatgctcattccttaaggaggctaggtgccagggctcacacctgtaatcccagcactttgggaggctgaggtgggaggatcacttgagcccaggagttcaagaccattctaggcaacaaattttttttttaataaattagccaggcatggttgtgtgcgcctgtagtcctagctactcagaggctgaggtgagaatacttgagccctggagttcaaggctacagttagctatgattgtgccactacactccagcctgggagacagagcaagactatgtctcaaaaagaaaaaaaaagaaattctcctgtgaatcatcataaagatattgtgaatgatgtaatgaacaatatctgcaacaagtccttgcaataatcccaacaaccagtttcacattgcctccctcaagagaggccagtggcattacatgaagtataattcagtagaagcaaactgagtttaacccctccataagtggttggtgggaaggcaggtcaacacctaacacaatcatgtttactttccaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgactatctgtggattgtttatttgacaaagggcattgttgcaacccagcacactgttttccacttaggtatggttattgattctgccccaggttcagaaaggtttagtcacatccctgacccccagctcaccctaactcctgactgtaattcttttatgataccaagggccacagactcttctccttaatcctgcatgtgctccccactccccactttggttgataaacagatacacttggaaaggggtaataacattttagagctatatctggtgtttacaatttagtacttggtatgagtaagggtctgagcacaagagaggaggatatgaaactgaaaggatacaaagtataataataacaatcatatcggctgggtgcggtggctcacagctataatcccagcactttgggaggccgaggccggtggatcgcctgaggttgggagttcgagaccagcctgaccgacatggagaaaccctgtctctactaaaaaaatacaaaagcagccgggcgtggtggtgcatacctgtaatcgcagcaactcgggaggctgaggcgggagaatcgtttgaacccaggatgcggaggttgcagtgagccaagattgtgccattgcactccagcctggggaacaagagtgaaactgtctcaaaaaaaaaaaatcctatcctagaaatggcatgaaatttggagtcagaagtcctggattcttttgggaggccaacaggggaagactgcttgagcccaggagttggagactagcctgggcaagatgatgagacctctatctcttatttttaaaaaaaattttaaagggctggatgtggtggctcacacctttaatcccagcactttgggaggctgaggcgggaggataacgtgagcccaggagttttacaccagcctaggcaacatagacccccatctctacaaaaaatttaaaaactaggccaggcacggtagagcgcacctatactcccagccacttaggaggctgaggagggagggtcactccagcctgggaggttgagtctgcaaggagcaacgatcataccactgcatgccaacctgagtgacagagggagactctgtcttaaaaagaaaaagaaaaaaaaaaaaaaaggccgggcacggtggcttacacctgtaatcccagcactttgggaggccgaggcaggtgtatcacaaggtcaagagttcaagaccagcctggccaacatggtgaaaccccgtctctactaaaaatacaaaaattagccaggcgtggtagcgcacacctgtagtcccagctactcaggaagctgaggcaggagtattgcttgaacctgggaggcagaggttgcagtgagccaagattgcgcagcctgggtgacaaagcaagacactgtctcaaaaaaaaagaaaaaattaaaaaaggaagtcttggattcaagtcctatcattactttatatgaaaatatttgtgacattttcaaaatagctctgaagtcctgccaacttgataaatgccacataaatgccaaaacctttccatccttgctcttgtttttagaggtgatgatatcaccattcgttcagtcattctgcaagcatttactgagcatcaaccgtctaccaagcactgagtaccagtactaggaaccagggaaacaatgatgaggggtgttaaaaataagatatttaacgagacagaatattgagcaaggagcagaatgggcaagatttagtgatgggctagaagggcacacatgatgaaaagtgaggtgtttttcttttgttttgttttgttttgtttgagatggagtcttgctctgttgcccaggctggagtgcaatggtgcaatctcggctcactgcaacctccgcctccctggttcaagtgattccctaagcctccaagtagctgggattacaggcacacaccaccacgccctgctaactgtatttttagtagagatggggtttcaccatgttggccaggctgatctcgaactcctgacctcagg

SEQ ID NO: 14055 - DNA, 22683 bp, Human; identical to SEQ ID NO: 14054

SEQ ID NO: 14056 - DNA, 18229 bp, Human
aagaatgggtgggaattagcgggggcctgagagggaacctaggagatggatctttgctccaaatgccactccagggctcttctcaatttgggcaggattgggcaaggctgggggaatagggatcaataggattttacagagggtcaagccaggcccaacactagcccaagtagcaacactgggtgaattaaaaaagcatcccttccttaaaattcttttttttttttttttgagacagagtcttgctctgtcacctggactggagtgcagtggtatgatcttggatcactgtaacctcctcctcctggggttcaagcgattcttctgcctcagcctcccaagtagctgggattacaggcatgcgccaccacgcccggctaatttttgtatttttagtagagatggggtttcaccgtgttggccagactggtctcaaactcctgacctcaggtgatctgcccaccttggcctcccaaagtgctaggattacaggcatgagccactacgcctggccttcttttttctctttctttctttttttttttgagatggagtctcgctctgtcgcccaggttggagtgcagtggcgcaatctcagctcactgcaagctccacctcccgggatcatgccattctcctgcctcagcctccctagtagctgggactacaggcacccgccaccacgcccggctaactttttgtatttttagtagagagggggtttcaccgtgctagccaggatggtctcgatttcctgacctcgtgatctgcccgcctcggcctcccaaagtgctgggattacaggcgtgagccaccgcgcccggccttctttctttctttcttttttagacagagtttccttctttcacctaggctggtgtgcagtggtacaattctagctcactgcagcctccaactcctgggctcaagtgatcctcttgcctcaggctcccgagtacctgggaccacaggtgaacgccaccacacctggctaattttaaaatttttttgtagagacaaggtctcactacgttgcccagactggtcttgaactcctgggctcaagtgatcctcccgcctcagcctccaaaagtgctgacattacaggtgtgagtcactgctgcaggcccctcaaatccttcactgccatctgggaaatgatcacaacagctctacaaatacacaatgattacaaggaatggtgccccactggagttgttcaacgcaaaacttgcacattgcaagtggcaatctcccaggcctgcctccctccacgagtgggtctgaatgggcctgagaggcaaacatccaagaaggaggaagaggctcggcggcacctccctccccgggagttctgctgattccatcttggggaagcagggtggaccagggcccaaatgcgccctggggagattgcgggggcgggagaggttgcaaggggcaagtggcaagagcctgttaacgtcttagggcctccaggcctttctgtgcccctagctgtgcctgtacgctttaccccacctcaggaggcttggtctccagcggttgaggctggaagcaccggggtgcggtggaaagggctctgtccaggaagaccggatccgcagagccgggagtccgggctaggaagtccctttctcggtgggagactgaggccgccttggcggggcgggacgagactcctccgaggtcgggaaagggggccccgcagcagccccttggcttcccttctcccttgcctcccctccggggctccggttcagaggcactctgggcgcctgctacagcttccaaactgcgccgcttccttcttcggcagaaaaggactttcagatgcggcggcggcggcggcggcgactcaggacagcgccccctccccctaacggccgcctctccctctccccctcgcccgccccggctcccccacctctgggaaggcgctgggggtgtggccagggaccggtataaagtccgggggagccggtcccgggcagccgctcagccccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctggtaaggtacccctggcctcccaattccctcctgagtgcgctcccttcccagcggcttcttccccattccagccgccctggaaggcccttaaaaatcccctatgagttgaagagaaggcaggtacgtggcagggcccgactggcatgggacaggctcatcaaggaaactgctaccgagtccctagcagcctgttgccaccaccaagggagactgtcccatcgctccatctcaaacctccaagggttgtctgtttgataagggggtcccagtgggaggcctggctgctggtgcaggagtggcagattaaggtccagttaagtcagctgtctagggccagagaactggaggatggtggtggggtgtgtgttggggaggatgagggagtggggaaagctttctgttcctgatccaggccgagggtgaaatcccagtggtctggggagccagggcctgaactttttttttacatggtccagtggtggagtgggacatacaaattagagggactttggcgttgaggggcattagacttgcccttccccaaagcccagagccaggtcaccttgttgtttgagaggcagtgggaagacaggggtccctctgccaggcctggacacctctgcctgccctggtatacaggccccctgttcttttctccaggcaggtaggatttgaggtggtagaaaagtcttggctcctagccgagagctgcaggagcctcatgtgtgtgggatagggaatagagaaggggccagggcgccaggggagagaaacagagagagagagagagagagagagaaacacacacacacacacacacacacacacacacacacacacacacacagagacagagagagagagagagagagagagagagagagagagagagagagagagagagactctgagaaggcccttgccctaacctcattcttacactttctttttttgtttctcagtttctccttagactctcagtctcttttccttctttctcttgctcttttgttcttcctgatttgtctctcaacctctagtttcactagtcatgctctcgagttctgttttcctcagtgtcttctgcccatcgtgcgtttctttctccaccttattctgtgtttctgtttcagttgctctgcttctctccctctctttctgttgctgtttctctgtgtctctgtcactgttggtctttccctgttactttgggaatctctctgtctgtctttctgtatctatgcctctgtttctcattccatctccgaccctgttttgctctcctgtgcctctgtctgtctctgtctcttttcctggtgcttgaagcttccattgttgcagtccggatgctgggactccagccccaagcttcctgtcctgggacccaaaccctccacttcctcaatcctctgcagcttgtcagccgaggagagcaggatgcagggaaaacaggaaggaggtggactccaggggtctgggcctcgggcctctctgcccttcctgcccctgggtagggagagatgggtcagcagaaaacattctaggagaaatgccagcctggcacccagcatatctgggaaggggggtcctgggggagaaagtcgctaatcttggggcagagatgccagtggcaatggtagaggaggggtactgagactgggagggagcaagggccgagcccttgggttcgcggggtacaacagagtcacgttccctttgaatctccatcctccaccagccagagggtatctggcaccagataaggatggctggtagcctcctcctctctcagcactttgaatgcaagacagaagagccctcaaagggctgggtaggaatacctcatcctctggttgggtaggaatactccatcctgtagtggaggaaaataagatcccctaggggtttggggagggcatggcatgagaattttgtggttgtcctctggatataatgcaaactggcctccaggaatatctaggggctgggtgtggaggttcatgcttgtaatcccagcactttgggaggattgcttgaggccaggagttcgagaccagcctgagcaatatagccagacccccgtctctacaaaaaaaaaaaaaaaaaaaataggcaactgcagtggctcatgcctgtagtcccaggtatttgggagtctgagatgagaagttcaaggttacaatgagctatgatcacgtgattgcactccagcctgggcgactctatttcgtaaaaaaaaaaaaaaaaaaagtaggccgggtgcagtggctcacacctgtaatctcagtattttgggaggctgaggagggtgaatcacctgaggtcaggagtttgagaccagcctggtcaacatggtgaaacctcgtctctactaaaaatacaaaaattagctgggcatggtggtgcgtgcctgtagtcccagctacttgggaggctgaggcaggagaatcacttgaacccgggaggtggaggttgcagtgaaccaagattgtgccactgcgctttagcctgggtgacagagcgagactctgtctaaagaaaacaaaacaaataaacaaaaaaaacaaaaaacggtgtcttggaatggggtggctttaggtcccctttggatgacacagccaaggtctgtaatgcccctccccctttcctccttgccttgtcctccagcctccagccatgcaatggatgcaggtatctggagagagacgagggaagcctggaggtacctactgagcaagctatgcccgtgccctcccacacctcctagtcatcatagaagtaatcccttgctgtgacctgggccacatggcaccatgtaaaaggcactctctagagttctgctgcagccctgcagggtctgtgggtgagataagacgaccaagcccctacccacccatctttttagccttacacagtcagtaggccactgtctgctttaggtcccaaggtttgggcccactggcccgcgaatagcttggtcgagggtacctgtctattttttctgccttttccttttggggctgagtgtcagcaggtggctgggggagggtggccacttggcatgcccccttctttggctgctatggtccagctgcctcctgtttgccccaggggcagatctcccctttccgtctccagccacccctgcctgccctcctgtcacagctttccatgtgctggccaggttgtggcttaacaccactgaggccaccagagatgaggcggggcgtgtgcatcaaaagtccacacctctgcatcctggtactgatcctagactcatggaatctgggggagtggacagcggaaagatcagcgtttggacggggagttcctaagctgggctctcagtccctttgggacagggttagggaacaggcaggctgggttaatttttagtcaatgcagcaaattctgcccccctacttcagtactgggaatccagttatgtcatgggaacaagggcattcccagaaattctgtgccttgtggggagggggagggaggagcatggccgcttcccatttttaatttagtactggcaaagctagcagtattggtgcctcgggtatcaggagtctttccacttaaagacagagtgctgcagagctaagtctctcctcctccccttccacccagtctacttcattttcctaatttttaaagtggggagggcaacaggacctgcctcacagggttggggcgtctggcatcgggtaagagctcaataaattgaagtgatgaggaagatggtgatgaagaagctgatgctgggacttagggaagcggtaggacgagggagcaaatttggggcaacattcagaggagttgagaggggtggggtggcctttggtgcattttgctgctgtcaacatgggaagaacaggccaagttgccttatctgttttttattctgaggctggcagcatgacacagctgttgggggtgataccccttgagccagacctcagagaaagggcctggtacccagcaccagcggtcttggcttctccagctagagtctaggggaagagggaaaagacctttctagcaggacaggtgggtgaccctctggatcacagctgaaacttctggtcgggatggctgggcccactcagttcatagcctaggtgtctctcgagggccaggggctggcgttggggagaaattgtgagggtaaaatcaggcaacaggaaagaggaaatcctctggctttcgccacaaactttgcagccggtggtgccaaagccgtgtggcctcttctctggcgccttcccttcctctgctgctggagcaaagaccgaggtttcccctatagtcagatgtcaactggcttagctccaagctgggcgctgtaggaggaccaagcctacttggaagtcccatctcccaaacaagctttttggaggtcagacttttcaggggaataggtctgactccactcctgctcagaggggaacccacaggcattggaatttctccagagggcactaccaggatgagtagcaccaggtggctggaactcttgtgtgagcagggaaatagcaagtatttagccagttttggagatgagaaggttaacgttatcaagagactcaatgctataacccttacccccacaaaaacctggtgcttaggggtggatcctggggtggctcttcagtctgccagttaagcagggttgggcaaggaaaagttacagattacatggaaagtcaacaaaccacggtgcagagaagctgttgaagtcagcgtgccctgccctggctctgtgtctctgaccagggcagggtcagagtgcccaagtgcatgtgggtaaggcacatgtggatgaatgtgtgtctggacacgtgattgtttgtgtacacttgcagttcttgagcctgagcctgtctgtgtgagtaggcaaatacggatttaccctgtgtccccatgagactaaggagggagctactctccctatctggtgggtgctactccgtgtagacatgaactggggataagtaggatggctagtggggaacctaacaagggagaagccaggcagtttgctggcttagcttttcgtaggtaaccctctgatgtgacatggggccataccaacccaagagcataagccatgcctctggactcaccctgtgccccatgcagccctaggcttcagtgagcatacctaatcctccttaatggtaaacatcccaaatatccattaataatcctctgagggttagttatttgtgaactttgactcgtaaaagctcagcactgtggctcacgcctgtaatcctagcactttgggaagtctaggcaggaggatcacttgaggccaggagtttgagaccagcctgggaaacacagtgacaccctgtctcttaaaaaaaaaagaaaaggccgggcgcaatggctcatgcctgtaatcccagcactttgagaggccgaggcaggtggatcacgaggtcaggagatcgagaccatcctggctaacacggtgaaacttcatctctactaaaaatacaaaaaaattagctgggcatggtagcgggcgcctgtagtcccagctacttgggaggctgaggcaggagaatggcgtgaacctgggaggtggagcttgcattgagccgagatcgcgccactgcattccagcctgggcgacagagcgagactccgtctcaaaaaaaaaaaaaaggagagagagagagaaaaagaaactcagcatggaaagcatagttgtggtcatgcttctattccatatctcttgagatttttgaggctgctaccaccctaattctccacacttccagggtgggagctcactacctcctgaaaactcttcctcactccttgaactcctgaaaaaccttcctcactccttgaaccaaagaatattctacccatttactgagaggaatgaatcattgtacaaaatagtgcttgcttttttaaaattttgagacagggtctcacttgttgcacaggctagagtgcagtggtgtgatcactgctcactgcagcctcgacctcctgggttcaggtgatcctcccacctcagcctcccaagtaggtgggactacacctgtgcatcaccacaccaggctaattttttgtagagatagggtttcactatgtttcctaggctggtcttgaactcctgggttcaagcgatccacctatttcggccttccaaagtgttgggattacaggcgtgagccaccccagctggcccctagtactttcttttatggtcattaaaagaaagcaaactcaggaaaaacaaaggctttccaggttggaagggtgccccctggtgttagtgtcctgggctgtggcaaacaagtccaggtgatctccagccctacttaagtaacagggtggggcctttgtccacatctcagctcagcctctgtccttctgacatttggttctaattctttaattcttgaattttttttttgtttttttgtttttgtttttgttttaagagacagggtcttgctctgttacccaggctggagtgcagtggcacaatcatagctcactgtagccttgatgtactggggtcaagcgatcctcctacctcagtcttctaagttaggaccacaggcaggtctgactaatttttttttttttggtagagacagggtcttgctatgttgcccaggctagtcttgaactcctggcctcaagtgatcctcccacctcggcctctcaaagcactgggattacaggcgtgagcacccagcctggttctaattctttgaggtcttccatttcctttttctctccactccccagttccagcttacacccctgaaacacggtgactccatcctcaagccttatggctttgtgcaaggtgggggtgtggagggaggtgatcactggggcagcttaggtttctttggctggaggaattccttgggagggtctcaaaggaagggcctggatcccagatctttctctggttcctaaccgagggctcaggatccatctccttatggtccccttggcacagtcctcgtcttctgaagtttatgtttcttcttttgctgcctaccttggccagggggtcttgctatagtgtcttctctttggttgactcttaggaacttgatgtaggactggagtcccctctggactgtccttcttgggattttaaatgtgcagaaggatggattatatctgtctactctatttatttcttcccttttattcctcttttctaagccagctctccaccgtaacaaaatcttcttccatccttggtgaattttattaataacctttggtgtggaaggttattgataaagactttctggttagattcctccttgcctggtttgcctttatccacatatttctccccacaccccccaaaccaggagaatgaaaagagaaccaacccccccagctttggctaggcagaaaaataccatttgacccagaggcagctctgggatcgctgccacgcatggaggaacctgctaactcctcaggaaaaaaaaaaccctgacgcaaaccagatgtaacctcctgtccggctgccaacatctggaatgctggcaggggctttgcactcaggccggcagcgagctgccaagcctgagcatttcagaggtggctctgatctgcagagaggtcttccaacctctttctccagctcagccctgtattctggttttgactgcttggagggaggagcagtggttacagttctgggactcaagcatggggtttttcttttttaaaaaaatgtattttattttattttatttttttagagacagggtcttgctctgtcacccaggctggagtgcagtggtgtgatcatagctcactgttaacctcgaattcctgggttcaagtgatgctcccgcctcagcctcctgagtagctaggactacaggcacatgccaccatacccggttaatttttaaattttttgtgaagatggggtcttgccatgttgcctaggctggtctcgaactcctggccttaagtaatcttccctcctcagcctcccaaagtgttgggattacaggcatgagccacaatgccccatttggatggagtttttcttgagctcagatagagccttcaggagatcccacagaggggttgaaggtccagcctcatcactcccgtctccagatccctggtgccctggttctgggcaacccctatggactttggatggagtctgaagtctaagaatgggaaacttcgaggtgggggactgaaggaatgtgtgaggctgttcttgtggtcctggggccacacaggttgtgttacacacacactcacacacacactcactcttcctcatgcaggcggatacactaactcccacttctctcccactcagccaatggggagagccttttgggctagagttctcattgctcatggaaactctgattcaggccatttggaagagggcgagcagagtccacagccctggggatcccctggctggctcagccagacaccgaaaaaatcaggagaggcaacagggagaacgatcagatggagaggggaatggtgggagctgaatggaaaggggacaggatccagcagggggtccccctgcctgcctcagacctccctgcagggcccaggggaccctcctgccatctgggcagctgcagctggtgactcatctgagcgctggcctgagtggggtgagggacaagtcaaggacttcaagaggaatattctcctgagagatccaggggagaggggaggaggtagggggctgctcttgtttcttcccgctccccaggccccctgctcttctccagcgccaagccgaagaatccccaggaaggagaacgtgggtgggaggctgggttggtgtgacgctctgacctcttccggtgctgacctctccttatcgctacctgaatacagacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtggtaaggacctccgatgcacaaatgtgcatgtgcatagacacacacacacacacatgccccctgccccccacatgcacgcacccacacacaccatcaccaccagatctggggcgtgttcattcagcacacattctagggtgactactgtgtgcaaggtgcaactagtgtgagtcatcaggacccagagaaagcactcattcccttccttgggattcctttcctgcccatcagttatatacatcggggcagcttaagtgattattaaatactgaaaaacttctataccaattggtaaaaagcagttacccaaagcgccctggggtttcttggccttttttggattccccaccccagaccttctcagtaaccaaagggtaatgctggccatagcagggggcctgggaccctgctccagggtctggctaatttcccttctgaaggtcttacaagttgtcagttggaagttttatctgtcccttctgcatagaaatcaccccctccctggctttctgcataggttcccacagcccctttccccacagtgtcccctcacttcccacccctcctttgaagaagctctttggctcgagaccctttcctccacgtctctaccctcccagtgtgtcctccagacccaggcctctctcttcacctcactgggtcctgcccagcccctggggctcaggcctcctttcggggccttcagttctcacttagctctgaccccaggcctgggcctcctgcctctcttccttctgctgagcaattttgtcttcccctcctccagccccagggctcctgccagagcgagctgcaccgggcgctggagcggctggccgcttcacagagccgcacccacgaggacctctacatcatccccatccccaactgcgaccgcaacggcaacttccaccccaagcaggtgggtctctgtctcccgctggcttggccctggactcagctctggggcatttccggcctctccgcaggatggtcctggatggagatctcaggaaggggaaactcctcaaccccaacccaaccccttggagcctccctaaacctacctcagcgtcagaacctcactcattttggagatgaggagactgtgatccagagaggagtaaaagcgccgggctagtccagagtcatagaacaagttaacagcagatcttgcctccctatccagggcaatttccctcacccctggatttcaccatctgtggtgcagacctagcaaccctgacaacctctggctcccaacactctctcgttcactctactctattcgtatgagtaattcctcctgtcactgagtgaggtttcttctgggaatggagggccaaagtcatgaggagtcagggaggaaactcagcctacccctccctgcaaggcgagtagcaaaaccacctggggtacagcaagagtgaaggtaaaaccagattggacggttggagacaggcactttgggtagaagcagaggaaggagtggggcaggagagaagacacaaaggcagcaacttccctattccttcctgcccttggaagctggggtcctctgacaagcctccaggaggctgggatggtcagcagggttggcctcttccagtctatctctggcccatcagaatgggtggcctgtctgggcagggctctggtgtgcctcctgctgggtgttgcctggggaaccctagcctggagctctttgtcgacgtagacagacccatttccctgctccatgagctatagacaaatccacaatttgagctgccactctgccagcagaagtctagatagaaggacaaaggttgccctgagtctgtgcatcccaggatggcatgaaaagggtatgagtgaagggacagagagggcaccccaaaaccaatgcccagcctatttctaacctttatcctaacacgaattttatccttgtcccaatttaaaaaactttttctcttaatttaaaaaaaacaattaatagctttattttttagagtagttttaggtttacagaaaacttgagcaagagtacagggtttcaatgtactgtcatccaccccagtttcctcattattaacatcttacatttgttgcaattgatgaacgaatattagtatattattattaattagtggtttatattagggttcactttttgtgttgcaaaattctatgcattttcttctcctgattttttttttaaaggcaggatctcagtctcccaggctggagtgcagtgatgcgatcacagctccctgcaacctccacatcctgggctcatgtgatcctcctacctcagtctcctgagtagctgggaccacaggcacacaactatgtcaggctaattttttttttttttgagacagagtttgtctcttgttgccgaggctggagtgcaatggtgggatctcggctcactgcaacctccatctcccgggttcaagcgattctcctgccttagctcccgagtagctgggattacagttgcctgccaccacacccggctaattttttgtatttttaggagagatggggttttgccatgttggccaggctggtctcgaactccggacctaaggtgatccacccacctcggcctcccaaagtgctgggattacaggcttgagccactagcttcttcctctgatttttatcccattgaaagttctgacacttgaactttatccccagaccagttctgatccttaagctatccttcactccaagattaattctcacactgaaatatacatttgcgccccctgaaccttctactatctaattttgacccaaaatttagcttaactttagttattctgaccttgacctctgtctttatcccaattgtgtttttacctgggctttaaccctcacccaactcatccagctcaacttttagtcatatttcctcattcaactgcaactcttaccctggtcctaccttaatcccagcttggatccacctcataactataatcccattcttaaagtcccaacccaatcagaatatgtacccaaaacatctccaacctgaacccagcctttcaaatccagctgtgcctttaaacccgagggctttcttaaggtcctgccttccagaactctctggacctttccttcttgaccatgttctccctgctccagtgagctcagaagacccatgctcaaaaaagagtcaccaccctcagaggccatcttgaagcagcgaccgtctgacttgggggctgggctgggctgggattggggtgggtcacttggggtctcttttcctgcgtcggaactgacccctcatgtccttctcttggcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgattgtgtttggttgatttattctcagttagacacagggatgcaccaggggtggagagacggggacagattttgggaggtgagtattgtgtggtccccagacctgtctgtatggtaagggactgcagaaggacggccaatccaccttcctcttccctgcaacggaagtttcctagggaactccttggcttcaaagtctgcgctgtctttacttagactcctggtgggcaaacaatggctcctgaaaggggggcatgaccaaggacagccctgtgggggcagagctgtctctgggatcagctggcatgtggggctggggcatttcctagggcatcgggcggactgggcttgcatctggatttgatttattaatttgttggggaggggcagggacactgccctgcatttgaggaaagggggtagatgcttcagcacattccacagctctgactgccgagatctctgactcgggcattgtgctgagattggattctgaggttgggaggggttgactttgctgtagactcagtgccagccacagcttcagagattgtgctcacatggtatgcctggactcttggccatcctccaaatgcccctcccctcccacacctctgtgccttgtgtgtgtgtgtgcacgcatgtgtgtggcagggggtggagggtccgggagcagaagctgatctctcggtgggggcctttttccaggaggttgcaggcagtctggagacgctgcattgagcctgccgcccgctgcgcgggctccctcctatctagctgtgtcctggattctcagccccctccccagctccagaggcgcttccaggcttctgatttcactgggccccaactttgttggcacctgtcccgtctgcatcttgaggctgggtctgcagttctgtctctctagctctgccccagcagcaaagtcctgcagccatctggtctccctgaggcaccacggcggctgccagcagcaggagataaagaacaaagtggtgttgagggttgcttcctcagccccagccactcttcacagagtcccctccttctggagcccaggccaaggcctgtggggatgggaggtggtgcacgctgaagattaagttttaggtttcaagtttagggaaagtatctctttccctaaggcatctttttcaacccccttgtctctagtccccttcccgatgctctaggcttgcacccttggcagtggtggtaggaggtcctttttctttcatgggcctcccaaaaaagccaaattggcttggaagtagctgtgtgcatggcctgggtgtaacttcgtgacatacgtgcatttgtggagtatgtgtgtgtgcatgcatgtgagtatgacgcagtgacacctgaaacgtgagtgtatgggctttttgggggtgtgcatgcctgtttgatgtgtgaagggaaggtgtgccatttgtgtggtgtgtatatgtggtgtgtgcatttgtgtggtgtgcatttgtgtggtgtgtatatgtggcgtgtgcatttgtgtggtgtgtatatgtggcgtgtgcatttgtgtggtgtgcatttgtgtggtgtgtatatgtggcatgtgaacacgtgtgcgatgtgaggagagagggagtgagacattcacggagcacgcctgtctctcctggctgtggatgactggactctcgctcattaggtgatcccacctcagggtttgtggggagatgtctgacactagagaatgaacatgtgctttggggagaggactttcacatcccacagaaacactgccctgtccaggcttcatgcccacaggatcctggagccaggtcctaagtaccaaaaagcaaataaaagcagcttcttgtttgcagctaggccctcccacccttgaaacggtgggaatacccaaatggtctctctagttgccacaggggtgtcagcacctctgggagatgtgggagggaggta

SEQ ID NO: 14057 - DNA, 4676 bp, Human
atgtggcctgtctcttgtgaatttaaaaaggtcacaatccacttttcagtgttttgagattttcaaaatgattgcattagctcttggcaatgctaaattatgttccttgcgaaccactatccagtttctcttgggccaagtccacctcctgctccgcaagaggaacaactcccagctggtggtacctggcggcagtgctggagaaacgccattttgtgactggcagagtacacctaggctttagaaaacaaaagctgcagaacgctgcaagtttaggattcaaagagcataatcaagagaaagacgtctcatagaaaatgtttctgagtaatagtgtaatcctactatgtttgagatgctttgtagatttcaataacactcctaagtcaattaaagcattacaaaggaatccaattcttgtgaaaggtttcagaaattcccgtaaagggtacatttccggagaggaggtgagcagtattccctctttttttttttttttttttttttcctaaagagctgaaggttatacggaattggggaattataatacctttggaatcaatgccttgttttatggaaaataaacacagccttcaggttatgaaaaccagatgtagaagaggacaagtttaaaaaattaaagtccaagccggcgcagtggggctcccctgtaatcccagctactctggatgctgaggcgggaagatcctttgagcccaagtttaagaccagcttggggaacaaagcaaaagtaaaataaaataatagtagtaataaaataccacttaaataatcatctgtagagttggaatagaatatagtagccggtgaaactgcacgattgttgctggcttaaagatagaccaatcagagtgtgtaacgtcatatttagcgtcttctatcatccaatcactgcactttacacactataaatagagcagctcatgggcgtatttgcgctagtgttgggtgttccgctgtgctgtttttccgtcatggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgctactgaaggcttcaaaaccaatcgatttcggccggtcgcggtgactcacgcctgtaattcaagcactttgagaggctgaggcgggcggattaccagaaatcaggagttcgggatcagcctggccaacatggccgaatcccgtctctacgaaaaatacaaaaacacgccgggcgcgacggcgagcgcttgtaatcccagctacactctgaaggctgaggcaggagaaacacttgaacctgagaggcagaggtttcagtgaatcgagatggctctaatgtactccagtctgggcgacagagagattcggttaaaaaaaaagttcgacttaaaataattctggagtcagaatgggtttacatttaattcttaacccagttcctcaaagcctgtagctctgttaagaaaataaaggccattggtcaagcctgcttggtcccaccctcatctccccaccctcccccaatcgctgctcccgccatttcctggggcttggaggaggggttaaaggagcggactgtaggcgtcacatttcccgcctgcgcgcttttcagtctcagtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcatttctgaaccaaaggcccttttcagggccgcccaactaaacaaaagaagagctgtatccattaagtcaagaagctcaatgtgtaattaagatgaatgatactgagctgacatcctaaaaaggaaagattaggggaactccaagtttgccctccactcactacatatgggtaggggagcaacgatattccaactctgaagaaagagtggaaaaaaagtagtgttaaaaatttgtattagtttccaagggacaaagaagcgctgcccaatcaatgagggccattcgtagctgtcaaccaatcagaactgatgagctaatatttcctgaggcaagccagggagccggaggggaagctaagaagcttattgagaaaaaacaaaaaccctgttttaggaaaaaaaaaaaccatcttttagcgattatgaaataaaatcacagagacatttaagtatccctcaatcatgtactgagagcaatactaaatttatcgccaccaatacagttttactctattaaaaagaccctgaaaattgaaaccctattcagactcctggaatacccaggacactaaattcaggggagattaaaatctgttttagagagaaaaggcacctttttcagtgttaccgcggccttcagcagttaacctttttttttccccctttacgcagaaatggaaatttgggtgatagaaatattccgaaattaaattgtgatgatggttgtacaactaagaaaacacggtaaaattcattgaactgtacctaaagtgggcaaattttgtggtacattaaatatcaataaagctgattatatacatacacatatatttttatatatgcagagagagaaatgatgcaagcagggtggtaggacatgaggttggtagcataggcaatgttggtctgtgaagggccacctgtgctaaacctggaagcctggggtttgtccagtcaagccatggtagccatagttttaaaggatgttcctgatgcagttatgtgttccagttaagtacatctagcttcagaactcagctggaaaagggatgtgaacttcaggttagctgatagggaaatatcttactctcatctgagtaaatattcacaaatgcctctcattgtgctctttttggtaccattgttataggactgatttcagcctcacgatgttagcttcagtgatggatgtctctttattttgaggtcctgttttccacctgacagttttcatccaggatttcttgaggaattacacaagtacccagcttggcttaatttaaaactgacaatggagagaattcatagctgcattctggatagtttcaggaatcagaggagcaaaaatgagcctggtatggagggtgggtcattttatgtctttcttagttggtattttaaagatatttattgatctcatatgccagatattgttgaaatcattggggtacataagttagaaaattttaattccctttcctgaattccagagtcaatgtagaggggtgtgtggatatcgattacccatatgggaggtatagtcgttgtaacaataagccacgactagctcctgttacgttttgcctggcctttcatagcattgctatgttcatagcattgctgatatgtcatactcatcttaggcatacccaccaccaccttgggccttcttcagtcctaacactcatgcagtccttgttcagaacaaagataatgttgcttaatttgcaacccctagactatcccccagattttctaaagagaaactgcacgctgattgcttcaggcagtggcaggtcaaggaatgagatggggaattgattgtgttagcattctggtgggcttagtggagagcctggagacttacatagaaaattcacacatcctttcattcaacaaacctccataaactacctgttaaacgtcagccctgttcaaggtgctagggatacttctgggacaaaacaaagtccctaccttcaaaaaatatattccagttgggggagagagaacaaacacaaaataaaatatatctagttatatgtattttttgttaaatatattattacatatataattctaggtggggaaatgttatatatatatgctattgaggatagtcaactatatatatatatgctaaatgagcagaaaag

SEQ ID NO: 14058 - DNA, 7068 bp, Human
actgatattaatagcttcaagttctaaatggcaacaaaattcttattccatttaaatcagtggtcctcacatttgagtgtaccaagcatcaatggaaggctcactaaaatacagatgcagggtggggcaccccagagtttttgattcactcagctagattggtgcccaaaaatgtgcatttctagcaagttcccaagtgatgcagagctgctgctctgcactgtgaaaaccaatgaagatatttaacatgtaaagacatagacaaatactcaaaacgcagaagataaaaccaaaacgtgttcacagcaaaggcaccaacacaaatgattcccactgataacagaaggacactgcagtttgagacaccagggaggtgtgtttctgcaaagcaatatttacataaagttaaagcagcacaggtgttggagaggatgtggagaaataggaacacttttacactgttggtgggactataaactagttcaaccattgtggaagtcagtgtggtgattcctcagtgatctagaactagaaataccatttaacccagccatcccattactgggtatatacccaaaggattataagtcatgctgctataaagacacatgcacacgtatgtttattgcggcactattcataatagcaaagacttggaaccaacccaaaagtccaacaatgatagactggattaagaaaatgtggcacatatacaccatggaatactatgcagccataaaaaatgatgagttcatgtcctttgtagggacatggatgaaattagaaatcatcattctcagtaaactatcgcaagaacaaaaaaccaaacaccacatattctcactcataggtgggaactgaacaatgagaacacatggacacaggaagggaaacactacactctggggactgttgtggggtggggggatgggggagggatagctttaggagatatacctaatgctaaatgacgagttaatgggtgtagcacaccagcatggcacatgtatacatatgtaactaacctgcacattgtgcacatgtaccctaaaacttaacgtataataataataaaattaaaaaaaaaaagttaaagcagcaaaacactttgcccttcaatctcacccctaacatattttttgcccttctggtttcaaagttaaacaactgtaaataattgtgatacaaggatgccttaatttaatgttatattttcccaaaaactcaaagttaggtaaagaaacaaaaaaaaattgtttatatttaaattctattcaagaaaagcatgaacgacacagtatataataagcctggcaatggatacaatcacttctctaatgtaattttggaatctgctaatttataatagaaggaagctgtttcacctacaaaggagttaatcaaacacaggtttaaaataatgacattattaaccaagggaaaaacaaagggccagagacttaacatccctagccagcacgcattttgagttaacataattacttgttagaagaaaatacatcacccagtgttgtacacaatatatttcagataaattaaccacccaagaaagcaagcttaaaatcttctccaggaagcagacttcgaaggcttgatctcaacttggatttatcatttgcatagaaaataaccataactcgaagttataaatcatcaactctatagcaggtttcagtaaaaagccgcaagattttaaattgctttttaaaagatgacttctcagccatcctcatcccacatttcctgggaaataaaagcagaagtcctaaaagaggacagatagaaattcagtgtctgcatagctttgagtccagtgtttgaagacaatctctgattgtgaagccctctttttctctccttctatttctctctagagcactcaagactttactgacgaaaactcaggaaatcctctatcacaaagaggtttggcaactaaactaagacattaaaaggaaaataccagatgccactctgcaggttgcaataactactacttactggatacattcaaaccctccagaatcaacagttatcaggtaatgttatttctacaagtacttgacaaatatatgtatttacactctgatatgtgtgtacattttttccaagtttctcttaaaattgtaaaccttaataactatcaatgcaagcatgtatttggaataaaaattataattaaaatagaagtctaattagtgatgtcagagacaattgttaattagcctctttattaagaaaaattatacaaagcatagaaataaaatataaatggtcttagttactttgcctcaagtataaaatgagatttaaatacagataaagggagctgaaattctcaatgtcaagaatacttgttaaatatcttacagactacacaaaatgtatattcactaagtcgaatttccaaaacggtcagggatgaactaagaccacacagcagtagcaggaaaggttaaaatcagtgatcttgtattggaaaacattaggttttgtttagcattattttaaagcgctaaataggtgaggagatgctgaaaattgaagccatactgtgacaacatgattcttaatcgttttccttccataattaaggacagaaaggaattccatggacattttggggaatttaagtgctacattcatttatctaaatatcttttacacgaaagttattttttaaaatttgttatttgtactttcaatatatctctgattattaagaatattttatatagaatcaatttcacttatctctggtgaaataaaaagattacaaatgtcatttcaaattcccaagatgtagatgccatatagcatattcaagtcacttgttagttttcattatagctgcctattgtggtaataacctatattttattttagctaccattacacactccataaatctggaaagtatgccctgttttgaggaatgccaactcatgaccatatatacacaggccatttctgactcttatttttttttttactgttttaaaatttatactgaatgatattcaagaaaatgtatgcagcaacttcaaaacactgaggaaagttggaaataagatacacatgggttaaaatatttgaagcagaataatgaatctccgtgaggccaatctttgaatgagtgagcaatatagaggcaggaatatcttccaaatataaagaaaaaaggtcagcttttttttttttttactgattcagtattttatttaataagtttcccaagagtaatttttcatcaatttcttccccctttttattactttaggattctaacaggcaattatccatcatttctctctcaactgttttgacggtactacagtaaaagaagctcagaaataaggacgttggggggaaaagtgactgtgaatagaaaccaaaaagctaaaaggcatggaggggaagctagagaagagtaaagcacagccccattatttctcttccagcttttgcatataaatatgagtgagctctaagacaaaatgtgctttaagaggcaaacattcaacaaataaaaaaatactaagcatctataacttcacatattgtacttcagatcatttctcttcagcagagatgcaatatttgctgcaatgaaatattttgggattcagttttctgtgttcatactaactactacaatgaagatgagaaacctcaacttttagaggaggctgtgtccaaaaaagttacacacagagataacagcaataataactaccttaggctgaaaataaccatcctctcttttgttctctaggtaaccaacaagaaatgcaagccgtcgacaacctcacctctgcgcctggtaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccaaaaatctcttgggggctaagattctctctgttgtcatctgggcattcatgttcttactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattaactgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaaggaagaacgatcaattggatataatcttcttaccaaaaatgatagttaaaatgtatatatatcctagtcccctaaccaaatcctgacctattgggatacttataaaaatttaagtaagtgggatacacaaagaataataactattaacttttcattattagcaaaaacctaagggatttaaactaattgaaactgtatttgattggacttaattttttatgtttatttagaagataaagatttaaagaagacctttacaataaagagaagaaatatcgaagtcattaaaataaggagacttacttttatgacattctaatactaaaaaatatagaaatatttccttaattctagagaaactagttttactaattttttacaacttcaataataccatcattgacacttacctttattaattagcttctagaaaatagctgctaattaggttaatgaacattttaccttagtgaaaaaaattaattaaatatgattacaaagttgcacagcataactactgagaggaaagtgattgatctgtttgtaattacttgtttgtattggtgtgtataaaatacaaaatttacattaaactctaaatcattctttgttgtaaattctttgttcaaagatattagataccatgactcaccataccatatacaactacatcaaatccatttaagaattaatgccaacacctttattacatgttattgtgcaaagtctcttctgaagatgacttctcatttcaataagttcaaatgtaaatgataaaacaggtcagacttataacatgcagtctaattctacacaaggcatattcgctattttaacataaacaaaacatataacacatgtggaagtttacatcacttatctcaattttttatgatcctcagaggtgactctcaaacagaaggaggaacagacatcaatacctaaatataatgccagaagaaataaaagggtgtattgttgtataaagttcactgaactttaataataatcacttttattgaaaccctctacaacctctgctgagttctatttcattacgaagctgaactcatttaactactaagtggtattcatttccaaccagccacatttctttctccggcaccactaaaagtgagcactcagtgtcagtggagatacagagacagttcatatagtatataacctatacactgctgggataaacagcagtaataatttctgctatgtagactagtacagttcactctaaaatcatatgcataaatttacatgttctataggaataccaggatatttgaggtagaagacaatctagagatcaactaatctaaccttcttcttttgcatataacaaaaatgaaaggcagactcatccctccacccattcaagttggggtagagcatggactgaaactgactacttcacagtgtcatggaggtcagatgttcggagactacagaggggacacaaactacccccaaaatctttgtcactgagatgacaatttccacaagagatgaaataaacagaaatgctaatagtaatatggtattttagtaaaagtaactgaaagtatttgaaattacctatgttttatgagtatgtatatatgccatggaaattttacataaaactctaaaatcacactttgctgggatatctttattcagagaccttagacatcatatactacatcaaactaaacccattcaaaacagtgtgagagttagtatttatggagggatcattatacataaaacatgccattatctctagcttttggcatattaatatatattaaccccacatttcacagtgagttttacttttttaaatgaagccaaattctgtagact

SEQ ID NO: 14059 - DNA, 4961 bp, Human
  misc_feature (1)...(4961): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagcactatgttctcagaggacgacttccagtcaacagaaagagccccatatggtccacaactacagtggtcccaggaatctgccaagagtccaggtgagaaacctgagggaggattgagggttcctcctggccagaacacagagggctgcttagaaatctgctctgcccctgctgtctccccagagagcatgtgcaggactatgtgctgagacccctctcttatactgggatcattggtctcagggagggggagacattggtctgagagggctgcacttaggtcagcagtgggagggtcccaggccatgaccagaatcaaggtgggggctgacgggacagcacttaccaaaaacatgggactcagcccttccctgccccttctgtcagctatgggaagtccctgggaccatgggtgtttctatttccctgatttcctcttctgatatctcctggaggtagagctttggtttaaggagatggcgtcaggtcaacagagggagggtcccaggccaagataggcatcaagatgggaaccaaacaggctccttacccgaggacacatggaccctgctgactgtcaccatctcttgctgtccttcctgggtagccctgtgtacatgtggccagatgtgtatccccacatgtcctctttcatatcaggaaagagctattgatctgagagtttctcaggtcaggagagctgtgtcttccaggccctggcaggagaaaggtgagggccctgagcacagaggggaccatccactccaaaaaagtgagaaactcacagagtttggcccacctttctgacagtgctggggtgccaggatgggtgcttgcagtactgcagcctgatggccccatgattcctcttctagaagctccaaaaactgagcagtgaggccttggtctcaagcaatgtcttcagatctcagaacacaggaagcctaggcagtgccagtagtcaagatgagatgttcacccttaatctacaaatggccccacctgccccagtacagaaagggacccccagcttgcaacctcacctgccctacctcagtcctggagcctcctgctctgatgtccagctgcatcttgagcagccttctcacttcctttttcaggtttttagagaacaggccaacctggaggacaggagtcccaggagaacccagaggatcactggaggagaacaagtgtaagtaggcctttgttagattctccatggttcatatctcatctgagtctgttctcacgctccctctctccccaggctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagagaaataaaaggagaaggtcattaattcttgtcttcttatccatattaatctgttgttctatgaaagtacacacccatacacacatgtacacccccctccccccacatacatattcaccaaggaaatgcagtttcctactgagttgcagattctctgagatgtcctggacaataaaaaatattccaaagtagagagtggtagcacctggggtcacagtaatactagaaatagctgtcaatcattaaatatccagtacatgccaggcatcatcccaggtgttttaatacattttatacattacaacagtcctaaaaaaatggtctatcaaacccattttctggatgaacctgagtctcatggtgcttggtaactttcccaagatcatatcactggtaaaccacaaggttggcctgaattcatctagagcccattctattctcactctttgcagcctgaagtacacctctgtcccttaattcatttgttttctcagtactgcataatgtctctcaagtggccaaaagaaggacactgtggacgtggtactgaaagcgggcctacaaaaggaaggtgacaatgagaatgaaacataatctggggatagtctgtgggctttattaacctagggtcctcctgcctgagccctagggttcctgagagctgactctacccaagtgcaggaatttctgtccaaccctaacactttctcgcgccacagaggccttcccttggtctccctcatgtgccctttcttccaattggaatctggcctgcttcctgctcctccctgctgcttgctgtgaaggctaagcggaatcacctgccttcccctttacacatcctgtcatcccaactgtgtgtctaaatacaccctcgaacttttctaaatagatggtgagtggaatgtgattagcacatgatatactattcttgagatacgaagttacagagagagagttttttaaagccattttgttattcgtaataggaatttaatggggtgttttatttgaaactggtcactgaacacatacaaggatgaatgaccttaccttggtggtgaaaatctaaactctctcgcataagctggagatgaggaaagaacatggaaatcactgtggagtcaacatctactgaggctgaactaaaaccccagagtctcccaggaggtgaaaaatgctgccttggtgggagtactagctcaaattttagtagaataattaaccaagtttctactttctcttgtctagtacttgccccacaggaaaatatgtgctttcattgtgtctaaaggcacctgacaggtgtttaggcatgtgaagggtagcagaaactcacaggttaaaattttgaccaggaatcaaatggaggaaaagttcaaagcctactaattgtttaaagggtattataaagggaagattccctgatgagccttcctgctgagactttcaaagttcttggacagttgtgatcttacatttcaaagcatcagtcacgtagcaggcacttgaaaatgttagagaacttcaaggc

SEQ ID NO: 14060 - DNA, 421494 bp, Human
  misc_feature (1)...(421494): n = A,T,C or G
ctcaacatcactgattatcagataaatgcaaatcaaaaccacaatgaaataccacctaacaccggtcagaatggctattactaaaaagtcaaaaaataacagatgctggagaagttgtggagaaaaaggaacacttttacactgttggtgggagtgtaaattagttcagctattgtggaagacagtgtggtgattcctcaaagacccaaagacagaaatattgtttgacccaacaatcgtatgactgggtatacacccaaaggaatataaataattctattataaagacacatgcacacacatgttcactgcagcactattcacaacggcaaatatatggaatcaatctaaatgcccatcaatgataggctggataaaaaaatatggtacatatataccatagaatactatgcagccataaaaaagaatgagatcatgtcttttgcagggacatggatggagctggaggccattattcttagcaaactaacacaagaacagaaaaccaaacactgcatgttctcacttataagtgggagataaatgatgagaacacatggacgcatagaggggaacagcacacactggtgccttttggagggcggagggtaggagaagggcgaggatcaagaaaaacaactaatgagcactaggcttaatacctgggtgacaaaatactctgtacaacaaacacccatgacacaagtttacctatgtaacaaactgaacttaaaagttaaaaaaaaaaaagaggttcttattatgttgcccaggctgatctcaaacttctggactcaagtgaacttccaccttggcctcccaaagtgcctggccttagatattcatacatttatttatttttagagatgtggtgggggtgtggggggtctctctctgtcacctgggctggagtgcagtggccccatcatagctcactgaagccttgaactcctggactcaagcaatcctcccacctaagcctgccgagtagctgggactacaggagtgcactaccatgccgggcaaacacactgattttaagtacaactgtgtgctttcagtcttaagatcttcagcttttgaaggacctcagccttcctctagttctaactcctctcgttctaaggagatccttcccattcctgcagaacgtctccccaacccttcttcttcacagttctccctcctatccctgaaccattgcaagaggttttgtgccaagcctctggcacatggcacattctatctcatgttgtgatttcgttttctatgcacgtgctctccttctagcctggaggtgagctgcttaagggcaaagagctcatgtgtagcccttccttgtacccattgtcctatagcaggtgctacctagggggtgctccagtagcttccttgaatgaaccaaagagaaggggtgaaggggggagtcagttgcctaggagcttgcatggacttctgtgtcctggaaccagcccggagctgctggaagatgctagaagttggaatcctatctcatttctaaacatctgctcccactcatctctttccagggtcatcagttatccccactcctcccccccgcccccactttgtataaatgagcccctcacatccctccatcttctccatcactgtgtggtcacttcttaaatcatgcgtctggaaggcgccctcctgtaccccatcctggaggcttcctgcacttcccctcttgtttcttccagaaatgagtcagagtgaaagcaaactttctgaggtcctgagatccccgagacaggctgtgagggccgctggccccgcccgctccagcagcgtgtgtgtgtatgtctgtgtgtgtgtgtgtgtgtgtgtgcgcgcgcgcgcgcgcgcgtcaggggccaatgctggaaaggaaacagcggactcgctgaggagaagaaaggagccgcccccttcgtcgccagccccctccccacttcccgtccagcgcgctgctcccttccccccgcctctggcctcggggaaggagcaggaggcagcccaggcggagcgggaggagctggcagcggggcgcatgccaggcgggggtcctcagggcgccccagccgccgccggcggcggcggcgtgagccaccgcgcaggtaggggagctgccacagagtcctagcacgtcctgggggggtcctggcaaggagggcgcgctctggcccccaggaagtcgcgtaggtcagggcgtgcctctgttaacaacccctttcgaggtgagggaaactgaggcaggacgcgaggcgtgcgaggttgagagaagagcgagtcttgggctgccagcccggcaccagcgccgagccgggccaggtccctgacccaggactgtgcagcgatccccgggacccgcagtttgcgaaactgtaggagtctgacccgcgcccccgctgcgtgtccaggtgaccgggaaaggttgcaggggcgtgcttggggtttggatccgtccccgtcctgggacacctgcgccgcctgcactctcgttgcggtgcgccccagcctgcgccccctcgggacaggggacgtcccgcccgccttaaccccaagacccagctggatctcgggttccaccccttcggggacctggagggaggaggctgggagcgggaccaggaactggtgcctgtgccttccctaggggctgctctgaaatcagtgtcaccgcccacttcctacttggctacagtaacggggatggcccaagccggagactgctcggtttccaccgcctggagcgcgggtctcgctgtcaactcttagtgatgattgtggatggttgtttttcaacaatgacaggacttctaccttctcactcttaaaatgtgaggttttccaaagacagtgagatttggagttagggagtgctgccttgtgttcttgctgggtgaggacagggctgggtcagtcgcttaacctctcagagcctcagtctcctgaaatgtaaaggagaacactcatagcctggcctccatgtgtcgttaggtttgttgtatgggaaatcaatttgcaaagtgttatcatcaactggacaaatttgaattggacagcactaggaccataggaactggggtttggagacagtctgcctgcatgtcaatcctggacatgcaggagactatgacagtacctgcttcatagggttgttatgcggtttaactgtgatggtggaagtgaagcacctcgcccaatgcctgaaatacccagtgcactctcaaaaaaccttagttgctatttttcctaggcaaaatctaaataattgggagtaatgtgagaataccagtttgatttgattaatgcaggaatagtagggcatttaaaaacacatgtagttctcctgtgctcggcatggtacatgaagtcctctgaggttcagttctgtgccacagagcaaaaagaaccgtggacaagatacccgcttttcgggctctttgactttgagcctgttttctcatctgtttacaaaaaagataaaagaaaaatgggggtagtaattactgccttttgtactgatcgcattgcctgaggattaaatgaggcaaaagatctgaaagcaccttgtggagtatgagtcactatgcacatataagacatgatagtactaggagggaatggtaacatctgcaggtttttagaacttacaatgtgccagacattttattatgaattcctttgatgaaatcctccctgcatctttatgggactgggattacagtcctcatttccctatgacaaagctgaggttcagggtcaccctgcttggttcccaagctcacagagctcttaagtgtaaagccaggattagaaccctggtgtgggtgccactcacaactgtgttcttggccgcttgccaaactgaacttatagagtggagctgtgattcagaacagacctatattagaatttaggtaatttttttttctttaggagacagagtcttgctctgtcacccaggatggagtgcagtggcacaatcatggctcactgtagccttgaactcctgggctcaagagatcctcctgttccagctttttgagtagttgggattacaggcgcatgccaccatgcccagctaatttttttttttagagttggagtcttgctatgttgctcaggctggtctcgacctcctggcttcaatcattcctcccactttggcctcccaaagcgctaggattacaggcatgagccaccaggcccaacctccatcctgcatatctatagacccaaaatgtaagagtgaactgttaatcctggcaaaagaggctttggcataattttaatttccctcagacttattttataaaatatactttaaactatcttcttgtaaaacaaatgatgacaatttgcagaaaagttattaaaacattgaaagaacaggttgcaagatctcatcacaaatctctaagtggtatctggattgttttgttttgtttcaacactcatttgccagaacccttaggatagcacatgaggtgtaaccggaaatcgaggcgttgggtgtcatggttactttgcagggctgggccccgggacttttctgcaggaagttcattgctcacccaagatgcctccagaagaaagcagaaacttccgagaggagcgtgaatgctctgtttctgtgctgcagaaacaattcctagtttatttgtttcctaaattaagtttatcttattggtttttgtttttccaaaagcaatgcatgctcattacaggaagcacagaaagctacaaacaagtaagtgaacactaaaaaatactgtaatctcaccaaggtagacaaatagcttggtgtctctgtccttgtaacccatttctatgctgcatgcatccatccaaaagtgagaggcaaactattattgttttttgttaaatgacaaaaatagtacttgctaattgctcaaacattatgacattaatgtagaacaaagccaatttattatgctcattaaaactttttctttttttaaaatctaaaaattttgattggagaaggattagagactaaattgttgatatttgaattttattgtggttttggttaaagtttgatgcaggaccttcagagcaaagagagggtacaatggtgacctttaaacaatatatatattttttgagacggagtctcgttctgtcgccaggctggagtgcagtggcacgatctcggctcactgcaacctctgcctcctgggttcaagcgattctcctgcctcagcctctcgagtagtgggattacaggcgcccaccaccacatccagctaatttttgtatttttaatacagacagggtttcaccatgttgatcagcatggtctcgatctcctgaccttgtaatctgcccgcctcagcctcccaaagtgctgggattacaggcatgagccactgcgccgggccctttaaacaagatttaaagaccagcacacaaagtttctgagtacaaaaataggtaatattttaggttagggtcattagaccagaattagaatcattctttttttttctttttttaattaaaaaagatggggtctccttattttggccagattgaccttgagcctcaagcaacttctgcctcgacctcccaaagtaccaggattacagatgtgaaccattgcacctggccagaatcattcttttgataataatgatggtaattgagtttatatgctgtgttctcatgaatccaagcagagcccactgtttccagagattcccttggcagccaccctgggttgaggagggtcccctcctggcacagctggaaccaccggtgaagagccatttttcagtcagcaccgtttagtaatataagacttttagcctcgaggagtcttccgttgttagttcctaactttaatgactttgtggtaaaaattccttagcgaatgacttctgtgcaacaatcatgtaatttttaaaattccagatgctttagccgttcagaatccattttttctttcaaaaccagagttcaccagctgtttctcttgagcgaagactttgcaatgagctttcaaatgttcacaccaagtagaagcaggaagggagaactgtggctgggcaatgaatgaaatactgacatttagctgtagaaggtaggcaggggctcacatggtgtgcacagccccttatatgactactggtcctgtatctgcttcctttccctgccccatttcccctttggctttttgtcatgactcagaaatggatgctagacattatggggctccctccagtcactcgggtcactcgtcacagacttataaacagaatcacagaacttattgtcagatgaagcttcaaaacaccagttggctaaactccttgtgttctggcaggtaagatgtcggcatccttatttaacaaatgatgctactgagaactatgtatgcagagacatagtctcaaaataagtgcagtcatgcctcgcataatgacgttttgtcaatgtcacatatgtgagagtggtcccataagattatactgggctgtcaatttcctaatgcctagtatttactatacattttaatgttattttgtgtacttctacttagtaaaaaaaagttaactgtaaacccgcctcaggcaggtccttcaggaggtatcagaagaaggcattgttgtcataggagatgatggctccatgcgtgtttttgccttgaaggccttccaacgggacaaggtgtggaggtggaaggcagggatagtgatgatcctgaccctgggtaggcccaggctagtgtgtgtgtttgtgtcttagtttttaacaaaaagtttgaaaagtaaaaaaataaaaattaaaaataggagcttataggataataaggatataaagaaaaaatatttttgtacagctgcacaatgtatttgtgttttaagctgtgtttttataaaaaagtcaaaaaattaaaaaaatttaaaaattattatatataaagtaaaaaaagttatggtacgctaaagataatttattgttgagaaaaaaatttaaatgaatttagtatagcctaagtgtacagcgtttataaatacagtagcatgaaattatgtcctcaaccctcacgtgcactcaccactcactcactgactcacccagagcaacttccagtcctgcaagctccatgcatgataagcctcctatagaggtgtaccatttttcatcttttatagtgtatttttactgtaccttgtctatgtttagatatgtttagatggaaaagtacttaccattgtgttacggctgcctacagtattcagtacagtaacatgctgcacaggtttgtagcctaggaacagtagctatacaatatagcttaggtgtgtcatagcctataccatctaggtttttgtgagtacactctatggtgtttgcatgacaaaatgacctaatgacacatttctcagaaagtgtccctgtcaataagtgatgcatgactgtgattgaaataagtagccccacattatttttctcatgtcaacttcaggttaattttccagccacgtggccttgtgcttgctcatcataaaaaaatgtggataaaattctacctgttaagccacaacatttgcctgtcatgggtggacatttaccgtttattttcagagttcaaagtttgaactctcagagaaatgcaaataagacagtaaactcctcgaggtgaggaatggcaatctctgaagataaatcatatatttattgtacagtattgaatgttgtaagtggcagtagagatcatgtaatctggccttcttcttttacaggtgagaaaagtgagaaacagcagcagagtgattgttagaacctggctcctcttcttttacttagaactgttttcattaagttgtgtttcatttcatagttctgtataattcatccctgcttaagatacattaaatgaattgaactgaatcccttttttttgagctatgatggctcttaaaaacttagattttcagccaggcgcagtggctcatgcctgtaattccagcagtttgggaggccaaggtgggcagatgacctgaggtcaggagttcgagaccatcctggccaacatggcagaaacccatctctacttaaaatacaaaaatcagctgagcatggtggcgtgtgcctgtaatcccagctacttgggaggctgaggctggagaatcgcttgaacctgggaggcagaggttgcagtgagccaagatcatgtcactgcactccagcctgggctacagagagagactccgtcaaaaaaacaaacaaacaaaaaaccacgtagattttcaagtaattactattgttacactaaatgtcaatggatccttaagaatctatttgttcatgaattcattatttattcattcaacgtttattgagtggctacttggttcagaattagaattagcatgacagccacacattagaaaggtatcactttttgactaaattaaaaacttgctaaaaatagttatccattgatggaataggctaccccgaaaggcagagagcattttgtcattggaagtatgtagggcagtgtggatgactctagggtgactgtcatgagggttctgcactggggagggggctgcgttggatgatgaatgggaacccttccagtgctaagatgctgtgatcgttgtcctgcaggattgggattgtgcaggatttgagctactgtgtaaatttcctattccctgctcattgggcttccacattttgcttccttcccttgcccaggtggttccatttcaggaagcctagatagcttctttgcagtcatctgcccgaatgtcgtagctactttaactccccagagctgtacatgtctaggattgatattgatcattaacacaattatgttcgcccagatgaacaaatctaccaggagtagaaacgtgcatttgacaggtggccttgcatggagactaatcgctttcacaggttgaaaggtgaaatatctaaagtttaatgagtaagttgtgtcctgaatgtggaatctgagttgaaattgcattttgtgacatgtacgcctacctaacttttctttttcatacctgtcatctttttttttttttttttgaaacggagtcttgctctgtagcccaggctggagtgcagtggcgcagtcttggctcactgcaacctccgcctcccaggttcaagcaattcttctgcctcagcctcccaagtacctgggattacaggcatgccccaccacgtgcagctaatttttgtatttttagtagagacagagtttcaccatgtcggccaggctggtcttgagctcctaaactcaagtgatccgcctgcctcggcttctcaaagtgctgggattacaggagtgagccaccgcgcctggcctgtacctgtcatctcttggtttgtgagtggattgattattggactttatttttaacacaggagaatgtgcgtgttttgcatttgtagtgaaagcatgcctcatcttactccaacactgataggaaaaggaagattattttacaatggtcaagtgaaaaaaaaagtaaatacagagataaaacggggttctaatatttctgctacactggaaacttagagttgcaagagctgttttgggatcacaaatcttctgaagaaaaaaagtttgcgtatttcagtacaagtcttaatgtttccctagcgtcttgtgttatagctgcaggccaagcaaaatgaaatgtgagacactgtccttggggatagagcatctgtattcaatttaaacagtagatttgggggccttaaattgcctcgactctattaatcattttgtgttccttagtttatagaattatctcctagagacattaacttatccattaatttcttccattgtgtttatttattcattcacaaacactagcacctactgtatacacagtacagtgttgtacattgcagggtacttaaaaatgtagagtgccaggcatggtggtgcatgcctatagtcccagctccttggaaggctggggcgggaggattgcttgaggccaggagttcaaggtggcagtgcgctatgcttgtgcctacaaatagccactgcactccagcctggacaacatagcaagaccctgtctcaaaaaaaaaatgaaaaaactcccccaaaaccaaaaatgtagattgttctcaagggccatccagtctagagagaactaagggagcctggtattcttaggccttagagcttaacagccacacctaggatgcctcttcagaaggtgttccagcccttcctgtgtcttcccagttctgatactggattatgtcattatgtctctgttgagtaactccttccaatcaggcctgcacactgctgccaggacagtcctcacaaagcacagatctgattgggttattgttcctctgtggaaggggctttcagagactcattatctccccccaagcaaattcttagcatctcttttcaagctttccatacactggcccttaaacacttaaaacggacactctggcctttttattatgcacattattctgcccaccgagaatattacagaatccgtctttcttgctcccaatctgaacgcatcaaaatgtcatccctcatttaccacctagcaaatcaataatgcttctcagccttccctggttctctggaatcgtctgctctctccttcttctgttatagtttgttatggatataacctgtttttctgactccaatgtagacttcttcaactcaaggtttcagttctggtttatctccttactccctcatctatgtagtacacttatggtttactctgttctcactggattagaccaaactcttaattatatttaggatgtattaatccaatgcatagattaaccaagtctattatttttatatcttttgaaaccaatcaggagtttcagaagttcagttcagtttaaatatttattgagatgcatacactatatagtcagatactatgatagctcttgaatataaaaaatatatatacttatgtttgtatatatatgtgtaaattgatatgtaaattcaaatagatagtgttgtctacaccattgagaagcctatagtcccgtggaaaaaagagaattcattctcatgaagtttccggatattgtttcatcagaaggactgggcacatcggggtgtactaaaatcattaagaagtatttagcaccagtagatgcctaataaataccttacagtctagatggatggatagatggaggaagaaagaagggctcctttaatttataatttacctattgctgggtttactcctaggtatgacaattttgaaaacaatttactcaatgtttatttccacactgtgtatgaaatatgctgctcttcattcagaaagagatatataattctccatttgtagaacactgagttaatttcatggttgtgatgttgcttttgcttactttcacccacattttctcctctgtagggtggcagctccgtagggtggacacacgctttgggagacctgcagctgtttgtgtctgggggcaatggtgaagggcagtgactcattggcccagaactcatgatctcatctctcacccagctggctaatcggccttggggacaggaggatgagcgctgcactccctcctaatcatgcagcttttgtatgtctttctttacttgacttaaattgtaatttgaatggaaaaatggacaaattctatcatttgaatttaacttttatatattttcttgactctgatttgggattatctaagtgcatttattcaaatatttattgtgtttttgaaactttttttgaaaagcataaggtaatacatgataaaagatattgttattacccctgtttttgccatttcaaggagtcagaacaggctcagtggaaacaaaatgagatgtcttatgggagttactttcccttcagctaatcttggtatgaatttatattgacactacctttaaaattttattctgctttttaaattttactttaagttctgggatacatgtgcagaacatgcaggtttgttacataggtatacatgtgccatggtggtttgctgcacctatcaacttgtcatctaggttttaagccccacatgcattaggtatttgtcctgatgctctccctccccttgacccctaccccccagcaggccctggtatgtgatgttcccctccctgtgtccatgtgttctcattgttcaattcccacttatgagtgagaacatggggtgtttggttttctgttcctgtgttagtttgctgagaatgatggtttccagcttcatccatgtccctgcaaaggacatgaactcatccttttttatggttgcatagtattccttggtgtatatgtgccacattttctttacccggtctatcattgatgggcatttgggttggttctaagtctttgctattgtacatagtgctgcagtaaacatacgtgtgcatgtatctttatagtagaatgatttacaagcctttgggtatacacccagtaatgggattgctcggtcaaatgattagttttttatttatataaatttatggggtacagtgcaatttcattacatgcatagtttgcctaatggtcaagtcggggcttttaggatgtccatcacccaaataatgtacattgtacccattgagtaatttctcatccttcactcctcctatcctcacccttctgagtctccattgtctgttattccactttctacatccacgtgtggacatgatttagctcccacttgtaggtgagaccatgtgatatttgtgtttctgtgtctgacttgtttcatttaagataacggtttccagttccatcgatgttgttggaaaaggcatgagttcattttgtatggctgaatagttttcccttttgtatgtataccgtattttctttatccagttctctgttgatgaacatctaggttgattccatatctttgctgttgtgaatattgctgtgataaacatgtgagtccaggtatttttctgatacattgatttattttcctttgggtagatacacaatagtaggattgctatattaaatggtagttttatttttagttctttgagaaatctccatacttttttccatagagattttaataatttacattctcaccaatagtgtttaaaatttcccttttcacttttcactgcattctcttcaatatctgttattttttgactttttaataatggccattctgactggcataagatgacatctcattgtggtttcaatttgcatttctttgattagtagtaatgttgaacatgttttccatttgtatgtcttcttttgaaaaatgtctattcatgtccttttcacactttttaatggaattattttgttgttgttgttgaattgtttgggttccttgcatattctggatattgttggatgcatagtttgcaaatattttctcacattctgcaggttgtctcttaagtctgttgattatttcctttgctctgcagaagctttttagtttaactaagtaccatttccctatgcttttttgttgttgttgttgttgcctgtgcttttgaggtcttagtcatgaattctttgcatagaccaatgttcagaagagttttccctcagttttcttctagtatgtttatagttttgggtcttatttataagactttaattcatctttagttgaatttagttttgtatatgatgaggtataggggtccagtttcattcttctgcatatggccatccaatttccccagtatcatttattgaaaggggtgtcctttgcccagtgtatgttcttgtcaatgttgtcaaagatcagttggttgtaaatatgtggctttatttctgggttttttattctgtttcattgatctatgtgtctatttttataccagcctatttgttacctattgctgtgtttactcgttattctcttttttaatgagtaaaataccctttttaaaagacaacatccaaattaggagactgcctttgattaaaatgaataactattaatcatcacagagcagggaaagtgtgaatcatcaggaatttagtggagagaaatccactgttttgggtatgtctttgtattagtctggggtaaatttcttgaggacaaaccttgtctcatttgccttcttataattcatgttagacttatagtaacagtaaagacttactgaattgggttgctttaaaacagcatgtgtaatatagccaccatggcatgcaggagtaggtagaattgcccccaaccaggagtggctcttgaaacatcacagggagaggattaggtaacggttgggttagaaagaggagcacaaggcacttgtcttcatgttgcttgggctcacaagcacacttttcatgtagattgcgtgttcaagatcaacatgccaaaagtggcaaaaatctctaaaggagcctccatctacacatttcgtgagagaaaaatgtccattctccatatcaaagcacattatcatgattttaatttggagtggatttaggggactgatgaagcatggggcactgcagcatccccctagccaacccttacacctgtggtgctcccaacacctcctgcgttcatcatttatcatgaagtatggtgcattcctgaaacactggacaagtgcatcttctcctagaagcacggaggtacattccaaaggcaaactcacttaaattgtgatcagaatacttcaacttgcttgctattgttgtggataagtgatagttaaccacaaccggctgagtggccaggtggaaaggacatggatggggaaggaggttcagggtcctgcataagtcctctagtgtctgtagatctcagtgtcctcccttgtgaaaatggggataatatcagccctcaatttacacagttgtagtgaaggtccaatgtgatcagtgtttgtcacaacctgtcatcatttatgtgtatagaactgcttttactataaacttgcttgtattgtccccagcagccagtcctgcctataatctgttggcttcattgcttgtccagtgatctgtggctccctcctgtcctaatccaggtccaagtggattaatgttatctgattcacgttagtgtttctacagatatgtaatgttatctgaatcacattagtgtttctacagcaaaacagatgcttgttcccactaagtaggataaatgaagactctaaattgcttcacatctgtgcacatgaggttctgccaccatgtgagttcagtcaggtcagattactgccagatgaattagagaaggcttgaggttctcagagaattttggattttggaattagagatgatgcatcatggatttgtgcttaatagctgttttgctactttccctccccttcccctctctccctcctcctccacttccagttcttagcctcagttactattgtactgcctccgtttcttgagacaggctgctgatatgctgcctttggtctctgagccaccaggtatagcgctgcataatggaagaacagatgaacataagagtgtcttggggaagatgagcacaagacatcatggggttgtattgttacccccagcttcagcacattcccggagtgtaagtgcaggctggcttctccataaagcaacacagcagtatgctctgagtgggagtacctccgaaactcagcttccaaaactgtgggctcaccagacctccttggtattttttttttttttttttgagacaaggtctccctctgttgcccatgctggagtgcagtggcatgatcacagctcactgcagcctctacttgctgggctcaaatgatcctcccatctctgctctgcaagtagctgggactataggagtgtgtcacaatgcctggctatttttatttttatttattttttgtagagacaggatctccctatgttacccgggctggtctcaaactgctgggctcaagaaaacctcctgcctctgtctcccaaagggctgggattataggcatgagccaccacgctgtgcccctccctggtttttgatccttggtctgacccctggattctcctggttgacttacactctttggagtgctgactagtatagactctcccaatgctgccttttggatgaatcctgtgatgccacattttccagccttaggacaaatgataacctaccctgtagtctgtccatgctctggagaccctgctggtcttacaagatgaactggacaactgctttcactgataggcctgaaggaaaagggttggaactgtcaaggttccccattaaataccaaccagcaatgacaatcaaggtgagctattcttgtgctgggtaggatgctatcttgggctctgagtgtgtccggaattggtgggttcttggtctcactgacttcaaaaatgaagccgcggaccctcgcggtgagtgttacagttcttaaaggcggcgtgtctggagtttgttccttctgatgttcggatgtgttcggagtttcttctttctagtgggttcgtggtctcgctggctcaagagtgaagctgcggaccttcgcggtgagtgttacagctcttaaggcggcgcgtctggagtcgttcgttcctccttgtaggttcgtggtctcgttggcttcaggagtgaagctgcagaccttcgtggtgactgttacagctcataaaggcagtgtggacccaaagagtgagcagcagcaaggtttgttgcaaacagcgaaagaacaaagcttccacaatgtgcaaagggaccggagagggttgccgctgctggcgcctgcagcctgcttttattctcttatctggccccacccacatcctgctgattggtacagcccagtcgtctgttttgacagggcgctgattggtacgtttacaatccctgagctagacacaaatgttcgccacctccccaccagattagctagatacagagtgtccattggtgcattcacaaaccctgagttagacacagggtgctgactggtgtttttacaatccctgagctagacataaaggttctccaaggccccaccagactcaggagcccagctggcttcacccagtggatcccgcaccggggctacaggtggagctgcctgccagtcccctgccgtgtgcctgcactcctcaggccttgggtggtcgatgggactgggcgctgtggagcagggggcggcgcttgtcggggaggctcgggctgcacaggagcccacgaagggcggggaggctcaggcatggcgggctgcaggtccccagccctgccccgcgggaaggcagccaaggccttgcgagaaattgaacacagcagctgctggcccaggtgctaagcccttcactgcccggggccggcggggccggccggccactccgagtgcggacccgcggagcccatgctcacccggaactcgcgctggcccgcaagcaccgcgcgcagcccccggttcccgcccgcgcctctccctccacacctgcctgcaagctgagggagccggctccggccttggccaacccagaaaggggctcccacagtgcagcggcgggcggaagggctcctcaagtgccgccaaagtgggagcccaggcagaggaggtgccgagagcgagcgcgggctgcgaggactgccagcacgctgtcacctctcgtgagtatctctagtgctgctggcgatgagatgattcagtgtggatgattgataccaaatgtatcatggacagtgaaggctgtgtaacaacacatataggtaggctctgttacaggagttacagttctaggcccagtaaatcttttttttttcactgtgcaattgaattttggttttacctatataacattttcatctgtatgaaatgtaagctctatacaattctccattaggacattgtgtggattttggtgtttctgaatctcttctggctcagaaaattccctgctcttgctggtataatttcatacccaaagagggcattctaaccttgaaagaagttcagctcagcagagcgtctgtcattgcctttctctgtaaacacagttttccttcttccttggcttctcaggtgttttagctccagggaggaaatagtcacagtgaaaatctatttaataaaaccgttatgaaaatgtactcaacctgagcatgcactggaacagcagaagatgaggacttggtctactgccttcccaccaaaccttgccggctctgtaaattttcagagctgtcacttgtgagctatttccaccaagggagagcttctgtaaagttggggacttggcaggccatttcgctaattctttgggtgttcttttagcattgtctgcagtgagtgtgggagtcaaaggcccttcagtgcagagataatgccatcttgttccctggaaccccgaaagagccagagtcaaaggagctttttgtttcactcatagaaaaacccacaggaaatcccagcttcagatattcctattcagtttccttgtcccttcagatctcactgtgtttaggcctcctttgagtgaggcaataactagtaaaaaaaaataaaataaaataaatgaaagaatgccattcatggtggcttggggactgggcacacacactgtatacacggtgtgggggccttccccgggacgctgatgtccttgttctcctagcagtcaaaaattggccagtgaaatacagagaatactagctacctcatactgttaagagaattgactgcggtcagatgtgtagagtttcaagtacatacagtttctgcctcactgtaggcgctcaatattattattgaggagctattattagatttcacatctctgccagctcttgtgtcacttattaagcatatgactgggaataagctatttaattctcttcgtctgtaagataggaagtaataatgcttattttgtgggcctattgtgaggatcatgtaagatgagagataaaagggcttagcaaacggtagcatattacaggtggcctgcagcctgccgctgtgcaggtgacgtcccacacaatggtactggccgaggggtgaatggagccctggtgctgaggatggcgagcctttttctaattcatcagctcagaggtgccacctttttctaatttaccctccctaagaggacatctttttatattttaccagcccacagaagataccttttaaaaatttgcacaatggtaccatatgtgctagctgcaattctgtcaacaagagaaagatgttatttttagtgtagcagacagagaattctggagagggcacatggcatgctttatctggctccaacttggtcatttctgtttaatttcaatgatctgattgccatagagtcagaggagcaattttgctattgcccaaattctacattttcactaggattttccttgaaggcaaggactataacccccaccctgcccatcaccttgcttgctcaccactgccctgtacatatccttcagaatggacatttgttaacaatgggtaagagtgtaggctggcctttcacttaccttcctgtgctttgctctttactgctagggctagcagccggaaagctacatatcccaggctttctcgccagctcatttgctgttaaattctgttaataggaggcactggtgggagaccagtaagacggagagaaaaacttcctgattctgggttttactgtgaggccattgcaagcagttgctgtagtgatagtaaggaaggggtgagttggaacatcagcaaccctgcaggtaacccccttattggggctccaatcttagttgatgtagcacttccttggtggcttcagagccaaatggcacaacctcctcaacagtacagcagattgagaaggctgagggacatcgtttaggagcattaatgatgggtgtctagctatgacccccttttccttttcacttctgtcctctccttctcctttgttctcttctagttctttctatatctttgtaacaaattccctatattaaatttcttctgcttgagatacttgaagtggtcttagtttccctgcatttagcacgtggactctctgaatctgttgggtgcttagggcctgggtttgtgccctaggatcctgtgactgaattcttcctttctctttccatcctcatcatgcatgcaggattgtcgcagtagcctttaaatagattttcagccaccagcctctttctgttcactgtggacattattggtagtttaatttttctaaaaatctattttctggatccacatttctgctcaaaactctatttttatgataactatttaagcataggtatagtcatctatgacctaaaccccaaaggcaggatcgtcaccatggccaccttttctgtgatcctaataacagagagatctgtgtcagaagaggattggttgttctttcaccctggctaactggaaggcagggagctcagtggtagacacaccggtcatcatgctggtgtgggaaagatttcaaagcctggccatagctcccactgaagctcctttctgcaccttactgcttccttgtacaagtcaaaccagggcctttagagcagggaccttcattgcactgccctctcctcgcctcccaaatgataatatccagctttcaaggtctgcctgatgtcccagggttaggagggcagagaccaggcagtttatgtcatgtcacttcttttttttttttgtcttttaaaaaatttattatactttaaggtctggggtacatgtgcacaacatgcaggtttgttacataggtatacatgtgctatgttggtttgctgcacccactaacttgtcatttacattaggtatttctcctaatgctatccctccccgcaccccacgacaggccccagtgtgcgatgttccctgtcctgtgtccaagtgttctcattgctcaattcccacctatgagtgagaacatgcactgttcggttttctgtccttgcgatagtttgctgagaatgatggtttccagcttcatccatgtccttgcaaaggacatgaactcatccttttttatggctgcgtagtattccatggtgtatatgtgccacattttcttttctttttttttttttagagataacaatactcactttcaacaatttctagaactacagagaagaaaaacaaggaaatagaagatttgagcaacacaattaactagacctaacacacatctacagaacagtctatccaacaatagcagaatatgtacttttctttttttttttttacaataacagtgttatcatttattattttgattaactcgtcatttagcattaggtatatctcctaatgctatccctccccactccccccatgccacaacagtccctggtgtgtgatgctccccttcctgtgtccatgtgttctcattgttcaattcccacctatgagtgagaacatgcggtgtttgattttttgtccttgcgatagtttgctgagaatgatggtttccagcttcatccatgtccctacaaaggacatgaactcatccttttttatggctgcatagtattccatggtgtatatgtgccacattttcttaatccagtctatcattgacggacatttgggttggttccaagtttttgctattgtgaatagtgctgcatataaacataagcgtgcatgtgtctttctagtagcatgatttataatcctttgggtatataaatagcaattttgctattgccccaattctaaatttttggggcaatttagatcgctgggtcaaatgggatcactgggccaaatggtatttctagttctagatccttgatgaatcgccgcactgtcttccacaatggttgaactagtttacactcccaccaacagtgtaaaagcattcctgtttctccatatcctctccagcatctgttgtttcctgactttttaatgatcaccattctaactgatgtgatatggtatctcattgtggttttgatttgcatttctctgatgaccagtgatgatgagcattttttcatgtgtctgttggctgcataaatgtcttcttttgagaagtttctgttcatatcctttgcccactttttgatgggtttgtttatttgttttttcttgtacatttgtttaagttctttgtagattctggatattagccctttgtcagatgggtagattgcaaaaattttctcccattctataggttgcctgttcactctgatggtagtttctgttgctgtgcagaagctctttagtttaattagatcccatttgtctattttggcttgtgttgccattgcttttggtgtttcagttattaagtccttgcccatgcctatgtcctgaaaggtattgcctaggttttcttctagggtttttatggttttaggtctaacatttaagtctttaattcatcttgaattaatttttgtataaggtgtaaggaggggatccagtttcagctttctacatatggctagccagttttctcagcaccatttattaaatagggaatcctttccccatttcttgtttttgtcagctttgtcaaagatcagatggttgtagatgtgtggtgttatttctgagggctctgttctgttccattggtctatctctctgttttggtaccagcaccatgctgttttggttactgtagccttgtagtatagtttgaagtagtgtgttgcctccagctttgttcttcttgcttaggattgttttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcgttgagcagtagtttgtagttctccttgaagaggttctttacatcccttgtaagttggattcctcggtgttttattctctttgtagcaattgtgaatgggagtttgctcatgatttgggtctctgtttgtctgttattggtgtataggaatgcctgtgatttttgcacattgattttgtatcctgagacattactgaagttgcttatctgcttaaggagattttgggctgagatgatggggttttctaaatatacaatcatatcatctgccaacagggacaatttaacttcctcttttcctaatggaatactctttatttctttctcttgtctgatggccctggccagaacttccaacactatgttgaataggagtgctgagagagggcatccctgtcttatgccagttttcaaaggtaatgcttccagtttttgctcattcagtgtgatattggctatgggtttgtcataaatagctcttattattttgagatacattccatcaatacctagtttattgagtttttagcatgaagtgctgttgaattttgttgaaggccttttctgcatctgttgagataatcatgtgttttttttcattggttctgtttatgtgatggattacgtttattgacttgcatatgttgaaccagccttgcatcccagggatgaagctgacctgatcatggtggataagctttttgatgtgctgctggattcggtttgccggtattttattcaggatttttgcatcgacgttcatcagggatattggtctaaaattctcttttttgttgtgtctctgccaggctttggtatcaggatgatgctggcctcataaaatgagttagggaggattccctctttttctattgattggaatagtttcagaaggaatggtaccagctcctctttgtacttctggtagaattcggctgtgaacccatctggtcctggactttttttggttggtaggctattaattattgcctcaatttcagatcctgttattggtctattcagagattcaacttcttcctggtttagtcttgggagggtgtatgtgtccaggaatttatccatttctcctcgatttttctagtttatttgtgtagaggtatttatagcattctctgatagtagtttgtatttctgtgggatcagtggtgatatcccctttatcattttttattgcgtctgttttattcttctctcttttcttctttattagtcttgctagcggtctatcaattttgttgatcttttcaaaaaaccagctcttggattcattgattttttgaagggttttttgtctctatctccttcagttctgctctgatcttagttatttcttgccttctactagcctttgaatgtgtttgctcttgcttctctagttcttttaattgtgatgttaggatgtcaattttagatctttcctgctttctcttatggacatttagtgctgtaaatttccctctacacactgctttaaatgtgtcccagagattctggtatgttgtgtctttgttcgcattagtttcgaagaacacctttatttctgccttcattttgttatttacccagtagtcattcaggagcaggttgttcagtttccatgtagttgtgcggttttgagtgagtttcttaatcctgagttctagtttgattgcactgtggtctgagagacagtttgttatgatttctgttcttttacattttctgaggagtgctttacttccaattatgtggtcagttttggaataagtgcaatgtggtgctgagaagaatgtatattctgttgatttggggtggagagttctgtagatgtctattaggtctgcttggtgcagagctgagttgaagtcctggatatccttttaaccttctgtcttgttgatctgtctaatattgacagcggggtgttaaaagtctcccattattattgtgtgggagtctaagtctctttgcagatctctaaagacttgctttatgaatctgggtgctcctgtgttgggtgcatatatatttaggatagttagctcttcttgttgaattgatccctttgccattatgtaatggccttctttgtctcttttgatctttgctggtttaaagtctgttttatcagagaccaggattgcaacccctgcttttttcttttttgctttccatttgcttggtagatcttcctccatccctttattttgagcctatgtgtgtctctgcacgtgagattggtctcctgaatacagcacactgatgggtcttgactctttgtccaatttgccagtctgtgtcttttaattggggcatttagcctatttagatttaaggttaatattgttatgtgtgaatttgatcccatcattatgatgttagctggttattttacctgttagttgatgcagtttcttcctagcattgatggtctttacagtttggcatgtttttgcagtggctggtacccgttgttcctttccatgtttagtgcttccttcaggagctcttgtaaggcagacctagtggtaacaaaatctctgagcatttgcttgtctgtaaaggattctatttctccttcacttatgaagcttagtttggctggatatgaaattctgggctgaaaattcatttctttaagaatattgaatattggcccccactctcttctggcttgtagagtttctgctgagatatccactgttagtcatcagacttccctttgtgggtaacccgacctttctctctggctgcacttaacattttttccttcatttcaaccttggtgaatctgacaattatatgtcttggggttgctcttcttgaggagtatctttgtggtgttctctgtatttcctgaatttgaatgttggcctgccttgctaggttggggaagttctcctggatagtatcctgcagagtgttttccaacttggttccattctccccgtcactttcaggtacaccagtcaaacgtagatttggtcttttcacatagtctcatatttcttggaggctttatttgtttctttttactcttttttctctaaacttctcttctcgccttatttcattaatttgatcttcagtcgctgataccctttcttccacttggtcaaatcagctattgaagcttgtgcatgcgtcatgtagttcttgtgccatggttttcagcttcatcagttcatttatggtcttctctacactgtttattctagttagccatttgtctaattttttttcaagggttttagcttcctagcaatgggttcaaatgtcctcctttagctcggagaagtttgttattactgaccttctgaagtctacttgtgtcagctcgtcaaagtcattctctgtccagctttgttctgttgctggcgaggagctgtgatcctttggaggagaagaggtgctctggtttttaggattttcagcttttctgctctggtttctccccatctttgtggttttatctacctttggtctttgaagatggtgacctacagatggggttttggtgtggatgtcctttttgttgatgttgatgctattcctttctgtttgttagttttccttctaacaatcaggtctctcagctgcaggtctgttggagtttgctggaggtccactccagaccctgtttgcctgggtatcaccagtggaggctgcagaacagcaaatattgcagaacagtaaatattgctgcctgatccttcctctggaggcgttgtcccagagaggtgcccgcctgtatgaggtgtcagtcggcccctacttggaggtgtctctcagttaggctacacaggggtcagggagccacttgaggaggcagtctgtctgttctcatagctcaaacaccatgctgggagaaccactgctctcttcagagctgtcagatagggacgtttaagtctgcagaagtttctgctgccttttgttcagctatgccctgcccctagagctggggtctacagaggcagcaggccttggagagctgcggtgggctccgcccagttcaagcttctccagccgctttgtttacctactcaagcctcagcaatggcagatgcccctccctctgccaggctgttgcctcgcaggtcgatctcagactgctgagctagcagtgagcaaggctccatgggtgtgggacctgctgagccaggcacaggatgtaatctcttggtgtgctgtttgctaagaccattggaaaaacgcagtatttgggtgagagtgtcctaattttccaggtacagtctgtcacagcttgccttggctaggaaagggaaatcccctgaccccttgtgcttcctgggtgagataatgccccgccctgcttcggctcaccctgtgtgggctgcacccactctccaaccagtcccaatgagataaacaggtacctcagttggaaatgcagaaatcaccatcttctgcatcgatcatgctgggagctgcagaccagagctgttcctatttggccatcttggaacagaatgcatcatgtcacttcttatacatgaatgagaataactgtgaaatgtgcacatgtgctctgagcctagataagattgttactatcatgttatattgttattattgtgttattatcgttattatcatgttattttcttacccataggttttccaacttgcttgaagtaatgctttcaggatactcaatattgaatattcaatactgatgggaaaactttcttaaaggaaatggacattacagggtcaactggaggaaaaataacacatttactgctcaaacatagcttgttgtttttatatttaaaaacataggcattgtaaaaagtcaaacaagcctgaaaaatgtatgggagaagatgaaatgatcactgaagtcacatattcctcactgttaatgatttagggaacatccttctagaaggttcacagagccatacaactttaccgaaatgggattatgttgcatcttgttttccaacctaattttttcccacttagtagtatagcacagatatgttttcatgtcaaccagtatgactttacactgttatttctttcttcttttttttctgagatggaggctcgctctgtcgcccaggctggagtgcagtggcacgattttggctcactgcaacctccacctacctggttcaagcgattgttctgtctcagcctcctgagtagctaggattacaggtgcctgccaccacacctggctaatttttgtatttttaatagagacggggtttcaccatgttggccaggctggtcttgaactcctgacatccggtgatctgcccgccttggcctcccaaagggagggattacaggtgtgagccactgtgcccggcctaatggttacacagtattccatgctgacaccataatttactcatccagttacattaaattggaatgttcatagttgttgacctttagaacatgccagtattaagtttttgtatttaaggtgatgctagttctaaagcatatattctgaaatctcagtggcttaacacctcagaagtttatttctccttatgtaaagtttaggttctctccatttgctgatggttaccttgaggtaccaggcttgcgtggaggggctgctgtgccttgcatggccatgcagggactcaggccctctccagcgtgtggtttgcaaggttgccctggcccttgctgcttagctggctgatagtggaagagaaagtgaagaagatgtcacaggaggttttaatggatcagaactggaagtggcagatactgcttctgcccccattccattggccagaatgtcacatggccatacaaaactgcaagggaggctgggaaatgccactcatctgtgtgtgtgggaggaaaggaaatacatttggtgaatactagctagtctctaacagagcttcccctactgtttaccaaattcctgttttgcttttcccctcacacacagaacacacccctcccagagtgagggaccctaagtcccatccagccctggcaccttgcttagtcactgttcaggatctctgggtgatgtgctgtcttccccatcacatctaaatgaggatccttgtggtttgatgacttatgaactagaagagaataaagttatttgcctcctccctagcgcctcccaattttcaatgaagcagggaagcattgtaacattagaagctcccatttagaacagagtaaagagcgggcagcacagtcatcacaggcccaaagcaacaatggaatccagttgggtgggcaaggtggaggttctcaaccagagggtgggagaactttcttgattagaccttgattttgccagaaaaggcaatctcttctcagttggtctccatggtccgagctctgtcctggcaagttccttcttgcactttattctcaatggctacgtttgaagtgattgcaggggagtccgccatcttaggagggtacacagctttgcagccctctagtgccctgctgttgtttcaaggctcaaatagacaaacgtctttaaaaaattttatttttagtccaggctcatggtttctttggccatacatttatgtcaaaaatttgataggattctgttttttttttaaattaattacttttatttttgacaaataatttacatatttatggggtacaatgtgaagctttcatatatttattcactatgaaatgattaaaccaagctaattaacatatccatcatttcacgtgtgtgtgtggtatgaaatttttgtgtgtgtgtggtatgaaattcttagcaattttgaaatatattgcattattattaactatagtcaccatgctgtggaataaatcttaagaacttattccttctgtctaactgaagctttgtatactttgactaacatcttcccatccacttctacccttgccccagcccctgctaaccaccattctattctctacttccgactttttttagattacacctgtaactgagatcatgcagtatttttctttctgtgcttggattacttgtttctgttctgttttcttcccttaagttttttatgccaatagcaaatccctaagtttttttcctagatattattaccaagcttgaattattatattactttctcaccctaatacccttttctgtcaatgagatggtgacttccttgaggccttcagggtcagatgggaaggcaaaattcttaattagctctttgctacaaggctgaatcttttacctgtgtcactcaaaagccttttcaatcttgtttcttactcctcagactttagaagcagtcatttcttccaaggctttacactcagaagtttctggacaaacatctggactctattccctttcattttatgcttgcaaaccaacaaattctttttttaaaaaagtattttaatagctttaggagtacaagtggtttttgcttacatggatgaatggtatagtcctgaagtctgaaattttagtgtacccaagttgcgtacattgtgcccaatatgtaacttttaaagtcgcccctcccacactcccctattctgagtctctaaagtccattatatcactttgtgtgcctttgtgtatccatagcttagctcccatttaccaatgagaaagtacagtgtttggttttccactcctgagttagttcacttagaataatggcattcagttccatctgagttgctgtaaaatacattatttcattcttttttatggctaactagtattccatggtgtatatataccacattttcttcatccactcattgattgatgggcacttaggttggttccatagctttgcaattgtgaattgtgctgtgataatcatatgcatgcaggtgtctttttgatgtaatgacttcttttcctttgggtacctagtccagtagtgggattgctggattgaatggtagatctacttttagttctttgagaaatctccatactgttttccatagaggttatactgatttatgttaccaccagaagtatataagcttttccttttcaccatatccatgccaacatctcttgttttttgactttttaataaagggccattctgtttgggataaggtggtttctcattgtggttttaatttgcattccctgatgattagtgatggtgagcagtttttcgtatgtttcttggccatttgtatatgttattttgagaaatgtatattcatgtcatttgcccactttttaaagggattttttccccttgctgatttgtttgagttctttgtagattctgggtattagtctgttgtcggatgcatagtttgcaaatattttctcccattctgtgagttgtgtgtttactctaatgattatttcttttgctgtgtggagcattttagtttaagtcttatttatttatctttgtgttggttgtttttggggtcttagttataaattctttgcctaggctactatccaaaataatttttcctaggttttgttctagaatttttatggtttcaagtcttagatttaagtctgtaatccatcttgagttgatttttgtgtatagtgagagatagagatccagtttcattcttctacatgttgctatttagttttcccagcaccatttattgaatagcatgtcctttcttcaatttatgtttgtatatgctttgttgacgatcagttggttgtaactatttggctttatttctgggttctctattctattctatttgtctatgtatctacttttataccaataccatgctattctgattacaatagccttgcagtataatttggagtcagttattgtgatgcatccagatttgttctttttgctcaggattactttggctgtctgtgctctttttttggttctatatgaattttaggattgttcgttctttctttttcttttcttcaacttttattttaagttcatgggtacatgtggaggatgtgcaggtttgttacacaagtaaacgtgtgccatggtggtttgctgcacagatcatcctatcaactaggtattaagcccagcatcaattagctattcttcctgatgctctccctcccacccactgcccactgatagttcccagtgtgtgctgttcccctctatgtgtccatgtattttcatcatttagttcccacttatagatgagagcatgcattctttggttttctgttcctgtgttagtttctggaggataatggcttccaactccgactccatccatatccctgcaaaggacatgatcttgttcctttttatggctgcatagtattccatagtgtatatgcaccacatttatttatccagtccatcattgatgggcatttagattgattttatatctttggtattgtgaaaaatgctgcaatgaacatacacatgcatgtatctttataacacaatgatttatattttttggggtgtataccccgtaatgggattgatgagtcaaatggtacgcctctaggtctttgaggaatcactacactgtcttccacaatggttgaactaatttacactcccaccaacaatgtaaaagcatttctttttctccacaacctcaccagcatctgttgttttttgacatcttagtaacagccattctgactggtgttagatcgtatcttattgtggtttttatttgcatttctctaatgatcagttatgttgagcgttttgtcatgtttgttggctggatgtatgtcttcttttgaaaagtgtctgatgatagtttcttttgctgtgcagaagctctttagtttaattagataccatttgtaggtttttgcttttgttgcagttgctttggtgttttcatcatgaaatctttgtccatgcctatgtcctgaatggtattgccttggttgtcttgcagcatttttatagttttgggttttacacttaagtctttaatccatcttgaattgatttttgcttaaggtgtaagggatgggtccagtttcaattttctgcatatggctagccagctctctcagcaccatttattaaatatggagtcctttccccattgcttgtttttgtctagtttgttgaagatcagatggttgtaggtgttgggtcttatttctgagttctgtattctgttccattggtctatgtgtctgttcctgtaccaataccctgctgttttggttactgtagccttgcagtatagtttgaagttgggtagccatgatgcctccagctttgttctttttgattatgattgtcttggccatttgggatttgttggttccacatgaattttaaaatagttttttctaattctgtgaagaatgtcaatggtagtttaatgggaatagcattgaatctataaattgctttgggcagtatggctattttcatgatattgattcttcctgttcatgagcatggaatgtttctccatttgtttgtgtcctgtacgatttctttgagcaatggtttgtagttctccttgaagaggtccttcacttcccttgttagctgtattcctagttattttattctttttgtagtaattgtgaatgggagttcatttatgatttggctctttgattgcctgttgttggtgtgtaggaatgctagcaatttttgcacattgattttgtatcctgagactgctgaagttgcttatcagcttaaaaagcttttgggctgagatgatggggttttctagatataggatcatgtcatctgcaaacaaagataatttgacttcctctcttcctatttgaacactctttattttgttctcttatctgattgccctggccagaacttccaatactatgttgaataggagtggcgagagaggacatcttgttttgggctgtttttcaaggggaatgcttccagcttttgcccagtcagtatgatattggctgtgggtttgtcatatatggctcttattattttgaggtatgttccttcaatacctagtttattgagaatttttaacatgaagggatgccagattttatcgaaggccttttctgcatatattgagataatcatgtggtttttgtctttagttctgtttatgtgatgaatcacatttattgatttgcatatgttgaaccaactttgtatcctggagatgaagccaacttgattctagtggataagctttttgatgtgctgctgcattcagtttgtcagtattttattgaaggtttttgcattgatgttcattaaggatatcggcctgaggttttctttttttttgttgtatctctgccaggttttggtatcaggatgatgctggcctcatagaataaattggggatgagtccctccttttcaattttttggaataatttcagtcaaaatgatacccctttttctttgtacctctggtagaattcagctgtgaatctgtctgttcctgggctttttttggttggtaagctatttattactgtctcaatttcagaactcattattggtctattcagagattcaatttcttcctggttcagtcttgggagggtgtatgtgtctaggaatttatccatttcttctagattttttagtctatgtgcatagaggtgtttacagtattttctgatggttgtttgtatttctgtggggttagtggtgatatctcccttaacattttctattgtatctatttgattcttctctcttttcctctttgttagtctagcaagtgatctattttattatttttttcaaaaaaccagtttctggatttgttgatttttttgaagggttttttgtgtctctgtcttcttcacttattatgccctcatcctggttatttcttgtcttctagctttggagtttgtttgctcttggttctctagttctttagttgagatgttaggttgttaacttgagatctttctagcttttgatgtgggcatttaatgctctaaatttccctcttaacaccactttacctgtgtcccagagattctaggacattgtctctttgttctcattagtttcaaagtacttattgatttctgccttaatttcattatttacccaagagtcattcaggagcaggttgttcagtttccatgtagttgtgtggttttgagtgaatttcttaatcttgagttctaatttgatggtgctgtggtctgagagactgttatgatttcagctcttttgcatttgctgaggagtgttttatttccaattatgtgatcagttttagagtaagtgccatatgtcaatgaggagaatgtatattctgctgttttgtggtggagaattctgtagatatctatcagatccacttgatccagggctgagttcaggtccttactatctttattaattttctgtcttgatttgtctaatattgtcagtgggttgttaaagtctcccactattattgtgtgggagtctaagtagtctaagtgtgtcattcttgaagaacttgctttatgaatctgggtgctcctatattggatgcatatatatttaggatagttagctcttgttgaattgaactctttaccattattaatgcccttctttatattttttgatctttgttggcttaaagtcttgttttgtcagaaattaggattgcaacccctacttttttctgttttccatttgcttggtaaattttccttcatccttttattttgaacctgtgtatgtcttgcatgtgagatgggtctcttgaagacagcacaccagtgggtcttggctctgtccagcttgccattctgtgtcttttaattggggcatttagcccaaaaaaaaaatatatatattttatattttttgagatggaatttcactctgtgtcacccaggctggagtgcaatggtgcagtcccagctcacggcaacctctgcctcccgggtgaagcgattctcctgcctcagcctcccgagtagctgggattacaggcacctgccatcttttagtagagatggggtttcaccatgttggccaggctggtctcgaactcttgacctcaggtgatttgcctgcctcaggcttccaaagtgctgggattacaggtgtgagccactgtgcctggcctagcccatttatatttaaggttagtattattatatgtgaatttgatcctgtcatcatgatgctagctggttattttgcagacttgtttatgtagttgcttcatagtgtcactggtctgtgtagttcagtgtgtttttgtagtggctggtaacagtttttcgtttccatatttagtgcttcctggtggtgatgaattctctcagcctttgcttgtctgaaaaggatcttatttctccttcatttatgaaccttagtttggtcagatatgaaatcttgggttggaaattcttttctttaagactgtagaatattggcccacaatctcttctggcttgtagggtttccattgagaggtcctcagttagtctgattggcttcccgttgtaggtgacctggcctttctttctggctgcccttcactttttttttttcatttcgacctggagaatctgatgattatgtgtctgggggttgatcttctcatggaggatcctactggggttctctgcacttcctgaattgaatattggcctatcttgccaggttgggtgagttctcttgaatgatatcctgaagtgtgatttccaacttggttccattctccctgtccctttcaggtatcccaatcagttggaggtttggtctcttcatagaatcccatatttcttggaggttttgttcattccttttcattcttttttctctattcttgtctgcctgtcttatttcagaaagatagtctttaagctctgaaattctttcctccacttggtctattctgctattgatacttgtgattgcattgtgaggttctcgtgttgtgtgttttcagctccatgagcttggttatgttcctctctaaactggctattctggctatcagcttctgtattgttttatcatgattcttagcttctttgcattgggttacaacatgctccttttactcagtgaagtttgttattacccaccttctgaagtctacttctgtcagttcagtcatctcagcctcagcccagttctgttcccttgctggagaggtgttactgtcatttggaggagaagagccactctggctttttgagttttcagcactgattctttgcttatctttgtgggcttatctaccttcaatctttgaggttgctggcctttcaatagggttttgtgggattctttttgttgatctttttgttgttgttgttttctgtttgtttttcttttcatagtcaggccactctaccgtagggctgctgcagtttgctgggggtctgctccagaccttggttgccttggtttttcctgtacctggagatatcaccagtgaaggctgcaaaacagcaaagatggctgccagctccttcctgtggaagctctgtgccagggggatactgacctgttgctggccagaacatatctgtaagaggtggctggagacccctgtttggaggtctcacccagtcaggtggaatggtatcagggacccatttaaagatgagtcttgctgctttttgtctgaggaggtgtgctgcattgtggcagacccttcctcatctggactgtttgcattctccaaagccagcaggctggaatggttgagtccactgaaccacagagatggcagccacctctccccctgggagctgcatccgagggagaggtcagagttctgttaatagaacccttgttggcgtggctgaagcccccacagggaggtccctcccagtaaggaggaatgaatcggggtcccacttaacgaagcaatctggccacagtgtggcaaagcagctgtgctgcattgtggggggcccttcctcatctggaccatttgtattctccaaagctggcaggctggaaaggccaagtctactggaccaaagagatggtggctgcccctctccctggaaactcggacctatctcaggcagattccagcctgttgctgttgtatgcctaagttaagttggtataaattcaaaatagattgttataactataggatattatatgtaattcccatggtagccacaaagaaaatatctatagaatgtacacaaaaggaaatgagaaaggcatcaaaatgtgcctctgtaaaaaaaaggtcaacaaaacacaaagaaaactggtcatggagaaaatgagggtcaaaaatactgtaagatataaaggaggcaaaatggcaaaagtaagtccttccatattagtaatcgagactctgtcttaaacaaaacaaaacaaaacaaaagaaacaaacaagcaaacgaaaaacgtccagtcaaaagcatagattggcagaatgaattaaagaaaaacatgatctaactgcatgctatgagagacccactttagatctaaaggttgaaagtgaaagcatagaacaagatgtaaatagtaacaaaaagagagctttggtgtctacactaatatcataaaatagaatttaagtcaaaaatttttacaagaaaaaaggacattatatgttgataaaagggtcaatttacctagaagatacaacaattcaaaacatatatgcaccaaacatcagagctccacaatatacgaagcaaatgttgacagaaatgaagggagtaatagacaactctgcaatcaaatgcctgaataatgcagtatgtgggctagtccagcctctctcatgatttccacatcactttgatgtggacatcctggacatctgcagttttcagttacttcctgtttcctgctggcatttaagtcccttgtactttatgtgaattcttacttcagttatactgcccctacaacttgcaatgaacattctcactttggttgtatcactttccaccctcctgcctgaaatctgatgctttccttcaagctccatccccactaggaagccttttgtatgagctaagattaacaacttgcatcctttaccctccacgtgttgcatatacctataccactcatttagcacatcacatttgatacttatttatttgacacatgtagctatatttaatctatttgtttggtctcctccataaccagagctttatttccatgggggctaatgctcctttaagtttctggcaatgattactgttatatagatgcagaatcttatttttttaatgaattaacagatgtctccctaaattaggcccaaatactgatcttaatcctaaggattagctaatagaagcatcataggtattaagttggacagatatggccaaactgtttaattttgtgagcttcagtttcatgtgctaatgccatatctatctatctatccatctatctatccatccatccatccatccatccatccatccatccatccatccgtctatctatgtctagcttgaccatcacaacagtctaaggagaagctatgcttatccctgtttttcagatgaggaaactgagacccagagacattaagtaatttgccaaaattacccaactcacacatgaaagagtcaaggtttgaacctagatctccctgactccactgcttgttattttaaacatctacaatatttacctttcagttcttgaacttaatcttgcctgagatctaagttcaagcctttcattatccacatccccccatatctaatgatagttgtggtaggcagaataatatccccccaaagatgtctgcatcccaatcctggaacctatgaatattttaccttgcatgacaaaaagggactttgcagatgagattaagttaaggatctttagatggagagactatctttgctatccatgtgaacccaatgtaatcatagggtgctcataaaggaaagagggaggcaggagtcaaagtcagagagagatttgaagatgctcaactgcttttgaagatggagaaagggaccaaagccaaggaattcactgacaccttgattttagcccagtgagactcactttgacctccagaactgtaaaataatagatttgtgttgcttgaagccactaaatttatagtaatttgttatggcagcaataggagactaatacagttgaccctcgaacgacacaggtttgaactgtgagtccacttctacatgaattttttttttagtaaatatattagaaatatttttggagatttgtggcaacttgaaaaaactcgcagacaaaccatgtatcctagaaatataaaaaaaaaataagaaaaagctatgttatgaatgcataaaatatatgtagatactagtctattttatcatttactaccataaaatgatacacacatctattctaaaaagtaaaaatttatcaaaacgtatgcaaacagagtgtacatggcatcctttgcagtggagagaaatagaaacaacataaaaaatgcagtattaaatcataattgcatacaattaactgtatacataaggtactgtggtaataatcgctgcattgccacctacattgctattgtggtgagctcaagtgtgggaagtatccacttaaaatgccatgtgatgctaaccgtctgcacatgagcagtttctctctccagtaaattgcatattgcaatgaaagttatctctttcagttctcacatttttttttgtgtttggagcaatactataaactttgagtaacacagcgggactcatacgaagtgccactactgatgctggaagtgctcccaaaaagcagagaaaagtcatgacattacaagtaaaagctgaattgcttgatgtgtgctataaattgagatctgcactgtggttgcccaccatttcggacagatgattcagcttgtaagcagacaatgtaaacttacaatatcaataagtaaagtacagtagtgtaaatacattttctcttccttatgattttcttaatattttcttttccctagcttaccttaattgtaagaatataatacatatacagaatatgtgttaattgaccttttctgttatcaataaggcttctggtcaacaatagcctattagtaggtaagattttggagattcaaaagttacagtgaattttaactgtgcaggtgattgatgcctaattcccatgttgttcaagggtcaactgtacaataggttttctgctttccttaccctcctgatgatttctgaactagttctacagagtttcctcttttcctttgcatctctccttcccactgccaccatccagattgttttcagagcggcacttcatcagctgcatcgtcaccctctgagggtgtggaagggctctcacttccacttaaggccatgccatgctaattgcctttctggctcttttctcttaaaaggtggtgcttagaaaggaaaggaatagtccatatgtggtcttagtaggacagggaacagtaggtctttacctcccttaatccgaatgttagatctcttcaatgcaatcaaggtaatgcttatttttttttggcacccacatcacatccactgctcactcaggttgagtttattgataactacaaccccaagcttttcatgtcatattaaagcaaaagccattatgagctgttcttatatctcgtagaatgtctgccatcttgtgtcatgtagcttttgtctcaggaaaaaaaaaaaaaaaaaaaagcacagtacgaattaatctctccagggaaagatttaaagactaggataataaggagagacagatggaattctgagagaaatatggcaaattctagagctaatctaattaaagggccatgggaacttctccctggcgcataaataaaatatgacaatcagtgtcagctaagaaacccttagcaaatacctaatctcatttttaaatttatcattacatagaactgttatcttttaacaaataatggtatgatgcaaaataagctgagagaagccaacagacacaggccaggcagctgcccagcctctctgcccacccctccctacatacacttcaggtggcatgggctctcccagccatttcgatacatgacacctctgtgacctcgccagcttgaaggataaaatgaaaggttcttagtgaaggaaaaaggcgttcatcttcaccccatcgtaatgggctctgaggaggactggcaacatgtagaatctggagaggagaggtcaggactggctgcagaggaggaagctgctgaggtgattagtagttctcagagagggccttgttctttccctttaaattcaaaatggcagtgcctcaaaccctctgggcttcctggaatttgtgtttaaatgtttatgtatttccaggcgaatattcaaacaatgtagctaagatgtggtaccttcaaagcaagtaaaccagctggcttccctgctatgatccccttgcacagcctggcccttcagacaggagcctgtattctgaaggaagtccttacagagcagcttggatctactaccccttaaaagaaggaggaactggtgaaattatttccattaactttaaggtactcaagaggaccacagaggtcttattcttttcagtttggataaatctggggcagtccaaaggttgccaagggaggtaggaagaaaagtttaatttgcacacttgagctttacagtctgtctgacttcattggagtttacttctttttaaattgcagactcagggcttaaatacttccttaccttcagtgacctttcctgagccctcctgttcctgataagctgcagggcagtgctttctttcctatgatgtgttgtcatattaacacacacacccagagtgattactgtgttcacttcccctggatgtgcttcatctttgttgagttaaaatcaaattgctttctacttcagtaaatccaattcagccttcttactgaccatgggttaaagttttaatttaaaattccctttcttttaaaaattagcaattcaaattcaaggtggtaaagcagcccacattctgagattgttggtgttggaaagggccttagctatcgtctgtcctgcgtgatgcttctgttgaattatctcaaggacagaatagttactactttgaacagattaggtggaatgatgtaaatgaaagtgctttgtaacttgtaggacattaaaaaataaatattattagcatttataaagatgctttttccattgttgccaatgttacttattttttcaaaactactttattgaggtcttattgacataaaaaaagctgtacatacttagctgggcgtggtggggggtgcctgtaatgcaagctacttgggaggtcaaggctggagaattacttgaacctgggagatggaggttgcagtgagctgaggttgcactattgcactccagcctgggtgacagagcaagactctgtcaaaaaaaaaaaaaaagctgtgcatacttaatacatacatcttgataagtttcaggataagtacaacacacttgtgaaaaccacctgtgaatcccacttgtgaaaccaatcattaaacatgtccctcaactcccaaagtttcttctttattattactatgattaattttttttggtgaaagcatataacataaaatctaccctaggcaaattttaagtatacaatgcagtgtttgttagctataggcattatgctgtatagtacagcatactgtacttactagcttaagctttatatattataacatgtgttttcctgttgaactcctgtcttccttcttgtgggtataaactagaataactttatagatcgcttgggaacatttttcacctcaagcggccattcctgtccaggtgtgggatgtgcaacacagtggtccaagagatgattttcagagtcacaaggacatggcatggggtaccattgactcacgttctcctgctaaggtgaaagtctcaatttgctgctagtgcatctttaaccttctctaactctcatttccctttgttataaagacagagctcagcagacttctgtcccaaaatctttggccaacagcaaaccatatttgtatggttatcttctaattatggggagtgattttcatatcccagtgatagtgataccaaaaaagaataaaagtatcctttaaattgacaagcaccatgaagtggtttgagactggctggtgtttgggacatggctttccacggagcttgagagatgggccatggatcagattactgcccactgtgacagacaacacacaatttgccatttcctatggcagtctttgacatatctgaagtcagtgctcatgtgtcctttcagccttcccttctttaggtctcacccttccagtttcttcacatgttccttatttgatgttctcctgcaatggtgactggagtctatcagtttttcttttgaggaagctccctgttcatcatttttatagaaggagcccttgttctgatatcagagagcagttcctcaagttggttgagaaagggaagtcagggagcaaaggagagttaatagggatgacatggaagaattgcagtgatagggatgcctgggaattgttaggagaacacttaggtccttagatgtctttatgttggtgtacaaaataggggttatcaaaactataaaaaccctggaagataactgaggcaataccattcaggacatagacatgggccaagatttcatgatgaagatgccaaagcaattgcaacaaaagcaaaaattgacaaattggatctaattaaacttaagagcttttgcacagcagaaaaaactatcaacacagtaaacagacaacctacagaatgggagaaaatttttacaaactgcatccaacgaaggtctaatatccagcatctatagggaacttaaacaaatttacaagaaaaaaaacaaacaaccccattaaaaagtgggcaaaggacatgaacagacacttttcaaaagaagacatacatgcagacaacaatcatatgaaaaaagctccacatcactgatcatgagagaggtgtaaatcaaaaccacagtgagataccatctaacaccagtcagaatggatattattaaaaagtaaaagaataacagatactggcgaggttgtggagaaaaaaacgcttatatgctgtcggtgggagtgtaaattagttcagccattgtggaagacactgtggtgattcctcaaagacctaaagacaggaatatcatttgacccaacaattctattgtggggtatatacccaaaggaatataaatctttctattataaagacacatgcatgtgtatgttcactgcagcactagtcacaacagcaaagatatggaatcaatctaaatgccaatcaatgatagactggataaagaaaatgtggtacatatataccatggaatactatgcagccataaaaaagaatgcgatagggacctggatggagcgggaggccattatccttagcaaactaacacagaaacagaaaaccaaacaccgcatgttctcacttataagtgggagctaaatggtgagaacacatggacatatagaggggaacaatgcacactagggcctattgaagaattggagggttgaaggaggaagaagactaggaaaaataactaatgggtactaggcttaatacctgggtgatgaaatagtttgcacaacacacctccatgacacaagtttacctacatgcccctgaacttaaaagttaaaaaaacacaaaaataaaataggggttataagcaaaatgtgtgcaacaggtggtacatgtgtaaagactgtcaagattgggttgaaaagtctgtgagagtgcctttgcagcttgcttctctgagccttaaggtgttccacctctaaaattggttgaaatgaggtattgtatggaaaaggctttggtaaacgaggaagtgctatacaaatgtcaaatattagttttttcattagttatattgttattttatgtcactgttataacattgacattctgttcagtgtttatcctggtttctcttcagatcatataaatcttgtgacttttacgaaagattcccatgaagaggaacaactctgagacttaaaccaatttttcagccttggtgctttgtataaaggatccagcactccccagtagtcctttcataaaagagccctgccattcccaagtccattgtcatgatttattgcttgcttgttgggatttcaccatctagaggtttttaatcaagaaagcctatggttgttttagtatccaaatccatgcatgttaaataatgactttttattgtctttataatgtctgccaacctggctgggtataaaattcttgagtatgccctgctccccacctccatccaaactgtatagggagtgttacttggcgttgaatattgccttggaagccagctttaattttgccctttgtacatgacttgagttttttcagagaatcagtcaggattcattcttttttctttggatttcagtgattttaccaggacatcttggtgttggtcataatatttcaatttgttttttaggagctgtgtgatcttttatttgtaggtttagtttggtttcctatttattttttcttctcaagggacatcaattgtccatatttttgtttgccttgtgtatatatcatcttccttttcattattttttttttaccttttcctttgcattttgctattttctcaagttgatattccataccattgactctattttcagctgtaactgtgcctcttgctgcttctgagatggcttcatattatgaatgaactgagcagaacacccaggcaggcatcagttggcctatggtaaatcttcctaggttatcataaaaaaattaacattaccatagctcagattaatagttggccaatagctgccttcttctccccagctcaacacatgcttgaactctccattctcctgagtaaaggaccttggaaaaacactccttaagaactggagaaggttgtattggttttagtatctgccattaattttatccacattttacagtatttggcaggtattctcatggttttaagaagcaatatagtgttaagagcatagttatggagaaaactgcctgggttttaattaaaatttttccagttgctagccatgtgaggttgggcaagctacttaacctcttgattcctcagttttcctcatttgtgaaggaggttagtaatagcactgctatgagatgaaatgaattaatatttgtaaaatgcttataaccctgctgggtacaaagtaggtgtcttgaagtgatcataagatgcattgtcaataaactttcctccccaatttctcaatcactttgctcatttcagtgggtttcacagaggtgtcattaactgtctttattccattatattgtgccagaggttgcctgatttgttttgctcataacgggattgttttaattattcatttagaattgcatccagaatatataactggctggctagtctgtgcttcttagattctgttttttttctcttcttgaaacgagaatacttgtcaatctttgatcttcagtaagtccatgatttctcaaggtctattgagtatatttctgtcatcatgtctgtcagttcttttagtactagatcctgactgatttgacctcagttggggacatgaactcatttgaaatggctaggtactctctttctatctttttacctctcttgggcttcaattcctcctaaattatgctaccactatctttttcaatctgaagatcattttctttaatagagatgaaggctgagaatttgagctatgtcattctgccctgtcttctctcttatctattatcactgtgccctagatactgggcacttccctgcctggttgactttcttgtcctgctccatttgtttgtgtgtttgtttgaagcacacctttgtgctgtccttagtatatttacaggaagtggagctcattctggcctttggtcttcttgacatttttcttattgctttgtgacccccttgggcttactcctggttgcttcccttctgtggatctttgtacatgtcctttgaaaatttctgcctttcagacagcttccttttcaatctcagaagtacttgtagatactttacccaccttgtctgccttggcattattgtactaattaatgtcttggggcacttgggaaagatacctgttgttccttaactccctgacctgggggtttggtttgggagaggtgagaagaggcccagaaatctgcatttccacaaacctcccaggtgattttgatgcacgtgacccccagatcacactcatgcctaactagtttggtgcagaagctcctaacctcttttttctgatcaagctgtccatgaagctgagttgatgagtgacctctggtgagtgcagggggactccctggggcttaccccagggtcaggtgcaatggttcttggcttgaagccagctctaattctgtgccttcctttgccactcaagaaagacaactgaatatctgaacttgaatctgttttcattataaagaattaaataactcgcagttttagtgctttattacttcctccaacatatcttccactccattactggtgtgctgtcccctggaggtgggaaaatgactcactcagcatcctttccttggctatttctttcttttcttttctttttttaagaaactggggtctctctctgttgtccaggctggagtgcagtggctattcataggtttatcataatgcactatacccttgaactcctgggctcaaggaggctgggctactcctcagcctcttgagtagctgggactataggtaggcgccaccacatctggctttcttcttggctatttttaactctagtttgacctggtcactttctccagagatttctttccttccacataatctgtaaattctgaatggctgtcagattaagtctgatgccattcactagaaaagatctttcattaggaggctctacttgaaaccaaacggactacagcacattttcaacttggaaagatttgaagaactgggaagcatgaagatctttgtacctaattcaaggcagtgatgtttggacacttcgactgtgtcgtgtttctcttagagctcttagtaggctggttattctgaaaggttggagtgtctcatagataaacaacaaacatcattgagtaattatacttttggggctcacgtttgagtattgacaactgtgaaaagaggaggtatagactccttacgagtttagtcctatgctctaagacatgtgcatttatcccagactctcgtataaaaagccagtgcccattgtgtgcagaatagggtaggactgaggccagacttcctgggatctagtcctggagctagcactaaccagctgtgttacttatctcctataaacctcagtgatcttatcttaaaaataaggtgataatgatccttacctcattcagttttggcgaggattaaatgacataaaatatgttaagagcttagaatatgtctggcacttagtaagtgctcagtgaatttatgatgcgtaaatggacatcagattatgtcagatttgtcaagctagtttttgatttttttttttccaatccctctctgatttttttctgcgtcacatctgttatatgtgccattttgaagctttgtaattttgggaggaagagtaatgggaattgaataatgtgggcagtcactgagctgttactataacaatatttgatccatagccattgggataagaccatgctatcaattgtagaaagtagcattagtaaaacatttcatttctatggcactttggagtttacaatgtattttctaatgtcctgtctaatttgaatacaaagaaaatatgaagtgcagagaaataactgattttctttttgtctcatcaccaggctaggtgtgacccgggtgtgcagcctcagcttggtgatctcacacatcatcaaagcagttctctgcagtacattgaagcacttgttgggtacacagagtacctgttgttaggttaagcattgtaggaagttgtaagaaaagcagctttgtatggccttcgtggccatgtgtatgtagttctgcctaagagcaaagttaaataaacttgtagccaatatgacaacacagcctgatgacagaaaaaaattccccagataaccttaaaactcacctagaaggagcgaggatttgtgtagtgttccggatgtccctttgttttcaccccattcctacgcccgcccagacttacctttgctgtcactggggctcttttggaggctgggaaggattttaatcctgtctggtcctttcccaagaatagcagtatgattgaaaatgtgcccacaagcataatctctgaattggtggatttaaaacaaagttgatgagagacttccaacggcaagtgtgtaaaaagaaaatatctctttaaaagatgttattgataatgaaaagctgagacccttgatactctgcacacggctagtatgggctttatacagattcagagacatccatgtgtgtcctgcttattggtccttaggctactcccgcccgcaaagtgtagcgctgtcttggtggatcctgccggaatgacacatctttttgctttgggatgattgctgggtcctggggtctctctccctgcctcttccccagccctaccctattgcacattttagtgtggcttagctctgttgcctttgtggtggttaacactcaacctcagagacaaagatctaagcaggaaggaggatctattgtgaaccggttggaagttgatttttgaccctaagaaattagttcaccttatcatcagatagagatgctatttgtacatttctccctcatacatgtacatttactctcaaaatttcctgggctagtaggtctctcaaggtggctgagagaccctagaaggtaccagtgtaccactgggccgcatccttaaagatggtgctgtgagggacagccatggaggcccatgtgcgccattgcccttatcccttgggggctctctggatgagggctttctctgtctttgtcttctcttgtcttcgaggtccttcttactcccttgtccaatgtgtgacatcttatcttttcctccatgagctccatttttctgttccaaatagctctagtctgctggtatattgtatttgttttttcttttcttttttttttttttttgacacagaattcccactgtcgcccaggctggaatgcaatgatgtgatctcgggtcactgcaacctccgcctcccgggttcaagcaattctcctgcctcagcctcctgagtagctgggattacaggcgtgcgcctccacacccagctaatttttgtatttttagtagagacagggtttcactgtgttggtcaggccggtctcaaactcctgacctgatgatccatctgccttgtcctcccaaaatgctgggattacaggcatgggccaccgcccccatcgtctgctggtatattatactcctttctctttgtttagttaaattatttctgctttgttttgatacataacagtggtatattagtctcaaccctttggaacatttttaggtcccgatgctatcatccattatgttgaagaggacaggtcaaaggaaagagccctgtgggaccttccctgtgaccatttaggatttagagtcatttggcctggaactgttatttcccagctacgaatccacctacctgtcccaccggtctgtgtctccagcctccacttctacacatggaaatcaggagaggctgcgtcttaaatccttttggtaaaatccagacatttatgacctctacctctcccatagtttaccatgcctgacccacagtagagttcttaagaaatactattgtcttttccccatttcttatttcctgtttaaataaaataaattcagtatttgtctttctagtgtgttgacatgtctcctattctcccaaattcctcaaagaccagtgcagcaatttaccaatctcattttcacattccttcagtgtaataagtgaattaaagccaatttattatccaggattgcctcatttatttcaaaataagctgtgtaccaagaaagctctattccctcagcaagagctaactccagttttaaagctcattctagagaaaaacagacttttatagtttgttttagctattaaagaccccttttaaaaaagaaataggcctttggatgttgccaggggttagaaagctagtccagagactgagaaggtaaacaaagaagcaggggaaaaactgattttgagtgtttagagtgtgtgaaatgtcacttttccccttaacctcttccttaaggaaaaggagagattgttaaagtagtgtctggtcagggcgcacacatgtagaaggtttctgtaactctagggtaaaatacagatctgttaaaattttcatgagtttcttttacttgtcagaagttgcctacagcttagatgatattttcctgatagtttgtaaacttctattgacttctctgtttttctattcgcccatacccatttattttctctttactgcattttactgtcttaggaagataaaacagaaaagcaaaacaaaacaaaaaccccaaaaaactaagtctgaagcagactgttgaataatattactttaactgatgaacagattttcctcccacaaagaaggaaaaagggagaaaattcgtagctcttctctctttttaaagactgtgctggaaaattccaaaatgttatcggaataaaggaatgacttcgggggctcagaacaactcggggaaagacactaaaatttattgagcatttaacgtcacctgccagaaatttaaaatgtgttttttaaagaacaaacatttcatgattttattgtatccttacgacagcctttcagggtatggggattatccccattttacagatgagcaaactgagacctggagaggctaagtaacttgttacggatcacccaggtgggaactgaccgaattaaaatccaacacttcatgccaggtgcggtggctcacgcctgtaatccaagcactttgggaggccaaggcgggtggatcgcctgaggtcaggagtttgagaccagcctgaccaatatggtgaaaccctgtctctactaataatgcaaaaattagccagacatggtggcacatgcctgtaatcccagctactcaggaggctgacaggaggatcgcttgaacctgcgaggtggtggttgcagtgagccaagagcgtgccattgcactccagcctggagtgcaagactgtgtctcaaagaaaaaaaaaaccaaccaaaaaacaacactttgatttgctgtaagaccctctctgtgaatattaaactggtaaacctcatacataatgatgagattagtcatctacagaagtaactcagggcttgtctgtaaacatcctatgctccaaagtgactgcagtgtaatctcaggaaggcaagactggaatgagatcgtaaataaaaaaatggacatctaatacatacattggtctcgtctgaagaaagactgttaacagagggggatggtcagtatggaattgtaaacaggaggtcaaagaggacgaatgtgttatttacacccaccagaacccagggaagtgtggtgagaagcagcaggaactcttctgtctgctcggcaggcgggcagctctgtgtggcggagacatttgcttccactattatggttgaagtcagcggccataagatcatctatagactgagagaaggcagtgtggacaagggcctcagagcacaggctctctaggggagcatgagttcatgttctccaatctttccaactaccatgcatggaagatattagaatgaacttttccccagatgagaaaacaggcatggagaagttacacttgggcaagtcaaagaggggtagagataggcttaaggccagtctaaattcagaactctcttgactacgttgctctatctctctctctctctcttttttttccttgagacggagtctcactctgttgcccaggctggagtacagtggcctgatcggctcactgcaacttccgcctcccgagttcaagccattctcctgcctcagcctcccaagtagctgggactacaggcgcccgccaccacgcctggctaattgttttttatttttttgtatttttagtagagacagggtttcaccgtgttagccaggatggtctcgatctcctgacctcgtgatccacccgcctcagcctcccaaagtgctgggattacaggcatgagccaccgcgcccggccacgttgctctgtctcttaatagtcttgtcattcctgggatgctgccatttgttttcttttctaatggatagtggatcatgaagatgggttcacatgggcgacttgaattctagagagccaggcaatgtcacagcttcctggccagtttgtgcctgttgggggattccccatctttgatgcctttgacttccagtccttgagggacactcacttccctggcaagcactgtcttggactgcatgagtgattttctattggttggtttctgaccgggcgggcacttagctccatgctggtctgtgcctggctgagatatctaagagcagctcattgccatattctgaatcccagccctcaggggagcagccagcacctctgcttcctgcctcctctggcagatggccctgatctgagagtttaagtgatagctatctgagaggagtgattggtagagacagtagcaccttattttaataatttaaaaatcataaaatatgccactttggatacaaaagcttttaagaggcacttaataaaaatgtttagttgctttccacaatgagaaaacattgttataactaaagcacacttcagatatttaagcattaaagcatccccagagacttattcttaacagtaaaatgtattgctttgttcaagatgattctgtaatggagaggcattacagaggcaagaagagacgagaattctttgtaattagtgtgcactgtttgaatgtaaatgagtacttgaaaacagtttgctctcttaaacatcctaagttttcccactgtcgtcttccataaggtattaattggtttaaacagcctctttatttgtaggcagcacaaaggttaacttcagtccagcccctgtctagttatcatcaactccaaatgctaatgctgtttgaattcatcagacagaattgagctttttgtatgtagtcatggcctcttaaaacttacaaggccaggcgcagtggttcatgcctgtaatcccagcactttgggaggccgaggtggatagattacctaaggtcaggagtttgagaccagcctggccaacatggggaaaccccgtctctactaaaaatacagaagttagccgggcatggtggtgcatgcctgtaatcccagctacttgggaggctgagtcaggagaattgcttgaacacagggggcggaggctgtagtgagccgagatcgtgccactgcactccagcctgggtgacagagtgagactcttgtcaaaaaaacaaacaaacaaaaaaccaaaacttggaaagtatatatagtgtctctatatgaaatgagactagagaaattttataaaagaagggtcctcaagtatagataaaagacaactgtattttattataaatgctttcttatatctcagacccaggtaagttacaggtcatgctcagcacctgcccccgtgcatatagcagcaggttgttgtaacatcagcttattgagaatgtggatcactataacataggagtcgtgttatgctgttcttttaattccctcataccagtgcactacattccaatactaacatgtggaaaaaaaatactgaatatccccttgttttttagtaagaccatagagcagaacatttgcaattttataatggttttatttttaaggtcaggcatttaaagtggcacaaagctttgatgtgggcttacatctgagtattataaacatttagcacaaagtaagaacttacttaaaagatgctccagcttccagtgtgctgtttctgtgtgaaatactgaaaatttgggatcattttaaaaataaacacttatctaagttggcatgcaaaatggagcatttagaaagccatgaaaataagcccatgcataaaatatggcattaaaaaggtaactgtgaactttacagatggactagcatgaaagaagctgtcttttgctagggtggatacgagagtttgcagctctttgctgcaaaaaaataagagcagaaacttaagttgtttagttgttttgaaataacagctacacagagggctccttctggttcatccatattttattagggcagcagttaaaaaattcattagagacacccatctgtagctagcagcacccttgaggggggctcagatggtgatcagattttggagtagcactttacactaaaagaaaaagacaatcgtttaggagaattaatagcacaatggagaggggctgcttgatgcatttgaagcatacccttccacatggtttatgaatcttttgctactgaattcctcagccacctgcttcagttgggaaagagagatccaggcataacaaggagagaaaaattggatcagagagttgagactgtattggtcagtggagaacatagatagagtgtctatgtgatccgtgttgggctctcactcgtgtgtgtttgtgtgtgtgtgtgtgtgtgtaaatcacgttggcctcctggggaacttcatcagtacaaaaaaaagcttgtggtcagagctgaggctgccctggtttaccttggccttgaactccacctccctggtggtcaggtccaggtgcctttgcctcatctttattcatgaattgaaaataactctagttattgaatggcaatggaggggaagtgacctctcctctaccctcctagattccctagctgggtctatgaaattgacaacagatagattaacaggagaataggcatagacatttattttttttttttagaaggagttttactcttgttgcccaggctggagtgcaatggcacgatcttggctcactgcaacctccgcctcctgggttcaagcgattctcctgcctcagcctcccaagtagctaggattacaagtgccctctgccatcataccctgctaattttttgtacttttagtaaagacagggtttcaccatgttggccaggctggtctcgaactcctgacctcaggtaatccgcctttcttggcctctcaaagtgctgggattacaggcatgagccactgtgcccagcccatttattaatttttaatattatgtgcatggggggcatcacaggaaaaaatagtaaataccccaaagagcggtgagatttgagagcttatatactgttttcataggggaaggggaggaggatataggttgtgatttttagaaatgtgctgttagaacagcagatggaagataggagagtttgtgacaaagtttgtctgggtgtggtgtcgactcctagtttcatctcctgcaatacaaatctgtcttccctggttgatgaaacttccaggaagggaattcatgacaactgagttccctttggcacatctgttttgggcagataaagggagtttagagaaaacctttccctgcacttgctgtttttcaagtgccttcagctcaaaataatcaatattccaaagcagcatagtttggagtggcttattttggtttccttcagtgactctgtgccaggcatggtatagcacggttaaagtcataatctcatctatccttccagcaatcctaggggtggagtcccatttcacagatgagataatggaagcaacagagaggttagtcacctgaccatgctcactcataagaggcagagctgaatttcatcttctgctattaagtccaggtccataaactgtgtgcatatacatgttttttttagataaactttctattttagaataattatagatttatcgcaaagctgcaaagacagcacaaagttcctttcacccagcttcctctaacggtaagggcttatataatcatggtgcatgtattaagactcaaaaatgaatattggtgcaatgaactaaactacagatcttattcagatttcaccagtatccttttcctgttccccgatccaatccaggatcccacactgtatgtcacatgcatggtttttgacccttaaacacgaagtgggctggatgtcaaactgctgggtggcctgtttctcctcattactgatgaagaaagtgagacgctggtgccatctgtcaccttccttgtggggcccaggactctcattgtctaatggaaaggggaaatcctatgtagggtagaagatttagaacagaggcatggggacaaattttaaatatagaccatactttttctacttgtagtagtttgtagctaaaaccacattcaagaaatagaaaaagattgggggagagagagtattctgcaaagcaacaacctctctagcatcattaaagtttatgatgcatttgaatcccaagtgtactaggatgttaaataggacttttccttaaaacaaagccttccagtcctgactgcctcctagaatcacctggatagtgtcaagaagcaccaataccggaggcccatccctcgatgttgtaatttcatcagtcttggttgtgatctgaacctcagaatttttaaaagataccaccatgattttttttttttttttttgagacagagtcttgctctgttgcccaggctggagtgcaatggcgtgactgtggctcactgccgccttgccttcccgggatcaagctatcctcctgggcacatctaggatgcatgtaatttgcctgtattctgtgaccaacccttctgtgaacaccccctctgtgaccaacccctcctggaatcccagtgtggtttccttggatggtttctggtcacttttttcgcaagccctcttcttctttcaggatttaccttcttaggcggtctcatttaaccctcctggctttcccacttgcatggcatgtgtttccacctctctgtggcccaggtcctgccttggccctgtcctctcggtccccacctggaagccaccctgggcctattcccatcctgtcttctgcctcttcctccacagctgccacactgtctgtacccaagtcccagtggttctgaacttcttcaagctggctgcactcaacactgcctttcacactgtgcttgctgttctctccaccggcaatgacctcaccctcctttttggcttgggaagcctcagccttccagtttactttcctggcctcctgcagtggagttgctcacagcctggtctgcatctgcttgttgacatgtctgtcttccccagggagccatgagctccattgaggacagggaccatgactttgaaaaattaataattaatttttagagatggggttttgctaacttgcccaggctggagtgcagtggctattcataggaggaatcatagctcattgcagccctgaactcctgggctcaagtgatcctcccagctcagtcttctgagtagctgggactacgggggcatatatgcacccaacttgaaaaagtattatcaaatatttcacggttataaaaactgtatttatatataattatgtgtttaatatataattacacataggttttacatgtgctgtttgaaaataatacaatcagttcctgtgtaaccaccacttaagaaatggaacattacccttgaattactatataattgcatgcattttttcctatgtattgtttgagaataatacagtaggcacctgtgtaaataccagcaggcttaaaaatggaacattaccctcgaggtcccttgcacatcacgtcctgttccctgttaagactggtttatcattcttttgcttttgtttatacttttagcacgtatctatctcttgtgctaaaagactgttacaagcagaacagtcattccagttttagtgattctgggctgagactgtagacaattaaataaaaagccaattcagtgtaggattcatgccttccgactgtgaggctgttgtaaggaagtagcgtttgtgggaatgccacccaggagtcaaatctctagcctttgggtgatcaggaggctgacaggaaaacagcgacagagctttgcctctggtggaactcctggtggcctgcagacctgttggcgtctgtacctgcagtccactcagctttccagatgactgaaatgccccaacagggtagagtggctcgcctctccaagaaagagcagttggtgaataatcatgcctgggaaaacaatccgcctggcaaagagatggatggtatccgttggtgaatgtgatggcagcaagcccagtgcaagattctgtggcgattccttgattgacctgctcggttggtggattttgaaagggagtgggaaggactgcttcacttgcgtagaactctccctctctcttgcgctatcttcatatcgatgtctacctttctctttgtgtatatgtgtttataaatatttcatatgtatatttgtgtacagacatatacacatttggatttatatttgtatacattttatattagtcagttttcatcctgctgatgaagatatacccgagacttggaagaaaaagaggcttaattagacttacagttccacatggctggggaggcctcaaaatcatggcaggaggtgaaaggcacttctttattttatcttattgtattttttttttgagacagagtctcgctctgttgcccaggctggaatgcaatggcgtgatcttggctcactgcaacctctgcctcctgggttcaagcgattcttctgcctcagcctcccgagtagctgggactgtaggcgcctgccaccatgcccagctaatttttgtatttttagtagagacagagtttcaccatattggccaggctggtctcgaactcctgacctcgtgatctgcctgcctcggcctcccaaagagctgggattacaggcataagccaccacacccggactggcaaaaggcacttctaacccaaaagtccacagtccaaagtctcatctgagacaaggcaattcccatctgcccatgagcctgtaaaatcaaaagcaagttagttacttcctagatacaatgggggtaccagtattgggtaaatacagctgttccaaataggagaaattggccaaaacaaaggggttacagggcccatgcaagtccaaaatccagtggggcagtcaaattttaaaactccaaaatgacctccagatctcacatccaggtcacactgatccaagaggtgggttcccatggtctggggcagctccacccctgtcgctttgcagggtacagcctccctcccagctgctttcacaggttggcactgagtgtctgcagcttttccaggtggatagtgcaagctgtaggtggatctaccatcctggggtctggaggatggtggccctcttctcacagctccactaggcggtaccccagtagggactctgtgggggctccaaccccatatttcccttcctctgccctagcagagattctccatgagtgcccagcacctgcaacaaacttctgcctgggcatccagccgtttccatacgtgttctgaaatctaggtggtggttcccaaaccccagttcttgacttctgtgcacttgcaggctcaacaccaagtggaagctgccaaggcttagggcttggaccctctgaagccacggcccgagctctatgttggcccctttcagccatggctggagcagctgggacacagggtactaagtccccatgcacacagcatggggaccctgggcccggcccacaaaacctttttttcctcctgggcctccaggcctgtgatgggaggggctgttgtgaagacctttgacatgccgaggagatgtcttccccattgtcctggggcttaacatttggcttgttgttacttatgcaaattcctgcagctggcttgaatttctcctcagaaaatgggtttttcttttctgtcacattgttatgctgcaaattttctgaacttttatgttctgcttcccttatatatctgaatgcctttaacagcacccatgtcacctcttgaaggctttgctgcttggaaatttcttccgccagataccctaaatcatccctctcaagttcaaagttccacaaatctctagggcaggggcaaaatgctgcccatctctttgctaaaacataacaagagtcacctttgctccagttcccaacaagttcctcatctccatctgagaccacctcagcctggaccttattgttcctatcactatcaggcttttggtcaaagccattcaacaagtctctagggagttccaaactttctcacattttcctgtcttcttctgagccctccagactgttccagcctctgcctattacccagttccaaagttgcttccacatttttgggtatcttttcaggaatgccccactctactggtaccaatttactgtattagtccatttttatgctgctgataatgacatacctgagactgggaagaaaaagaggtttaattggacttacagttccacatggctggggaggcctcagaatcatggcgggaggtgaaagacacttcttacatggtggcagcaagagaaaatgaggaagaagcaaaagcagaagcccttgataaacccatcagatctcatgagacttactcactaccatgagaacagtatgggggaaattgcccccatcattccattgatgtcccactaggtcccctcccacacaacatgggaattataggagtacaattcaagatgagatttgggtggggacacagccaaaccgtataagatttgtattatttttatatcacgcatgtgtgctcccccaacagtgttccttcatgcacatggatggtggtgttgaaaatgcactttctgttggacttccaattttaggccaagcttaggcccaggttgttgaattaataatgaataaatctagataaaaatagaatggtggttaccagggactggggcagggggaaatggggagttaatattcaatgggtaccatgtttcagtttgggaaggtgaaacagttcttcaggtgcatgatggtgatgattgtacaacaatgtgaatgtacttaatgccactgaatgatacattgaaacacggtaaaaatggtaattttatgttacgtatatgttaccacaattaaagaaaagtaaaaaaaaaaatcatagggaaaattcaatggaagcctcaggaaatggtaggggaggtcaattccaaaaccacatacattctaaaatgtcagaaatggtcagttagcaaagtaaggattaattagattttacacttgtatgtctttgttgacatttctgggaataaagagagaagagtgtgataattcctcttctatgtcagttctagaaccttctctttgttccttaccctggtgcttgtatgagtatgtacaaatgtgtgtgtgtgtgtgttgtgtttgcaaacatggacaatggcgtgtgggtttgctactctatttctagtatttctgtgccaccttattaataggagagctgtgggatcaggcctctggatgtaaccctgtccttccttagtgcttctgagttcaaactgactaactcacaaaatgcgtctgcatcgggactgacttgtggcattcattttctcaaagggcaaaaaaccttttgtttctggtagaaattaaagatgtgtttgtgacggccctcacttctttttcaccaaatgcagcacccttcttccctttaatccgatgaggtggttttatggggtggcacataacttggagctcatgggaggccttagaaccattaaccaactgagctaaccaggttcctccattagtttaatttcaaattgaattctccttcctccatgattgaaagagtacattcaattcctgtaacagtttttatatgcctgactgacatcccttcctaaagcataagcagtttgagggcagggatggtgtcttgtttatgtctgtaccccatgtatcatctagtgttcaataaggaattgttttatggaaatggattacatgattaaattggaaatagaatacaggttgatttattccacccccagcttgccttgctcactggatgcttattacagtgacctgaaggcacttcagaagacttaagtgctctctgaattattgaaggaagatggactttggctcagtagagtgtttgtgcttagtgcctattactggattctgattctttggaaacaaattaatccagagggatatattgtttctttatggttctgaatatttggttagcctgaatgtattaagatcttacaccccaaccatgacagatgggattaaaattccttccctgaaaagaatatattcctttatgcttccactataaatttatatgcaagtcatgttttgtaaagtcgtgttcttctcttgctatttggtgcattccctgcagcattctcgaggtcccagcattttcccttcaggagaccttagaattattggggtacggggcagccaagtgacctgcccaagcccacgtgtcttttttttttgttgtttttttgagacaagagtcttgctctgtcacccagactggagtgcagtggtgtggtctcggctcactgcaacctccgtctcccaggttccagtgattctcctgcctcagcctcccgagtagctgggattacaggtgtgcaccaccacgccaggctaatttttgtatttttagtagagatggggcctcgccatgttgcccaggctggtcttgaactcctgacctcaagtgatccacccacctccgcctcccaaagtgctgggattacaggcatgagccactgctccaggaaaaaaactgagtatcatgttttcttaaactgcatgtttaagatttcatatttaaaaatgaatattgtctggccaatgtgtattttaatttcttctctgatatactgtaaactaggattgttttaggaattataaggacctcaggaaacttctgtgtagtataaactggaaacaattcatatccaccacagaaaataattaacagtgctgggtgttaacaatacttaggggggaatgagtgatggagggaatgagtgatatggacaattggtgaagccctgttgactgggtgatcaggagaagggagctgatgggggagggattggaagctgaaggctgagaaggatttggatagatgaagggagaacataagagggagggctgacaggattcttgctgatccggctggttaatattggcttgccgcaattttccttctaagctaggtaaacatatatttccaggcatcctatttggactgtgtatagagacccattgacatctgggtctgttctaagctgctttcacttccctccaatcagagcttgttgggctcaataaggtggagatgggggtcatatattaccagggcaagcaggtctgtgcttcagagaggaagtaaggcatcagcgcttccctctagaattgatctgttgcggaacaagagtcctcgagcagcagagaaagctgcgccaggctccctttccctgctcagtcgttcgttcctggactagatgggtggaacgaggcatctctgggtttcacagagcacagagggcacggcttgtttcctaaccgggtctcaaaacctgcctgcactttgggctttttcttcaccttgccatatgttgcttcctgcccttttgaacctccttccggagctgattgcacttatgtgctaggaaaggagtatttgtcttcaaggtctgaatgcatcctaatccttattgaactgcaaggtgtgatggcacgacttggatatgtaagtgagaattgattctggtcacaggggatgtcataagtttcctcaaaaaataaaaaagaggaaaaaaatagtgagaaaaaatggcctttcgttatgggaaactgggagtttttcctacagatttcattcttgccttatatgggtttcctggaattcttctagcagattccagcagtgccctccggatctgccctctgccctctgagggttaggattcatagtgtgtgacagtctttgctattcaggccaccttctgggaaggccagtggccaggggatggttttcatgagccctcagcagggtgcagaagccaggtggttcccatatctcattcccacttttggtaaacacctctcttatgtttgccctcctgggcttgttgcttctggtccccggctcatcacagcttcccagggccccggtagaaacaagggttcacagtgggtaacctcactgtgctgcaactggaacctggcttgcaggatttcaggacctttggttgagtggttttagaaaaggctactcaggggctgggcgcggtggctgtggctcacaactgtaatgccagcactttgagaggcctaggcggggggatcacctgagatcaggagttcgagaccagcctggccaatatggtgaaaccccctctctactaaaaatacaaaaattagctgggcgtggtggcaggcacccgcaatcccagctacttgggaggctgaggcaggagaatcacttgaacctgggaggtggaggttgcagtggggtgagattgtgccactgcactccagcctgggcaacaggagcgagactgtctcaaaaaaaaaacagaaagaataaagaaaaaaagaaaaggctattcaggctgaagtgccctcaggccttggaaaagaaatgaaatttcaaacaaattattttctacctagcctttttcttttaacttcagaagggttatctggatgactggtatttacatacaaaaaatagttaaaagtctttttaaaccacagacagtataggtttcactggactcatttttcaagatacgaaattgttgaattgttttcctttggtaattgaagccagaattcagtgttttctctaacttcttttcggattctttgctctctggagaacgttttgcctgctttgcaagggggtatgagtagtgcgtgtgcctgagggcctctctctgccccctcctaacgcctggccaccctgttccgactgctgcccctgccggtcgggcccggacactgcagggagcctcacatcctcggatgacggattccttctgtacatctcatcacatccttttctactggcttcaacttgcatggcctctgtcttgaagaaagaaagaaaaaaatgaaatgtttcttctgccttcctgtcattttacgcattttacgctgatatacttgtaggcaaagggaattgaaagggcatgcactttggaacgagacaagcctcagttcaaatccgggctttgggaaaccatgatccgggagttctggggcaaagtaaggctttctgagctttagctgtattattggtaaaatgggaatagtaccgatctcctagggttatagtgttaaatgcctcccttcctttctttactctgacttcttccaccaccacctcatggtccctgcttccattcctcccttccttgcaagcttccggaattctttgtaccccgggcagcaatagcccttttggagctccccgcaattggcaagagcaagtcactgtgtgagcaagtcttgggctctgttatcttcagatgctcaagtcaggaaatagggggctagaggtcattgtgctcatttccccagagattatcaatgccacccccaccccttttaggagatggcatgtgccatgatcgtagctcagtgggatccttaatgcctagtgatctcggcttaacaggacaaagattccaagcccatgtctgttctgggaagcaaagcaggatgtgtgggcctggagtgaagtttgttccatttctcgccataggccatggtatgattacagctgtgcctagtgctgcctagttttactttcatgcctgatttgcaatgtggcagggtcctgagatgagagctctgtgtgggccagtagagtcaagagactttgtcctggtcacttggctacttgcagggggttctggaaagtcaagttctctgaatctcagttgcctttaatataaaaggaaagctatagtttcgggtcggattgattcacatggttttggtcgggagtgaatgaaattaatgtaaattaaaacacattatgagtagcaaagtgctatgcaatctaaaaataataacattttaatcactcttatcatcatatgtgccaggcactgttctaagctgtctacaaatagtaactcatttagttgaatgctcacaaccaccttatgagagagctactgttaatatcaccactttactgatggggaaactgaggcacagagaggttaagtaacttgtggaaggtcacacaaccagcaagtggtacaatcagggtttgaaccagtcaatgaggagtcagcatttgttattgttcctattcctatagcatagctgggaagggaatgcaatgctggtttggagaacacatcaagcaggcctcctgtcatccactgagtgagatgagatgatggccatacattgcggcacagccagctatccatggtctgcagcaacagatcagtcttgcagggacatggatagctccgctagtgaacattcacatgttcaacgaatagctagagtaaatagttggatctcatttagaggcatgctctggcattcctctttcacgtcatttgctttccaggcccactccaggatgagagtactgaggtgccataaaagaccaacaggcaagatgttggagggttcaggagctgccaaggttgtgttcatgctgacctgttggcatagcgtacagcagtgccagctgctctgctaaaccgaggagctgagatgctgtgttgatttctacatgttccaggcaaatacttcctgaggattgtcaggatttacataatggattggccctgggaccactgagccagcatctatctttgacaggtgtactgagagatgacctttaaacctagggatgttctccagatgcagttccagctgggccagtaagatctgcatgtttatggtgctgttttttcttttcttcccaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtcagtgtctcttccacctctgtggcccgagattgtcgtgagctcagattagcactgggcagacggcaggaaacgaggggttctgggctcaactgacttcctcctggaagctgcagcagctccttttggagccggctgcacaggatgttgctgcacttctgtctctttgaattggacacagatctactctcctttttgtcttctctgtcacttaggtgctcagatttgctctccattgggccgcaggctcctctgcaggccccggcttaggtgagacgtggttcatgcagcccagctctgctttgagacaggaaactgggggcaggggagattgagctgggtgatgtttggaaggacttgagagatacaaaaatggggatgccctctatcagggcgatcctgctcttcatccgcttcactcattcccttccatcctgctgcagtggctgctgccttccacagggtcgggagacttcgcttctggtcattgaacctctttggctctcagtttccgtatttagagataacaccaactcataggattgttctaaggctcaaatgagaatgtagctgctttggaaataagtacaaactggagacatctaaggcccagccttatgatgatgctgtccatccagttatctgagaggtgggtatagccggaagtaggtagggttcctctacccacaaaagttcccagagaagcccaggtagagatgctctgtggctcatctgttgccagactgtattttaatcctggtgtgtgtgtgcatatgtgtttgtgtgtgtatgtgtgtgcatgtaggtgtgcctgtgtgtgcgtgtgtgtgtgtgcatgtttgtgctgtgtgttcatgtgtgtgtgtgcatgcatgtgcgagtgtatttgtgtgtgtgcactcatgtgtttctgcgtgtggtgtgtggatatgttcatgtgggtagggaagtggagcacccactcatcaggcatttgggaggagtaatctgcagaagttcatgctcattccccgaaagagcatctcccatctgttctttatctatagtctgatgtttctagccctgtccctgtttgccctgtttcagccctcagggacctcagcccagccctctgatttattatgcagagagggagtgaggtcagagcacagatgcaggcttgtattctgggtgatgtgtggagtcttccagttagtcattgcctaaaccagtgccccttgtctttccccgaaacccgttctgaagggcctccaatattggttgatttgaatgcatagaatctatccagtttcttaggccagaaaccacaaccatcttccacacctccctctcccttgttccacatctggctggcctccaagccctctcagtcctactgctaatctgtctctcatcaccatggccgctgccctggctcagatccttgttatctttcacctgggttttgcaagagggtctaccttcctgcggtgtttctcttctccagttaattaaactaaatgtgatcatatgtgcaaagtgcttcagacagggcctggcatctagcaagtacccagaaattaaccattgtcatcattagagaaatagctccaatttagagagtttgagtcaaaagcaaatgaagctctcccttctgtccatagctcaaattaaattcctatcttatctcaaatggtagaatctggacacactttttctttagtgtaagtattgttgtctatggcagtcccacagctgggcagggaaaaacatgacactctcttcaattacactcatgtactgcataatgacattttggccaatgacggatcacatatatgatgtgacagtggtcctgtgagattatcgtactgtgtttttgttgtaccctttctatgttcagatatgtttagatacaacaataccttaccattgtgtgacacttgtctgcagtattcagtacagtcacatgctgcacaggtttgtagccaaggagcaatagactattccatctagcctaggtgtgtaatgggctacaccatccagatttgtgtaagcacactctacgatgttcacacaatgatgaagtcacctaataatgcatttctcagaatgcatccctgtcattaagtaacgctaggctgtacttgagtatctgttgtgtgacagcggaattaacagagtagtgggaatgacagaaataacacagtccagggcataggacttacaggaaggcagagtttgcctcaataggaggaagaacctcttgacagtgggaattgtctgtgatgaggtgggctggtcagggacttgttttcccatggtgcttacacagaggccccagactgctcactggggttgcggctgaggccttcgggacagggcagaaggtcggtgaaggatctccaaaaagatcctttgaaagagtaggatttctagtgtttgggggccttattgatattatattttaattccttaacctcctctcgcttctacttaagtaaaaatgagaatctcaggaatttaagtttcagcttcttctaaaagatggttgatcctcagtgtttgtggattctatatgtgtgaattcgtctacttgctaaaatttgttgttaactccaaaatcagtactcacagcacttttatggtcatttttcatttttattttattttttaagagacggggtctctgtcttccaggctggggtgcagtggtgtgatcataactcactgcaaccttgaactcctgggctcaagcgattctcttgcctcagcctccctagtggctgggactacaggcgcatgccaccatgcctggctaatttttttttttttttttttttgggtagagatgagggtcttgccacgttgcccaaactggtcttgaactcttggcctcaaatgatcctcctgcctcagcctccaaggtactgggattacaggcatgagccaccatgcctggtggtaattttgaacctgcacagagtggcaaaatatttgggtcacctgatgtacacgctttctacttaggtcaaacaagttcagaccagatgacattctaccttctctctcatactacaaactagtatcctttttgtggtctatttaatgccatctttttttacatttttgtgctctttattggtgagttaaccattgcaaaagctccctaagcatagtgctaatgtcatctagtgctcctaagcatgagaaggctgtgatgggcctgatggagaagatacaggtgctccagaaactttattcaggcatgagttagagtgctgttggccagagtacaatgcttatggatcaataatacatattaaataagatgtttttaaacagaaacacacatagaacaaggtcatgtgttgaccgatggaggaaggtgttgtgaccaggggttcacaggaacctaccctgtatttctcttaggagcaatgcttcattattccctaattcagtattcacagaaactttatagaacataactacagtactgtgaataaggagaatcgactgtgaatattttatgctgtttagaaatcgctgcttagcgagatttccaggggttgcatgggactgagaagatggtaataaaggtagttggtgaccaggcatgcagaggaggggaagtggagtgggccctgcaaggtaggctccacctaaggccatggaaactggtgaaaaatgaaggactctgcctgtagagtattataggacgttccacaggcagggttgtggcacagtgcaagacatggccactggggctgtgcctccagcaaagacgggtattcagacatatctcagggcagtccattcagggccttatagagatcactggacgaggtgggcatcgtggggtgggctttggctgtaaatgaatttttttcctgaccttgtttcctgcatttcttcagcttctgttctaataaatgtttaatgataccatcatttgggtgtggcgatggtaatgctatagctttatgtggccctcaaaccattcacacagcctttcttctgtccctaatatataggactaagttactggtaaactttgcagttgtaatatagaacaattcaaagacaaaggggttaatatgattattcattcattctttcattcattcagaaagcatttatcaatgacaacgagtacaatgccttatcctaggctttggagattgtattaggacaggctagtaacaggcactacgttagaggctcaacacaacaaaattgtgttttttgcgtatgcttcatgttccacagagatttttggggggcaagaacccagcctgcaccatctgaacatatgatccccttagtcacagacttgaggaagagaatgttagggagtcctacaagagcgatcaaatgcttcagcgtagaggtaaccccatcactgccactcataccctgttcagcagaacaaggagagaggcacttgtactctttccatgtgcccaaagcagtggaaaatcaagtcagtgtaagtactagcatcctatacatggatgcaaaatagttcttgccccccagatgctcaaggttgaatgatgtgcacagataaaaccaaacaaaggaaaatgatggctataacctggtgcaataagtactccattcttccagtgggtcagaaaaaaaaacccaaaaaacaaaaaacaaaacaaaccttggcatcatcctggtgcattttcctcagaccccacctgtgatgtattagcaaatcctgttggctctatatttaaccagcggtcttctgaatataaccggaatcagatcacatctcaccatcttcaccattgccaccatcctcactatcatccaagctcctgtcatctccttcctgaatgttcccatagcctcttacctggcctcccttcttctgctcttactaacagcagccagagtgaaactgtttaaaacataagtcagatcatgtgctcctctgccccaaactctccagtggcgccccatgaacttcagagtaaaatcagaacttttaaatggtcttcatgtctcttcttgacacagtcctcattacctgtgtgacctcattctctacagttttcccttacatcaatctgccccagatccagtggcattcttgctccctcttgcttttcatttcactttcacttcttgctttcttaccagaaacacttctgcctgagcctttgtactggctcttccctctgtgggaatatttttctcccagacagcctcgtggttcactcccttaccacttttaaatctttgtgtaaatgtcaccatctcaaggagatcagatttcaaattgcaacctctaccctctaccagcatccctgatccccataacgtggttctcccttttcctttttcatagcattaatcacttgctaaggtgccataaaacttacagttgacccttgaacaacacgggtttgagctgcaagggtcacttatatgcagattctcttccacctctgccacctctgagacagcaagaacaacctctcttcctcctcctcctcagcctactcaagatgaagatgatccactttcacttaatgaataggaaatttattttctgttttttatgatgtttttcgtcatctagtcaatgctgaatttttttctcaatgatttttaaataacattttcttttttccactttacttttattgtaagaatgcatatataatacatataacaaacaaaatatgtgttaatcaactgtttatgtttttggtaaggtctctggtcaacagtagactattagtagttaagttttggggaagtcaaaagttatacacagattttcaactgtatagggccggggttggttcccataatccccgttgttcaagggccgactgtattatgtttttgcctagaatgtaagtctggagggctaagcattttatgatgtatccttgttacatcaacacaatacaaacagggcctgataactaagaggcactcagtaaatatttgttgaatgggtctatgaatagaagaagcaagtacaggtcacaatggaggtatagaggagggacatttaacacagactggaggagacgacacttgtgctaggggttgaaggaaatgtaggtgtgagccaggcaaagaatgggaggaagatgtttttcagggatcaagcccaaatccattcattggtaggccaagaattcattgtcagtaaatctttgggtctcctgttgagaagaacaatgattgtattagtcagttctcatgctgctaataaagacgtacccaagtctgggtaatttataaagaaaaagaggtttaacggactcacagttctacatggctggggaagcctcacaatcatggtggaaggcaaaggaggagaaaggcacatcttacacagtggcaggcaagagggcgcttgtgcaggggaactcccttttataaaaccatcagatctcatgagacatattcattatcatgagaacagcatgggaaagacccacccccatgattcaattacctcccacgacatgcgggaattatgggagctacaattcaagatgagatttgggtggggacacagccaaaccatatcaatgatgctaaatcaacccattggtaacactcagagaagtaactggatcactgagtctccatgtgggttaaataagactgcccttttctgtaatggaaaatatttgaaccttagggcttctcagaagggttttgtgagagctttgccatcattcttactcaagccttcaggacagcctgctgagcttaagttcatgctctttttctcttggtttctctgccaattttggtgtgtttaccttcataatttaaatgtgaggtttagaacagagaccatttggtcaggaaatttgtattccttctcattatgcatttcttcatgcagatgagggcacagtgtgatgtttttgtttaaaataaaataacattttaactttttatgtggatgttatgctcaaattacactttttctttacatagattttttttggagaaactaatgcatctggcattgaaaaaatgtgcatttttgttttttttttaaaaagagaatgaagaagttcagttttgaaacagtttctaaatgttcttagttttcacaaaaatgtttgcttgaattctattgtaattttttattttttcccctttaaaccaacataggtaatatccttaagattaaaacttcagaaacttcaggaagatgcagttgagaatgatgattatgataaaggtgagttttaatttgtttattgattgttttgtcatcatgtcccaattttctttccatctttactcatatctaccttttgaatcccaaaagaattgtacaatctgttcctctgatcatctctaccagggaatagttgactcttttacagcattattgttttgtagatttcaaagtacttcatgaacattaatcctttgggttataaatataaccttatcaattgtccagaaacacttagcatactcacacaataaaaattatattagcttgccacctgtctgcccatggtgtgatgtatctataatccacttgttcataaaaaatattcgtctgacacctatgatatgctagggaatatgggagacaataggaaagtaagacagacatggtatctgcccttgtgatgccagtaaacttaagccttcatggggctctctgacttcataatttccagaaccagagataggaaatgaggtgaatttgagaaatgtcagactgtgccaaagggggtcacatgcatcaaatttccacatacatggcctaaaatacccaagagaaaaagaagttacaacattagaccagagatagagggactgatctgaggccaggaaaacaaacaaacaaaaaaacaaaaaaaccaattaaaatgaggcaccaaaatagaagttgggctgcaagcagatgagggctgacatgggggttgaatgggcacagggtagactgagtcaaaggaaagctttcaggtatggttgtcctgggaacaatcctgaaaactttagatgctcattgcaagatctcacacccatttctgctgggtgtgggaaagagaaagggctgaaaatgacatgtagattcccctaggcacctactaacttgatagatactcctgctattgagcaagttaggacacccaggattggtatggaaatggaatgtaggtttaaggattcttctggaagctggttagctttaaggcatgggtcttcagcatttagcccatgtgacattctcattgtatgtgtcatagactgttggaattagggcactatgggaataagataagtgatttccaaaaggaggtagaaaatcctgttctaggaaatgctgttgcatgttctcattacctatccattgcagttgggtttagaaagtcacggggcatgggaggaagggagaaaggactggagacagaggagggactcttgacattctcccagtcctccttctacaggccacttgatttcataataacactgggtggaggatgagttgcctgagagaggaggcaagtcggaggcaggggaaggcacccctcaagcccagcgtcagtggcttcagcccgggcacagctgtaggcagggagaaaatgagctattcctgggccagggctcacctgctggatttcatctatgagagataattacagctagttttgaagctgcccactattgcacagatttatttttattaccatgaattgagtcctggactctctacctttaatgacactgtaacacataaagcttacaatgcagtgaaaaagtaggccaatcaggccctagtttgtcccctgctcctgcttaggacctggtgaactttctagacttggttctctcaatggcttcattaaatggagacctcacttctttaatcttttctccaaacattccgcaacacctaagggaatggggtttgagaggatacacctcatcagggaagctcaaagaatacaggcatcttctttagtgtttctgcctttttctgttcctgttggtacctcactacttactacatcagaagtttcagggtgggctcagcattctgtgttttcccaagccttcctggtgactggggtgtgtcctgaggcttgagaaaacactggtgcagagtttatgctagtgagcactaggcctggggggcagcagccagccaagccctggaagaggggttgagtctatgggttgtgtccttcctgatccaccagaaatctgtgcagcagacaagcatcctggtaggcacaggacacacgatttacatgccactccccttgtcttcttcccaatcccacagacccgattcagtgtgttgagaggtaaatgttcttgtggaatatgcacaatgcctggcatataggaggcaggccctcagtaaatgtggtgtgagggaattaattaataaatgacttgccctctgaatgcatggaggctatggatggcaagctagagtgaatgaggggaaagcactcttgccacctgaaggtgggcttagttctcagctcatctgcagtgcccaggatggggggtgggagtgggtgaagggaaagatctttgcatagaaattggcttatgtgaaaaatatctattaagtatccatcgtatacaacagcacttctcagactttaatgtactgtgaataacctgggttggtaatggattaaaatgcagattctgggctgggcgcggtggctcatgcctataatcccagcactttgggagtccgaggcgggtggatcacgaggtcaggagatcgataccatcctggctaacgcagtgaaaccccatctctactaaaaatacaaaaacaaaattagccgggcgtggtggcaggcgcctgtagtcccagctactcgggaggctgaggcaggagaatggcgtgaacccagggggcggagcttgcagtgagccgagatggcgccactgcactccagcctgggcgacagagcgagactccgtctcaaaaaaaaaaaaaaaaaaaaaaaaaagcagattctgattaagtaggactggggtggggtgggagactccatttctaatgatctcccaaatgatgcgcatactgcgagcctgtgagccacacttagagtaataatggcatataagaaatcacaacaacgccgtgtttaaggcatgctgaatgccgtcctcaagatctgcatctcaaggagtatgcagtccaggaggggaaactggataatacacagtaagaataataaagctatacataatatgtcccttaaaatacagacagaccaaggcgggtggatcatgaggtcaggagtttgagaccagcctggccaacatagtgaaaccccgtctctactaaaaatacaaaaaattagccgggcatggtaacaggcacctgtaatcccagctactcgggaggctgaggcaggagaatcgcttgaacccgggaggcggaggttgcagtgagcagagattgcaccattgcactccagcccgggcaacagtgggagcgagactccatctcaaaaaaaaaaaaaaaaaaaaaaaaatcattaaaaaaaaaaaaataaaggcagacaaagacagtcccaaaaagggacaaatgacttctgccagagatcttggggtgggtgaagaatcaaagtagtggaggaggaggcagtttagatgggtcctgaaggatgggtttgatgcaacagacgggggattccggcaaagagaagagggagaaagggcactgttaccatgagccaccatcccaaagttaggcttgaaaggagacttgcggctgactatggtttgaaatggatcacaaaagggctcagtacttggacttgtcagtgattggtaaattattttaaattgatcactaagtcattaggaaagtttggaagacataaaggtagtgaatttgttatgagatttgttcaaataagatttgaatacaatttcttctctcatatagtttattgagggtaactattaaacattttaagaattgttgagttttttttcatagtttttacttgaatttgctcctttttctctgttaggagcagctgtgcagccctgttctgtctcaggggaaggggtctgccggaatctgagaggtttgccagaagaaatgagagggtgaccttatctcccttggtttttgctgcttttttcttttgctctttctttctttctagtttcactcataaaaatgactttgtgttccaaagaaagaagcagttggcacagagtagagagttccatgttttatctcatcaaagtgctggcaaatttccccactaatgccttgtgggaaaaccttctcaggctctaattacatctctccatcactagggaagtaaagttaatatttccttatattcttgcataaggtgggagggcttgggagaaaaagaataaggctttcattaatagcatttacatagcgtccttctccaagaggattcattagattcattgcattaatgcctatcccgtgcttatggtcaggtgaggggcaagtttgagacctcagagtcctgcagagagaggaactgtggtcagtactggagataaggattccagctctgacatgggtggggcagagaaaaggtgggcgtgggcaacaagtttctatgtggttactgttctagttgttcctgcacctgtttgtgctccataatatccccctggctgctcgtgtcccatgtccaccagtgaccatgctcacttccacttccgatgtgagcaaggagagattgtgaaaaggaaggaacacaattttgggaactcagcatttcagtgacttatatcaatgtgacatatagagcagctggcttcactctgcttgtttagaatttcctttttggagtaaaagtagccagcatcatattactttctctatcctttgtctcaactcatatccattatgacagaactctagtataataaacatttatatacaatgacagacattgaaagaaaaatgatggtggcagaggccaagcataaaaacactctagggtgagtcttttgtctaaattaccataatgtccctttgtctgaattatgtcttgagcaagatttctctatcctcagtttctcgtcactgatggtgtgcaaattacccaaccagatacccctttccttcacagggaacctgccttacacctcccatagggtttggtgtctcagtggcttccaggagcctggcagttagaaccagaatccctgccacataagcgttgatgtgactgaacacagcacaaccccagagatttccttttccctgcgtttcattccagtctagaaagaagaaaacaagattgaatagaatcggccattcttatatcctcaggactgccagaatcaatgggatgtggatgccatctgggggcccatggaacataaatgcttttcttggcagcctgtatcattttgctttctgacttaaaaagtggactgcaattgaaatctgctcagagagacaggtccagcaaaactgtcactttataatgtctgcacagaaaaaaagcaaacatgaccaccagtgcaatttccacctgcagctcccttgaacaaggcacttctctccctgcctgcacaccaggactttggagtgttcttgtctgtgctctatagagctttcccttcctttgctgtgagatctgcttgctatatcaccttgtcctggtatactaacaaaatctgctgattaaaacccaaatcaacagcacaaatctcaagtatgtgtcatgagactcactacatccttagcacctatgaaaaatgccaacacttagacctgcaaacacaaatgggaaatgctcaaagtcaccattggctatgatctctgcccttaatttacagaattgtaaattctcctgcaaacaagaaaagaagctaagatagtgcaaccaagtaaaagaaatgcattttatgtttcctctttttatgatatgtttgttttattagatagctgctgctctggtgccaatcataacatcaaaagacacaatcctgaatgccatcatcctgaatgttgaaatctcccaaaattaaatccctaaaaccccaaattcctaaagtctaaatccctaaagtctaaaatccctaacatctgcaatcctgaaaaatcacagtcctgaaagattaaaatcccacatgctggaattctgaaaaccaaatgtggggaaaggatttagtgagttttcagttgtgtcatgttagttgcatcatggtaggtggaactattacctttttattgtctttatttggaaattaggtatggtttaagaagatgcatataggtgcccagctgacaaggggtggacttgtggacttaattttaagtgtcaacttgattggattaaggaataccttgaaacctggtaaagcattattttgggtgtttctttgagggtatttccgcggagattagtatgagtctgcgtgtactaggtagggaagatctgtgtttaatgttggcaggcaccatccaattgtcaagggcccagagaaaacaaatgtagaaggcaaactggtctctctctgagaaatgagacagactttttcctgactccatggacatcagaaatttgactgcatgaaagtgcattataacaacgttgactttgtgtgtaagcactgtgcgtatacataacaatgttgggatttcctcaatagatgaagagatgtttggacatcggcatttgtgaaaaataaaatttcttgagatctctgctctctgggtggctgcatacgaccccctttgcaggtctgttccatggtgggcacattctcattcgttgcctgattacatcacgtgattactgtgggaagaattgtcactatcattggttttcaattgaggtcacggaatctgctgagagggaggaccagctgtgtgctctggccactctgtcaatttgtctcccatccctactgggtctagagcattttgtgtcccactgtggaagactgagctttgtagacagttgaggacaaaacttagctaggaagtttctgacttctggaagctcttatttacatgacagtgaggaaaggaacagatgagcgctctacacttggaggtagcaggaaaattttccacaattttatctaaaaaattagtctatttttatctaaaaaacaaatgctaattaggaaattagctcttgtgttaatcttcagcattgttctcagaagagcataagcttgtatatctgcttcctcttactttaagtaaaaacttaaaaattgggagatgggctatacattaagacaaaaataccataggaagagaatatgaacaaaatgtcatttatttagtttggttgcattgtcttagcttctcttcctgtttacaggagaatttacaattctgtaagttaaaggtagagatcatagccaatagtgactttgagcattgcccatttgtgtttgcaggtctaagtgttggcatttttcatgggttctaagggtgcatgcagtgagtcaagtgccacctacttgagattttagctttgtgcacagatgcgaaagcttattggcacctgatgtacttccctctcattcacagcataaaatgtgatttcacggtgatgccttttctccttggctttgcatctgggtacacgcttggctctttcttaggtcttggtaggatttcttggaacccctgcagctctggaggtagaagcacagtggcatgaacattccttcctaactgccatgtcgtggtgtgtttctctctgggaatgggaccatgctgctttgccttccctgcctatgaggacatcagtctgtcctataaggatcacgtggaatgttgtcatggtgcattattcatgataaactctgacagcttcaaggttaggtgtgatgctgaatacaaaacaccaagccaagccaaaagaattttttttctctcctctatgtcctctccctaaatggttcttagttgaaacttgtacatgatttcctactagctgagctgtagcaggaagttgtgccaacagtggacacatcttattcacgttttatgcatctgcctatgagaatctgtaagagacacaagctgttcatgttgtagagtccggttgatgaagcagaatgtggttcaggaagtctctcttgcgcttagaagactgattttgaagctgctctcataggttttctgcttcttctgccctcttagagtggctaggaggctgcctgggattccaggtaggtcttggccctaagacctcagctgctccatagaaggtggtcagacaggatgaggcagtgacttcgatcatctggagcctcacacctgtaatcctagcactttgaaaggctaaggcaggagaattgcttgagcccaggagtttgagaccagcctcggcaacactgtgaggtcccatctctacaaaaaaatgacaaaaacaattagccaagcacaatgtcatgcacttgtgttcccagctactcggaaggtggaggtgggaacactgttttagcttgggaggccgaggctgcagtgagctatgattgtgccactgcactgcactcctgcctgggtacagagcaagaccctgtctcaaaaacaaaaacaaacaaacaaacaaacaactcaatagaaatgaaaaggatgtgctaatgatgagatgcaaacccccaaattgacatgtaccttcccattacaacaattttaggtccaaactatgcatttggtgcaaatggttgatttatccttaacaggaaggatgtcttagtctgcttggactgccatggcaaagtactactgactgtgtggcttaaacaatagaaacttattgtctcactgctctggagattggaattctatgtcaagttgtcagtagggttggtctcttctgaggcctgtctctttggcttgtagacagctattttctccttgtgtcttcacacagtcttccctctgtatgcattggtgccttaatctctttttataaggacaccagtcatattggaataggatgcatccttgtgacctcattgaaactgaatggacctctttaaaggtccagtctccaaatacaattaaattctgaggtcctgggggttagaactccaacatatgaatattgcagggggatataatttagcccaaaacaggaagcctaaagggctcaggacagagctaaatactaaacacattcaggtatttccacaaaatttgaataatttagtttgactatctgtggtcattgtggtcatatgtagacatttgattgaaacttttttttttttaaagcagactttttgacacaagtaagttgattcttcccacaagtgaacttagctgtttttcacattttgttttattgcagagcctggctcttaggccagtatatcatggtatcccttcacacaaacaactatctactgaatatctgccagatttaccatgccatggtggacaaactatgcataaaaaaatagcccaccaccaaggagtatacagcctagttggaataaaacataaatagtacaaatatgtgaaacttcagctaccattagaattgattttttttttagaattgatgtttatttttgtatgaggacatatttctttttttttttttttttttttgagacagagtcttgctctgttgcccaggtggagtgcggtggcgtgatcttggctcactgcaagctccgcctcccgggttcatgccactctcctgcctcagcctcccaagtagctgggactacaggtgcatgctgccatgcctggctaattttttttttttttggtatttttaatagagacggggtttcaccgtgttagccaggacagtctcaatctcctgacctcgtgatccaccgaccttggcttcccaaagtgctgagattacaggcgtgagccaccacacccggccatgaggacatatttcaataggcagagacacaaattaacctagtaccagctgaaaagaggacttatgatctggtgtgaccagaggtggcaagagtgatcagaactaacatgttcttcacttttttctctgtattgtggcttattctttcaaacctcttgttttagttatttattgctgcatgtggtaggctgaatgatacccatccctccccaaagatacccacatcctactccttggaacctgtaaatgttaccatatttggaaaaggggccctgcagatgtgattgaattagagaccttgatgagggcatcatcccagattatctgaggtgggtcctatatgacatcagatcatgtctgagagacgcagtgggagattggaccaattgaagaggaggtggtgatgtgaccacagaggcagggattggagtggtagctccaagctaaggaattccagcagccactggaagctggaagagacaaggacaggattttccccaagaatgttgggagggaatacagtctgtcaataccttgattttagctcagtaaaactgatttcagacttctggcttctaaaactatgagagaataaatttatgttgttttaagcctgtaagtttgtggtaattagttatagcagccacatccaatttatatacggcataaccaccaaaaaacttaaagcagtgtcaaagagttacgttagcaaaatggtagagtttgcagctccaactttgtttccccacagaaacatcaaaaaacaaacagaaaccattagaacaaacatgatcagaactctggaaaataggcaaaagtttaagcaaccaagcaaacactgaataaagaaaaaggccacttgaaaatggtgggaaactttgtagcatttttatttgctcttgtcccagccttctctctagcaagacagttctcttgatgatgacagccttcattcccagtgtaggaccctggtccctgattacagagggactagagaagaccttacttattgtggatgtctgttctaacctgtctgggggctacgttaagtactgacataggcatgtatctctgcttagcctaacttagaacataggctggaaaaatggcaggcattgcttgcaaatgctcaaagtgagctaacaaactgcaaaaacctggggcaaaagattactggttgaggtgtacaatagaccatctaaagtccaggtgcaaaagctggaagagattctgtgggaaattaggacattcaaaagcaccatgtatacaggaaaatgtagaaatccatgcatatacttggggcaagatgcatgctcagaaaagaggagagaagaccctaagctttcatttcaggctgatccttgagttaagtgtaaggttgggtaagtattgtaggagttccccagcacagagccaatctgcaaagactgggaaaggaagtttggaaaagtatctacaaatggactattatagccatcaaaaataaaaaacagcaaaccctggggaagggtgagagtccgatagccagagtttacattataatatttaagtgcccaatgttcaacaaaatatcacaaggcatacaaaggaaacgagaacacatggcccattcaaagaggcaaaataagtggacagaaactatccctgagaaagcccagccatcaaatttattagacaaatactttaaaatgattgtcttaatgatgtccgaagaactaaaagaaaacatggacaaagaactaatggaaaccagaaaaacagtgtatgaacaaaatgagaaataaagtgatagaaattataaaaattgatcaaacagaaattctgaagctggaaactgaaagctgaaatgaagaatttactagagggttagacagaagatttgagcaggcagaagaaagaatcagtggacttgaagatactacaatggaaattattgagtttaaagagcagaacgcaaaagtaacgaagagaagtaaagagaactgaagggacctctaggacatcatgaagcagatatatatatatatatataggagatatatatatatatatatataggagatatatacatatatataggagatatatatataggagatatatatataggagatatatatataggagatatatatatataggagatatatatataggagagatatatataggagatatatatatatataggagatatatatatatctgctttcactgttgttattcaacattgcactgcaagttatagtcagagcaaaatagataaaaggcatcataatggaagggaacaagtaaaattatctctatttgcgattgacattatcctatatgtagaaaatcttaaagaatccacaagaaagctgctagagctaatgaacaaattctataaagttttaggtgtgaaagtcagtcatgtttttatctacctggaatgagcaatcccaaatggaaaataagaaataattctatttataatagcatttaaaataataaaatacttggaaataaatataaccaaagaagtgaaagacttttacattaaaacatgtaaaatagattttaccttgaaacatgtaaatagagtttacactgaaaaatggaaaatagcccagaaatacacccatatatctgtgtccagttgatttttgacaaggggtgccatgtccattcaatgggagaaaatagttctttcaactgatggtgctggggcaactggattttcacatccaaagaataaagttggactcttgtctcacaccttaaacaaagtttaactccaaactgtgcaatgattatggataaaagtttggtggttcttcaaaaagagaaacatagaatcaccatatgattcagcaattctactcacagatatgtatgaaacagagacagagagaaagagacagagagatggagatgggggagagagacagaaagagagaagagagagaaacagagagagaggagagagagagaaagagatagagaaagagacaaggagagacaggcagagaagagagacagaaagagagagatagggattgagagagagagaaagatatagggagagagagagagagagagacagaaggagatggaggagtctctttcacacatatgcacatacacagtatgctggaggaagctctatcatcttttatgaatctatcttaagaaattatgttgttacttccaccacatggattcatttgaaacaagtcatcaaagttgtcccatcttcaaggggagaagaattagaccatttttttgatggaagaatgtcaaagaacttgtgggcatattttaaaatgatcacaccactttattccatgtggcaattgaagacttttgaattaacaacacacgactagagaagaaaaagagacttcccctcttggatccagtatgaaaaccttcaggaaaggattgggttaggtgctgactccttggaccaatgaccataaccaaagggatgaggtactgtaattagccaagcctggctacctgtctgtctctgtgatgaggtgggtacatctgttaggagaagatgggggaactggtgcagtgcagataaaaatagtagctagtatgcttattgcctagtgaaacatgcacacacgaagcaattaggaatgattgagagcagcatatgaatttaaaaatgagggatgttaaaaatgcataaagaagattaaaatgaaaacactccttacagagttcattcatttggtcaatacagtcatttccatcccaaaacctggtcttacatgttagcttgaaggtgcctcttgcaacagattttccagagacttttgtctgatctttactgggaccaaagtaacctttgattgtctctgactgtggctgtttttccgggagctttatgtgctgggctcaggaaaagttcaacccatcaataggttatcacatatatatactctgggactgattggaccacattttctcactgaattgactgattgatgaattcagttggcagaattaactcttctatgtctacatgaagtgccatttagaaataatcaactcttaatcagcctgggatagtcagtactaaaagcaccttcatgagctgtgaaaaatttaatgcatttatttacatatttagttttaaattttagtatattgttagttgaggtatagtttccaaacaaagagccgtgaaatgtttagtaactgtctctgtacctctggatgaggacagctcagccgggaatggagggggactgggtgaggagaccagaatgtcagtgtggccacgcagcacacttttgttttgtcttctgtccttgagcactggcttgttcctggataaactaggcataataatacctatcctgctgtgtgggtggaaggttaaatgtgataatgatgtgtgtgagatgcctgcacagtgcctggaggtattgaagaattatttgctgccttttctttttctacctaccacttacccgctacccccgggtgctacatgttagaaaacactgtgtaaagtgtggatgcttctgaaaaatctccctgccagcagttagtgccaatagcgtgcagaaaataagatgcaatgatttggcttcttttctgtttggcaataagaagcttatttgcacatagcctgatttctttcaatctgcaaaaaaaaaaaaaaaaaaaaaaaattggaaatgaagtaaagcaatatatattaaaacatgcaaattataaagaagcatttaaagcttgactactcttcacattgtcgtatggcaaactattttttttatctgcagtctaaatttcatgacctagaatctctcgttttctgcctgatgctttgttgcatgacattggatgacattgagaaaaatgaaattgaaaccctgcttgggctttgaaagaactggcaatcctgcttttaagagtggaaggaaaaaaaatggaaagggaaggaggaaaatgggacatacatggaatactaaagacaagactgaagaaagagaggttgaaagctctctctcttctgattatgtttctgtgggtctctactgttttgtggccttcaccctcatgggcagagaaggctaaggtgtaattctcaggtaaccatttaatctttccatttaaaatggtcatttacaaacatggagtccatttcctttgcataatggcaacgagatggcgcctgtgctccttcgtggaattccttgctctgggtgatggactggacagctaatttgtttttataaagtgtctgggcacttaattaaatcttgcatcctgtctaataaaaaatcaatatcaaatccactaccaacacgttctggatggcagagaggcatgccagaagaaaatcttgagtggcggttccttccagatttagcaagctctgcagtttgtgtttggctgttctctcatcctgttgcttggcccagctcctattcctaagtcaatgagggcttcaaagcatggtgtgaatgcatcagctgctctagaggtcctgtctttgggagatgaattgtggcccattaaaaaaaagttctctagggaaatgtgaataagtttcctgcaagtctcggaaataaaaacctttatggtatataaatatttgaaggttaacaaggtcttcagttggaggaaggcaggcccttggcagaaccaaagggcatctcacgagtgggtagaaagttataggagggattggtcttttctgctttggtgttggtagtggtagctgggggtctctaggctgattgtgtatgatctggagtctggagccttgctacagtttgaactggtcagaaaagccaaggcccgcctccctctgctgactctgtctcactgagccataggcgtggggtcctgcattggccatttcagttttgcttgttgatgaggaaaggtagatcaagtgggtcaaggtggcaagggtcatgtattcagagtagggactgagtggagttggaaaataagcagcagtgaagaagagagatcactccagcaatcttctcactgccaaaagtctccaggtcccatagactgagcaccattcaataattctatgtgttgtatgaacgcatcagacaattccacaacctccttacttcatttgcctgcttgtcatagtgcgagaattgctttcattgtccatttgtttcttgacagtcaaatctcttcattaataaaaaaaagacttgaattcatggcaccattttattttccaatactattgtatagaatgtccaaactaagatctaaagactatctttttcccaccatccctctagaagttcctgatctttgttatatctcagcccagctcctcttgccatatcccctattacaatgaatggcaagtcaagcagaaaaaagcctgtgggtcattgtggactttcagctctcccgggacatgagccactacaccttttcgattttatctcttaagtatctcttccttctgtcctttgatctcgtaagtgttgtctggacacacgcactcgcctcttaatgggtccttggtttctattttcatccccctccaaagcatccttcgatcatccttcaatccctttccaatcatccttcatgttgtaaccagtcttctttctaaaactcatttacaattgcttttctacttcatctctctgcgtgactaatgtcactatcaggacaaatgttaaatatggcctgccataaccagcttcttgccctggcccttgcttagctttctaacttcatttcttgccattccttccccacttcaagcaactttctctctcttttttttttttttttgagttgcagttttgctcttgttgcccaggctggagtgcaatggtgcaatcttggctcaccacaaactccgtctcccgggttcaagcgattatcctgcctcagcctcccgagtagctgggattacaggcatgtgccaccacacctggcaaattttctatttttagtagagacggggtttctccatgttggccaggctggtctcgaactcctgacctcaggtcatctgcccgcctcggcctcccaaagggctgagattacaggcatgagccaccgcacctggctgcaactttctctttagtcccttggtagttcccgaaggcatactgccttgtccactgtttagtacctctgcctgcacttaccacctccttctcctactaggtcatccagacttggtttctggttggtcatggtgtggctcatgccacaatcctagctttttagaaggctgaggtggaaggacttgaggccaggagttgtagaccagcctgggcaaatagcaggaccccatgtctataaaatttagccagacatggttctgtgcatcaatagactcagctacatgggaggctgaggctggaggattgtttaagcccaggaggtcgaggctgcagtgagctatgatcacaccactgcactccagcctgggtgacagagcaagaccctgtctccaaaaaaacaaaaaagacttggtttcagtgccccttcttttgagtgcttggtatattctctatcctcatacatattgtgttttagcatagctattggctgtcctcttggctaaactgttagcctcctagggaaagaaagagaccctattcatttttactctttatccccagaacttagcatagtgcttggtcaaagtagcctctcaagaagtggttgttggatgaacaagtgaattcatcttattatcacttatcatcttattatcattgttacattattaatagctgataattctactaacaatagaattataaagcattagcgcttttcaggtcaaccttgttaaaaacctgactgcaaagttcaattctgccatttgctagctgtataagcttggacaaattattctttctaagctttattttttctatctataaaatgggataatagggttgtttggagaattaaatgagatggtgcatgctaaatatttgggttatgtatcattcagaatgaatgtttgttaaattatactcactggtaaaatatttaggtattttagatctgctagagataggctttttaatctctttgtgtttttttgttcaaatgtatttgcgaactgattattttcttagataatcattttcttagataaccttagcgcacctaatttgatgcctgttgagagtagagagaaaccaaaaagctcacagcagaaggactttttcatatgtcacagtagacaaacaaagttattttccgtcacagccatgtattgggtggaatgacctttagtagctgatgacagcgatgtagcagaagggacagttttccacttgacctttatacaatgtgccagcttgtctcataacacaaaataagttgcaattgacaggcttgatagaacactaacccgacaggagacagacactgaagcagcccctgtttgctaccgagcgtggcaacttccatatacccaagggtgccttagggatgactactccctaagtcatggccagaacatttagtgtaattagttcctctaggagtttattgtgaggtgagatttgctcataatgaattttcattgccaaggacttggttactcgcaggtaccccactatagtcttttgacttttctgtctttgtaagctgtcttcctctcctctttgctctttgcttttaccataggatgttttcttctttactctttttaattttttttctttaagacagggtctcgctttgttgtccagctggggtgcagtggcatgatcatagctcactgctgcctcaaattcctgggcttaggcgatcctcctgcctcagcctctcaagaagctgggattacaggtgcatgccaccacacttggctaattttaaaaattttttataaagacggggtctcactatgttgcacaggctggtcttgaatgcctggcctcaagcgatcctcccacttcggcctctcaaagtgctgggattacaggtgtgagctgctgcactcggcctcttctcagcttttctaatgcttcatttttgccgttccctaacttgactacttttagttttctaccactgggtgatttttttcccttggggctttctgcatgagggctaaaatgtgaagttcttaagtttgttccttctcccagatagtcacagggcagaagtggttctgagcagcaggtaggaaacgtgttgtcgtttcgtttacaggtttgttggaggaagttgctaccagtcatctcactttgcatacctagttctgacattgactgcattaataaccacaggtaatttactttacctctgcaggaagtcactggaagggttacattttcatttggggtgaacagcaactgtggatacggatcatgaaaattgacaatggaaaatgggcatgccattctggaacttttcccagcttttttccagagccaggtctgtcctgatgtgagaaatgatgtcctcatctgccaaatgagtacaataacattagctctacctaccttgctgggctgatgaaagaaacagaggaaataatacatataaaaactgtgctgattgaaaggagctatgtcaacatattaattcaggctgtccctggttggagtattgtggataatgttatctgctttttattcttttccacactacagatgagaaaaaaaaagaaaaaaagtttttaggagagaaaaaattagaagaaaatgtttaaaaatactctctggaaagttagaattctaataaaatccttagtaccacagttgaggatttggcttcatgctccaagtaagtaaatctggctgagattaatatttgatgcatatttatgaaatcagatatatcaaaactgtatcaaaagatataaatcttttatttttcttaaagaccttatacaatgaaatgttcatttatatcatatggacttggggcagcaacaaaaacttggcaacctggggttgctgatatttacagctgttcaacattttttggatccatgtattctcttcagaacaccagaaggctgtgcttttcaaattgtgttctgaggagcctcagagatgccttagggaaggctgaaagggaagcttcatccagagtactttggtttccatctgttattagtccagtaagatttcatctcaaaaagggctctgttgctaaaaaaaagaaaaagaaaaacaaacaatgaaaaaaaatcaagaagtaaacaaaaattcttgaaaagcactgccttggctgggcacggtggctcacgcctggaatcccagcactttgggaggtcgaggcgggcagatcatgaggtcaggagattgagaccatcctggctaacatggtgaaactccatctctactaaaaatacaaaaaattagccgggtgtggtggcgggcacctgtaatcccggctactcgggaggctgaggcaggagaatggcatgaacctgggaggcggagcttgcagtgagccaagatcgcgccactgcactccagcctggcgacatagcaagactccatctcaaaaaaaaaaaaaaaaaaagcactgccttaaggactttcaaaaatggtatctcagatatttggaaactattgttgagagaaaggaagagattcctcccaaatctgggcttctttttcatgtttgatagaagcttgaattttgagtaaaaaacacagtatgctagagatgcttaacctggaatgaccatggtatttgatacaaatgaggttctgtagaatgcggacagctctgcctggactgctctatgaaatagatctttctacttatccacactcgaacaagtgtgtccagcataaacatcacagtgcttcaaatactgttagtcccagtcaaggatgttattctgtgtccattccactcagaggtattcattttcttcttggcagctggaaccaattgctttggatccaccatggaagcctcgacatcctgaaccaaactcctattaatgaaacttcccaaatttaaacaaagcaagacaaatagatatccacacagcgtagatcatgacttctttagacatcatgaaaagaaaaagaggacccacgtggaagaatacgctcatttatgatcagggtagcatcatattcctctcccttttaacattatttcaggatagcagctgtctggatgctggccatgggcttgaaaaaaaccaggtgggcatttctgcccactgtaccgtttctcccatgcgtttcccagtcccctgtcatggcatgaaaaaaccgctattgttctgtgttgggacaattagatttttgtaggggggagaaaccacccaaaagcaaatggaaaaatatgctatgattaatgtcagttacgggaattaaacttcggaggcctttaggacaattatgaaggaatcattttccccttggtggcaatatgtactacagttgtcccttgatatccatgggggattaattccaggacgcctgtggatacagaaatccacgtgtactcaagtcttgttttcagtggatatgaaaagtcggccctccatatctgcaggttttacacttggcgaatgctgtatttttgattcatgttggattaaggatctggaacccctgatacagactgtatttattgaaaaaaaagtctgcctatgagtagactcacatgttaaaacccgtgttgttcaagggtcaaccataactgcaggcagaacatctgggcaggaagctcctgcaggaagacctgtaaactcaggtctgtggaacggcgatgatcttcttcccttgcttccagaattattgctgtgagatcaggtgcactggctacgaccttactctttgtgcagaacttatttctggtctggtttaagtgaacgttattctttctgtgcagtcctgtggttacatcaaaggttaaatttcatatagcatgtctgttatatcagacttctctgatggcctgtccagagcaaacattttaaaatattggtcctattctgtcttataacagtctgctctggtgatttttgtctcatcaattggattatgacactgtcagccactgttagtgttattctcaaattcagtcttccattcatctctccttcccttccctggcagacagacttctgcagccactgggactgttggggtgaggaaaggcaagaaccgatgtttcattctctccctcccttcttcctccctcttttttgttggttgtggggtgggctacatcttcttacccaaacaaccaggagcatttgttggcaagtttattgtgcccagtgccgatgtctggacaattaattccctaggtcagtggctttcacagtttgtgatggtgactccaggaaggaaactcaccatgaccctgtatatacatagaacaaaaatgcagcccactctgatattgtatttgttctattctagttcattaaaagtgaatgttggtcttcatcctttaaatggatattgtcacctgctaatagattggaccagtattttgaacaatggccttggtacttcatttggctttgcatgctcaattgtcatatcctctgtgtggggaagggggcagggctgcttccctgggctgtctcctgggatgcccaggggccctgcctgcctgcgtgggtccttggggacctagaagttccggtttttcatgaaacagcggggctctagaagagccttttcccttatcctgactcttccaccctgatttcttcccgaggacttcttactatgtttaaagatggcagtgaagtggcctgtgggttctagaaccctgcaaacaccgccccaagtgtgataccagtttacccttcttgtagacatccccaaacttcaaggtgattgtcttgaagcccttcacccaggagagggaaccagcgtacaataaccgctgtgctgcaggagaggggaggtaaagagttgtcacagccttgagcctagctcttcccccaaaggcagtctctcttttcttcttccttcctttagtcatctgtgtatagacacagatgcaaacttttcctggaattcctaatcttaagcagtcttcaataggagacctggcttcagagtctgtccttaaacagtgaggtgccctgtgtcttttattcttaactgtggcctatctccactcaaattttggcatttggcgtttggttgtcagtggttattttacattctcaagtgtcactgtcatttggttagggtagttgtcagggtggttctgagagccaagtgtgtagcatagctttgttgttacaaatgaaaaggccagttcccatttaaccaggtactgctggctttctctacaggatttggtctacatccattagtgctctttgttgtccatgtcactataggagagattccccgggacctacagggtcactgtctgtttccaggatcagtgagtcactccctcgtggcctgttatggctttgtgtgaccacagagagggtcacggtggtgtggaagcagggagggggagtcagccctcgctgtgcagcaaccacagtgacgtccccagtgatcaggcttcgtggggatgctcaagtccctcttgatgatcagctctagtgattctcatgttctgcacgcacagaatacatcctggaataatggtggtgaggtaggaaactggcaagacttattttgtgttcacaagcctcctgacccaaacaggatctggtccagacagggtcaagtgaagaaactgacgcaaaccagcagatggcgacaaaagccatccctaactgcccttattgctcattagcataagacatcccaccagccccatgacagcttacaaatgccatggcaactaccggaagttactgcccctttcctaggaagttctaaataacccacccctcaatttgcactagctcaccccttaatttgcctgtaattgaaagtgggaataaacacagttccgagagcccatatgttgctgactctgcattgctgcctatgagttagccctgctctgcgaggagcagtacgcttcattaagatgattgctgtctaacaccaccaggtcgcccttgaattatttcctggttgaagtcaagaaccttcctgggataagccccagtttgggggcttgcctgtcctgcattgttggtattttccgtttgctgagaaaagttcagttagtgctgcctgagctggctgaaggcccttctgggctgggtccatatgcccaagagggtgacactggctggtctcgggggtggtgtctttgagggaatgagattggtcctacgagtgctggagaaactgcacactgaaatggtgtagcctagcattgttagggagtggcagataggagcaagaagctgaaagcagggagcagacaggaaggagcacatcccctttcctcctccagccttgcagtctctttggagctggcagcaaagtcagaaacatggttggtctacagaggtccagcctcagcatcacaaaacagaagataaaaagatatgtttagaggggagagacaatagcttaataacaggcacagccccaaaataacattttgcttttccatgttatgaaccaagtgagagataacatgaaggcatgaagaagatggaaatctaaatatcagcatcgttcctgataacataacattatggaatgtggcttgggtatatggcaacagtgggcttcctaataccaaaccccagaacaagaattgcccatgcagctgtgggcagtgatgagctgcaggcaccttttttttgaggcctggccttgtaaacctgagtttctggaggagcagagcaaatgagtgctgcccaaggtcacctggcctccaccaaggagggagagaggaagcactgagttacacatgctcagtcttaggtcccagtttaccagtggggaaattcagtctatctccctggacaggtgaaagcagcggggcaacagggaaagcccctcctcatggatacctaagggcagggaagacgggctgtattccctccctacataatgtaaaagacaatattctcaaaagcagttgacacaacaggggccagttcttataaattgatagtatcaccccagaatgtgtttgggcaaaggcagttttataagtggccacatgatctggttccatgacatgctgcttaactgctctgtcttaattcaggaagtggttttagaatatcaggaaaagagagacggatggactgcatcatctttctagaaatatcatatccataatcacatccatgatctctctcttagcctatgatggacaaataagggtctgcagtgagattttacccttccctgcaagaatctggggtgtaactattcaggattattcattaagagagggctctcaagctaatagaatcaaccttggattaaggctggcatagtaatgcagtcagtacttggtaattagcaatattctgattcttttcttaaaacaccagctcatccctgcctgctcctgcttgtcttcaggtgtctgcaagatgataaaatggatgaacatagcacatgattatccgtggaatactcagaaactatcatctctcgtgttatagcttgctttttctctatttttcatggacacctgtgcttctcactctaattttacattgcacacctataatggattcttattttctgctactgatatttttgctagtgtataagatagaatttcatatatcaacatgtcccagtattcctcagagggcttaatgacttccaggtggttcagaaccactgatgcctggggccctaaagggagactgctgcatgtcctacatgtgtgaatggaggacagagagcgagtttaggacagggggcagggacggacattttacattttgaagaagtaaacactgggcaagactggccattaattcctcctctatttgaccatcctctgggtgttgggactcactgaatataggctgagtttcagagagacgccccttgagtagaattaaatctgaatcaagaagcaattaaacccatgacagcaatctcttggaatcatttttacttttgtaacaactcttctacttgtgtttttcaaaactcttcacaggcattcttttctcaccattttacaataatctggtggcatgagttggcctagtgttatttttcatatgtgagatgagtaaagtggctcttagaggggttaaatagggcctggtgtggtggtgggtcatgccttgcaatctcagtgctttgggaggctgaggtcggaggatcgcttgagcccaggagttcggggctgcagtgagctatgattgtaccaccgcactccagcctggtgacagagtgagactctgtctaaaaaaaaaaggaggggtaggggggtggtaagaaaaaaccctaaaattatattataagattgtttaggatgaatccaggactaaaatctgggtctcctgactcttaagcagataaatcagttttaaaacttgatttttttttcgtatgctagaggatttcatacaaagatggaggaatcacgctgcatccctttggtgtttacttgatcattttattcctctttagaggtttatctttaggatcacatgttgtgccatctatgatgttaatctttaagatgctagcttaaagcattataaagccaagatttgttttttaaagtgtctaaagagaatgtctcttgttaaagtgagactgtcttctcattttacaaatcctaactgccttttacagcacacagtgcggtagatgttcgggaggcagccgccaacaaggcacaatcgcccactgtcttcaggggcctctggcttagtcctcatgctcctggatagcacctaccaggagttcccatctgggtccaggagttaggctttaatacctagtaagagtcattgagctgccaactattattttgtagctcagaggtcttggagctctatccttggagttatacacttaaccagtgaagagcctaacggccaaagatgtaactgcttgacatatgaaaccacatggtgaacttagtttgttctaccaaggacctgaggtctttcttccatctgcattctgttactattgcatttttgctctggaaaatgttcccatttaacgaaattttatttctaaaatctgcatggcatctgaggagtttgagaaagtacttctaaaatgtgtcctgcagagccttctacagtgtatctttcggcttctccttagttatttatagaggcatatatatatatttttattatgctttaagttttagggtacatgtgcacaacgtgcaggtttgttacatatgtatacgtgtgccatgttggtgtgctgcacccattaactcgtcatttaacattaggtatatctcctcatgctatccctccccctcccccaaccccaaaacaggcctggtgtgtgatgttccccttcctgtgtctatgagttctcattgttcaattcccacctacgagtgagaacatgtggtgtttggttttttgtccttgagatagtttgctgagaatgatggtttctagcttcatccatgtccctacaaaggacacaaactcaaccttttttatggctgcgtagtattccatggtgtatatgtgcctcattttcttaatccagtctatcattgttggacatttgggttggttccaagtctttgctattgtgaatagtgccgcaataaacatacgtgtgcatatgtctttatagcagcatgttttataatcctttgggtatatacccagtaatgggatggctgggtcaaatggtatttctacttctagatccctgaggaatcgtatagaggcatattggagtccagtacatacacaggttcacagtgtgctagaagcattgctctttattagttattcttatcactggctgcagttttgtgatttctctctattaacattgcctttgaattgaaggtcactgttttatttgtattgctgctcttcagccaaaagaaaatagcttcattctgctttgttccaagaaactaatattctagcacgctttatgccttctgattggatttcatccaaattggaatagctcaggctagtggaaatattttatttaatcctctagggtttttttttttttttgactagctgttgtatcttgatacctttacatcactcaaagaatttaagctgttcctgctgccatgtcattagccagagaccaattttgtacaacccccttggctttgggcctaacactggtatgttccatttgtccattccagaaagggatgtacacatcactgtggtttgaattatattttaaaaaataatgatgatggtggttgctcagtggtgctcctctgatactctgaattctattatagatgaatgagctgcaaaatattctataaaaaaacaattatgtcttaaaagattataggctgcagcaattaccactaaaagggtgagagagcctgtagtttttgagcactgacaagcagatacatccagctaattttttgtgaaaacaccagcagagcaaattactcatgaaaaatctgttcacaggaatgaattaaatgccatgtccagtttaacagtgaacactgactgcaaccaaaaaccaatagagataaataatgaatggcatttgaattcattcatttgtatgattccaaaaatagcctcagtgccaatagtgtttctaatgtccaaaacccactgtagacatggagaaggataaagaagccaatgaaaaagaaactaaaaaagtgaccatttggattttattttttctccacattcctgcagccagtcacattgaccttttatttttattttttatttttaaactttagattcaggggatacatgttgtgcaggtttgtgacaaggatgtgttgtgtgatgctgaggtttgggcttctattgatcctgtcaccccaaatgtagttagtgaacatagcacccaataaaatgtttttcaatagtgcagtttctacagttactgttaatatggaattggcccaataacaactggctgaatgtataagttggatgatagcttgccagaaatttcccatggccttgttggtaggctggggtaagatatgataatatgctataaagaattattcttttaatttctctcctagttagactatacctaataaacttcagttttcagtgcacagaattggtcatttatcagctgtgcacctagattgctaagtgagttagtcctagcctaagtaattaacccattttggtgatgactgaatatatgtctaaattcaattaaaatgaagaatatggtgtaaaattatttttatgcaggagagcctgccattacattttaaataagagtttctctttcagagtttacatatttttaaatggctaaaaaaaaaaaatcacagttttttgtgtaggcatgatctatcacatttccctgtataaccccaaatgggaaaatggaagttctaggttccaagcttgggttcctgaatttcactttaatattttaaggattaagaaagaaccttgaaaggatattctgttgtagcccagtttttaggcagtattgattcaggaaaggcaagccccaaactggggcttagcccaggagggttcttggctttgcccaggaaagaattcaagggaaagatggtggtagaagaaaacagctttattgaagtggcagtgttatagttctgtgattgctcctgcagcttaaaggcagttctgcagtaatatttatacctacttttaattacatgcaaattaagaggtagttcatgcaaaaatttctaggaagagggtggtaacttctgcattgttggatcattgccatggaaaggggcagaaactctcaggtgttgccatggcaatggtaaacatggcatgctgggcctgtctttgaaaaggtgcttccattgcctccctgttttaaccagtcctcaattaggcctggtgtctgagccccacctcctacctctgtatcactcttaatactttgttatatttttattaatatatcaaggttatgttaattttgtgcactgaaagagctgtgaattttgcaaaagtttccaaattaactgagaagtgccaccaagagatatagtctattcagtttttccaaaagctgctttcttagcacatattccatttgggcataattttagcaagttgacttataaagcgtctttaagtggaatatttcttcccctgcctcacagccaaggcaatggctctccctggcactgtgcaaaccctgagccagacgctctgctctcaacagttacaacaaagtcaccaggtagatctagtttcactgtctctttcactgtcaaggagactgagtcttagagaggttctgacttgttcaacatcttgcaactagtaaagagtaaaattaaggtttgacttgagacagcttcttcagaactcatgctcttaaatcctgaccctatagtgtgaataccttggacccctgctcagccataaagtcctctcttgccctccactgtcatgaggactctccaaggttgtattgacttgaaggctacatgagaaaggtgggtgggtgcatactttacagttgagtttgatagcatagcaaggcttgacagataatgataactagctatctatgtgcctagggtttctcatacatcgcatcatgaatttttttacaaccttgtgtccagtgtattgatcagaaaggtcacagagacaagaagtgccccagcaggaattcagacccatctctgtttggcttcataatttatgcaaatcgatcccagacagaattctacttagaaatgcctcaagataccagttggaaattatctttcatttctgaaactggaaattaaaaaattatttaaacaatgcataatcattgtaaaaatatgtaggcattgggatatacagtataaataaaagaaaaatatcctttgtagagatcctttgtagacatagccaccattcatatttcgatgtgtgtcctttttgacctttttcattgtgtggctgagtggcattttgtcttttgctatttccgttgggttctctgtattatggctacttggatatgatctaaggaatgttcctctttctccagtaagtgctttcaatgcatatatcttaataaacaggtagaaagttggatagtttgctctttctactaataagtaggagccacgatagtagtattgtgacagtggtgatagtggttggagtgctagcggaggtgatagtagcagtggtcgtggtgctgatgatagtacgtgtgagagatgagttggtggtgtaggtagtgggaacagtggcggtggtagtggtgatggtagaagcagtggtagtggtgataggagtggtggtggtgatgataggagtggtggtggttgtagcagtgttgttggtaatggtggtagtgttaggagtggtggtagttgttgtggtaggagtggtagtggtggtaatggtagaagcagtgggtagtggttataggagtggtggtggttatggtaggagtggtggtggttgtagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcacttaaaaagagtggacaaactcatttctcttgcctggacagttgtgagtgaagatgcctccatccctgagtctgaaccataagcttggaccacatatataagtgattcacttttccatagcatctgtgaagacatacttatagaaacaatgtatagttctgaaaatctgagggtttaatgaaaagtagcaaaaattcagttggtcatttacttccctggcacatttgatgattgacatttggtgaaagaacactttattgtgaatctgtttgaagtggtggggcaatgagtattttggaggtgcccataatcaagctctttcttcagaagcttgtgatcctgagaaattttgtgttttctgtgttgtctataaactgcaacttaaggatgtttgcaaggcctattggcatcacgtgctctctctctctctctctcacgcacacacacacacgcatgcgcacacacacacaagcttgctagagcttgccagtcatatgacacactcaagacctggtgtaagtactttttctattttagtcattcacaacttaactggtttacttggcagattcttgctggggaagaacacttgcttcagaaccacatatcccactgaaatgtgtcagcaaagcaacaaatatgtatcaagaacaaggcaataggctaagtgctgagtgggcagatatcacagttaaattattgcttgtcttccaaaatttttgtatcatctccaaaggtttgtttttcctttcatatcacaacaaaatgatttcccagtcttctttccacacattgggcaagcttaaaatacaacatttctaaaaatcctctttggtgttccctgaaaagatctatgagctatggaaaccaagcttaccctaagctgtttagcattaagaatttgaggaaaccaaatctccacttttatgcagaaatcaaagagtagcataagtaacttgtaggttattttaataatacaataattttgtaaacaataaacagctcaaattttgtagctggctttgtaagtagagaaattgaaataaagtcactcaaaatcacactgactgattgattgtcaaaactcttagttcttcccaggactttttaaaaaacatacttttaataaaaagtacagataatatttacatattttgtatcctgatttatcttgtaatattaaaatatttcctgttttcctaattgttcattgacttactgcataccattctatgagtggatataccataatttacttaaccattcccctagaattggatctgaggctgtttccattttggagagttttttttgtttgtttctgttggctactgaatacttcctatgggaaagaggtggacgtggtggaaaatgaattgatagaatagtttgcatttgtataaagcatgcaaatatgtatttccagatatgtcacagtgaaaggatagaatctttcctgtagaaagaacacagaggttaagaatataggttttggagtcagacagaccttggctttatttctgaatccacataactgtgtgactaattttgaaaattttctcgaactttctataagcttctttctttcatttccaaagtgggagtaaccactctctcgtgggatcattgtgaggataaaatgattgatatgtagcaatgtgcttggcacatagcagtgctcataaaattgttgctattttctatgtttatcttattcctcatccaaactgtaacactcattcatttattttagtttgatttttttgagtcggggtctggctctgttgcccaggctggagtgcagtgatgtgatatcggctcactgcaacctctgcctcctgggctcaagccatcctcctacctcagcctcctgagtagctgagactacaggcgtgtgtcactgcacttggctacttatttgtattttttgtagaaatggggttttgctatgttgcccagtctgatcttgtatttctgagctcaagtgatgctcctgccttggcctctcaaagtgctaggattatagacatgagcctctgtgcccagccccattcatttatttattcagcattcaccagtggctgttgcatgcctgacactgagctttttactggcaagacagagctgaatgaggctgtgtttctgccttgtggatcccccagtatccagggacccagatcaaacagataggcaagacccctgtgtcacggaggaaactacaggggaaggtactgctttgggagtggctcttgggaaaagtaatagcaaaagcccagaggttagcaccgaaaaagatcaagttcagactctgcctttgctattttcttgctgtgaggccttgggtaaattacttaaagtttctgaatttcactttctgcatttgtattcttactctgcaaagtgttgtgaaagaatatacatatagctctgggcatgtagcagatgctcaaaaatgattattatgcttgaagtcttcagtgccccaatcatggctgattttcatgaaaataaactcaacaaactccagtgttctgaaatgtctgagactggctcagctgtgctcaggttagtctgaaatacattttattacagtctaattctctgcaaagtggtcatccacacatcttgtgtatggtaatgtggaattagaatattcagctctcagtgaatttcatttattggccattatgtaaaaaccaaagaaaaatgacttatgaagacattgattgctttgtagctttaaaagacctccttagaattagaatggctacacagcctctaagaatatggtctacactatatattttgtcatcctgcagacacaacaaggaagtgggaatcgaatctatttagcaggatgtctttatgtgtgaagatttcttgctgcttataaatgcttatttgattatttattcatagatatagaaagcacttttctttcattctgtttcctcattgtcacccaagtaagagtcacttattactgatgtgctaaagaataacagatgagcattgaccttcaattaaacattagcaaatatgttgcagtagcataaaaaataacatccacttgcttcagaatagaatgagatgatgcttaacatttctattgctgaggtcctacaagtaaaacatgtttgtttcataaatagaatttatattatcaattggaacatattcttcaatgcattattttgcctactgcttaggaatatcttcctttgttaattttgagttattttatttctactattcagccatgcttataaaatgcaagtcatatttctaatattattgctgttcttttagtcagatgggttcaaccacatttattcagcacctgctatgtgcagtacacttgtcagcatgctggtcttaaaccttgagctataaactgaaatcacattaacaatgtctagagaaagactgcagagatttaaaataaagaaaagtcagagaaaggtgagttatgttttttttgaccactgggccaaacagtgaaaggagaataggagaggaggttttcttaaaggcacaacaggattcacacaaatgaggagacttagaacagaaaggtcacaaatacagcacttgtagtgctggggatatgtattaatattttaaaaaaacaacatattttgaaataattctgcacttaaaagtcacaagtatgctacaaagagctcacatatctccctcgttctcatgcctgagctggctccttcctgagctggatacatacgcccgttatcagaacgtttttctgaccacttgagggcaagctgcagttttatttttatttttattttttgagtcagggcttgctctgttgccccggctagagtgcagtggcatgacatcggctctctgcaacctctgcctcctgggctcaagccatcctcccacctcagcctcctgagtagctgggactacaggcatgtgccactgcacctggctaattttttgtagagatggggttttgccatgttcccaggctggtcttgaactcttgagctcaagcaatcctcccaccttggcttctccaagtgctgggattacaggtgtgaatcatgatgccctgtcactcctaagtaccccattgtgtatgcccccaaacaaggacactctcccatgcacccaacctgcagcttcctccaagtcatgaagtcagcattaatacaacactcttctccagtctacagactccattccatttcaccaagcatcccagtgatgctcctttctcctttctgactcaggaacacacattgcatgcagttgttgtagctcttaagtttcctcctgcttgagcagttcgttagtactcaatcgttctctgtcttccatgtccttgaaagttttcaggagtgtagaccttacattttgttggatgaccttcagcctgggtctttcggatgtttcctcatgaccgggttcaggtcatgcaaccctaatgagaacctcttgaaaatgatactgtgcgttcacatcaggtgtcacacagtgtggacccctcccgccactgtggatggtaaccttcatcaccccatcattctgtggctgcctggtttctccagcactaagttcccatgtttcctttgatatctaaatagtatgttgtgggcatgatagtctatgattattctgatgcctactccccatcaaacctccatttcatcattcatttccattagtcagcattctattagcatggatgtgttggttcctattctattcaatgggctgtactttattactattattttgattctcaaagtgtctcaggtttggaccagaggaacttcttcaaggtgtctcttgtgttctattgacatgtccccatctgcctttgaatacttcttaatttttttgtacaacaggatgctgtagacacatctgtactgcccctgcctcagccctggcctcagccatttctcccaggagctctggttccttgtatggatggatggagtttagaaatcaggatctgtgtgcttggtgtgctcatggctactgaggtgtcattacttataggccttctcagtaggtaaatatagaaaatgtgtgtaaatgcactcatatgcttccttcgctatttccatattcacctgtgagtttgcatattaaaaactagtagtttatgctaatgtttcctattccagtgcaagtcattagaatcttttctacccttccccctttccatgattatatgaacattctccaataatcaggaatctggccctctttatcttcatatccttaactccttcatttgtttacatatttctccatgtaacctatctcccatttatcccagctgtcttccccatctgttgctgtgttcccctcaatgtgcctcatccccaggccctggcaggctcatcaccacgtgtgctgccagatgcctctgtgtggcagcccctgcatccttggtgctggtgagtggaccacctgtgtgctcctgtacaggctcccaacttaccaatggggccgctcactgccaccttttctgcacaggaagagacgagaaggcccatttatgattttgaccccagtcccaggcactgagttcttcaagggccaggaatgtgacttgttgatctttgtagcccaacagtctagcaatgttgatttacccaaagcattattaattgagtgacagatgaaataataaataaacatggcatttgaaaggtgaaaaagtcttgtcaatcattttcaaacactctcctctcccagaggaaccatttccacatcatctgtatcacatggacaaagattgccaatctgggtaaagcttcctccttcccccattgaggtgtgaaatggactgaatgcttgtgctccctaaattcctgtgttgaaaccctaattctaatgcgatggtattaggaggtggagtgtttgggaggtgattaggtcatgagggtggaggcttcatgaatggaattagtgcccttatacgaagaaaccagagaggtagcttgttccctttctgccatgagaaaaagcagctgcctgcaacgtggcagctctcaccagaacctatgctggcagcttgatcttcgacttccagcctccagaactctgggcaatacatttctgttgtttaatctacccagtctatggtactctgtaatagcatcaccaaccgacatagacaaggaggtctctgatgcacctttttgttgttttgtaacaatcatgatttaaaaacatcttgtggaggtattggtcatatttagcacatgaggctctgggacttaagtggggtaagtgatttgtcaaatagaatatgcacagttagtgtcaaagccgttgcccggatctgggtaccctgatccttagtgttgtgattctgtgttctatccaatgtcatgcctcccccacatgactcaggagcagagtgctggcatggagaagagacagggtggctgagcgagctcacttatggtcctgaataccaggggcagaggtttggactttgttctgcagcgcacatggagtcctccaggcctttgagaagattttgtattacaggttgagtacctcttctatgaaatgcttaggaccagaagtgttttaaatttccaatattttggggggttttagagtatttgcacatatataatgagatatcttcaggataggacccaagcctatacatgaaattcatttatgttttttgtacatcttatacacatagtctgaagttaacgctatgcaaaatttcaaaataattttgcacatgaaacaaaattttggctgcattttgactatgacccgtcacatgaggtcagatgtgcagttttctacttatggcatcatgtcagcactcaaaagctttcagactttggggcatttcaaatttcagatttttggattagagatgctcaacctgtaacatgtatgaaagtgcttggagtaatgccaggttctagcagatgtttttgcattttgtttatcagcttgtgcacatctgagtgttaggaaggtcgctctgttggtgatgtgtggaaaccatggaaggagtgagagagatcagacagagagtaattcatccttgcagaagtgctgacaactcgggctaggctggggacagtagaaatggagaagatgtgaatatgtcaaataccacgagagactcacgaggatgtgaaatgtaggaagaggacaaagcaaaggatctgaagctgaaggcctggatgggatagtgcccttgcaaggcagagtaacatcttgctaggtaggtaggcagtgagcttgatttaagacttgatgagatttatgtcttatattcatttagttgctaatgaaaaggatttaaagtggcttatgaaaaacataaaaaaacaagaaacaaaacaagggaatctaaagttcattgtaatcagactcattttttgaacaatttgctgtgagccaggcagcatcccaggtgcaggtcactatacaatgaccaacactgtgtcatggcgcctcttgtgtggatgcatgaggccttgaacatgtggaggtgagggtgtggtggcttgtcaaggagaacctgcctgtgcttagggagctggtggagcagggagcctacctgcagggttggcaggaccggaggagatactgggatctgatggatgaggtagacttagcctgggctggatgtggaggaagaatgactctggcaatgggaacagcagattctcctgaaccctgctcccagctcctctcacagcaactttgcttttctggttccctatgtccgatctgtcagagaacatctcaaatccgaccacttttcaccacctgcgctttcatttccaggtcctggctacccttaggtcttgcctggggaacatcaatgaccctgtgactggtctctgggctctgctcttttacaatgtgttcccaacagagcagccaggtgatcctgttaaacatgagctagatcatgccagtcctctgctcagaacccttcagtggctctcatctcccttggggtaaacaccaaagtctgctacaatggcctatgtggctctgaagatcaagcccactctcataccctctctccctcatctactactttccccttggttcaccctactaggagtgttccttacatattaaagtgtgtatttgcctcatggcttttgcactctctgggagctccctctgcctggaatatccaattagtgaataggggtgtcattcggggaacccagagagccagcttttgtcagaatggaggtaggatgcacccttatgctaaccagaggtggtgctggcagggcaagtggaagctcccagtagctgagagctgtgagagaggctggagtaggagataatttagaaattggagatcatcactgaagctatgcaattgctggtgaccatcctgatgcccttttctaatcataagataaaaaataactggggctgagcatggtggctcacgcctgcaatcctaacactttgggaggccgaggcaggaagatcacttgaggccaggagtttgtgatcagcctggacaacatgacaaaaccccatctctgaaaaaaaaaatttaaaaagcagagcctggtggcacatacctgtagtccaagttacttaggaggctgaggtgggagtattgcttgagcccaggagtttgacatcagcctgggcaacataacagggctccttagctacaaaaataaaaataaaaaaagctaggtgtggtggcacatgccagtagtcccagctacttgggaggctgaggcaggaggatcgcttgagcccaggagttggaggctgccactgcattccagcataggtgacagagcaacactttgtcttaaaaaagaaaaaaaaagagagaaagtagtagcttttgatgcctacccttttgaaggtgagtggcagcatggaacatagctaatcacagatattttctgcgataacttatatctttctttggaattcactgtgagtgtaatttttggcagccagtttaccatttccagtgtttaattttgttggatcagcctgcgctctctgagaacttttcatctggcagtggatgggtatagtttagaatatggtggatagcagagggaggctagactgggtttttaattttttttggaatttgaagacagtgcttaatgatattactaataatagacaatccttttgaacacatacaaaatgccaggcatgatgctaattgctttgcatagattatctcagttaatcctcagaaggccttatgatgtagatactattattaaccccattttttacagagcaggaaactgaagcttagaaaggttaagtaacttgaaggtcagacagctagaagtggcagaggtggggaagactcaggttttctcctaacccctatggaacagatctggatgcatctttacatacattatgactgtatcaggatgctattttagaacacataattcaagaactttattgcgtttcaccaaagttttgattttgtagaacaagaaataaagtattaagaaagaaatcatataaacatttgaacgcttggtgtcagttaaggaatgggtacatttcagcattatcctagaaggtcttatcaggccagactctactgcgtattttaagtggggtgtctgaattagcttctgcagtaacttctgaagaaggtggcacagactgagagatctgctaattacttgggacttgatcttggacagatgaccttttctagtatccttagaatgaattgttggtaaatgcttagtttccggctataggtttcaatgcatatgacaagtttatgtgaatgtctttcacttaacagcctcagagacacaagttttctgccctttcctctacctttttgggacccaggtgtgtgccttgggaatgggccagtgcaggaaaagagttaggttgagaggcacgctgtgactcatgttactctctgctggtgtatgataaaaggttttgttcaaaatgacaagcttgttgaaaaatgtgttttaatttagacttgagtcttatcgaaatggcctccttagaaaatggcttatagagccataagaacataaaggagtctttgtgatctagggtagagactcttaaaacattttctcattatgacgtaaaaaaggataatgtttgtattgcacactggggttaagtagtaagtgctcatggcccgaggtgatggcttgggatgttgagctgccttgggcccacccactgccccagggtgaagaggatcaaggtcttagtgcactagcctgccaaggaccaccagaagggaagctctgatgaatggtatcttaaaacccagtccttccatttctgcagaaatagttttatgtgaaactttctaattctttgggcattggattttgaagataagttctcattagaatggattccaatttctgcagtttatttaaaattttttaacagtttgataccaacactttattagcaaagaaaatggaatcaacttttttttttggtgccagaaagcatagttttttttccataagaaacaaaggtgaaatatatgtaatgggtgagagacaaccaaaacttgccacataagggccagtgagagaatcccaacaaatagcaaaagttcatttttccatgacctattcatcacagaacaattaaaaagctacacaaagatcagtcttacctgcattttagaaatacatttcaattcacccatggatccaacatgggtgatctatctatctattcttttagatagacagagaagtttttattaactaacttaggaaaaaacactacctgttaaactcataaacaattgtttaaagagtatctacagaatccttctctcaatgtttccatgtaaaagaaatgaaaatcaatagtccagagatcctcgttaataatgagccactgataaacacaacatatttataacttgtataacattttatttatgtgcattctttgagcattatgcaatgtaattaaaatttttttaaataaaaaaatttaatatctttattttttgtcaattgatttttccccacttaaaaaatttgcaaataataattgtgcatatttatggggtacatagcgatgcttcagtacatataatatatagtgatcagatcggggtaattagcatatccttcatctcaaacatttattttcttgtttttttttgagacgtagttttcctctgttgcccaggctggagtgcagtggcaagatctcggctcactgcatccttcatctcctgagttcaagtgattctcctgcctcagcctcccgagtagctgggatcacaggcgcctaccaccatgcctggctaatttttgtatttttagtagagacggggtttcactatgttggtcaagctggtcttgaactcctgacctcaagcaatccacctgcttcggcctcccaaagtgctgggattacaggtatgagccaccgcgctcagcctaaacattcattatctttttgtgttgggaacattcaacatccttctgactatttgaaactctaaaatatactattgtgaactatagtcattctctattgctgtagaacactagaacttattcctcctatctagctgtaattctgtaacttttaacaaatctctccctatccttcacttccccctacccttctcagcctctaatatcctctatcctacctcttacttctatgacatcaaccctgatacagtttggatgtttgtccccttcaaatttcatgttgaaatgtgatccccagtgttggagatgggcctggtgggaggtgtttgggtcatggggtggatccctcgagaatggcttgattctcttcccatggtaatgagtgagttttcactctgttagttcacatgagagctggttaaaagagcctggcatttcttgcttgttccctctcttgccacgtgatgtgcctgctctcccttagccttctgccatgattgtaagctccctgaggccctcactggaagcagatgccggcactaagcttcttgtaaagtctgcagaaccaggagctaaataaatctgttttctttataaattacccagcctcaggtattcctttatagcaatgcaaaacggatttaagcaaactcattttagcttccacatatgagtgaaaacatgtttaactttctgttcctggcttatttcacttaacataatgtctttcagttccattcatgttgccaagaatgacaggatttcattcttaatggctgaatagtatttcattgtggatatataccacatttgctttatccattcatctgttgttggacacttagattgattccatatcttgactaatatgaataatgctgcaagaacatgggggtgtagatgtctctttgagatgctgatttcctttcttttggataaatgtgcagtagtgggattgctggatcatatgattgttctatttgtagtttcttgaggaacttccatactgttctccattgtggctgtactggtttacattcccaccaacaatgtataagagttcctttttcttcacatccttacaagcatttgctgtttattttatttttttgtctttttgataatagctatcctaactggggtgagatgatacctcattgtgattttgatttgcatatacctgatgatcagtgatgttgagcattaaaaatacatttttggccatttttatgccttcttttgagaaatgtctgttcggattatttgcccatttttaaattagattgtatttcttttgttgagatgattcagttccttgtatattctggatagtaatcccctgttggatgggtagtttgcaaacattttctcccattctgtaggttgtcttttcactctgttgattgtttatatcttttatttttttgagaaagggtctcactctattccccagactagaatgcagtggcatgatcacagatcactgcagcctcgacttccccagactcaggtgatcctcccacctcagcctcctgagtagctgggactacagccatacaccaccatgcctggctaatttttgtatttttgtgtagagatggtgtttcaccatgtttcccaggctggtcttaaactcctgagctcaagtgatcctcctcgtttagcctcccaaagtgctgggattacaggtgtgagccattgggcctggccttgttgattgttttctttgaagtgcagaagatttgtaatttgataaaatctcacttgtttagttttgctattgttgtctgtgcttttaaaatcttattcataaaatgttttcccaggctcatgtcctctgttttcttctcataattttatcatttttggtcttacatttaggtctttgattgacttagactagattttcatataaggtgagagacaggggtctactttcatccttctgcatatggatatacagttttcccaacaccatttattgaagagaccttcttttccccgattagtgtttggaacctttgtcaaaaatccaaaaatcagttgacagtatatatgtggattaatttctggattctcaatactgttccatcggtccgtgtatctaattttatgccagtaccatgttgttttggttactacagctttgtagtatattttgaggtctggtagtgtgatacctccagtgttgttctttttgcttatgattactttggttatttggggtcttttgtagttccatacaaactttaggatttttttttctgtttctgtgagaaatgtcattggtattttgatagagattgcactgttattttaacaatattaattcttacaatccatcagtatgggctgtcttttcatttgtttgtatcctcttcaatttctttcatcaatggttcatagtttcccttgcagagatctttcactttcttggttaaatttatttctaggtattttaatatttttgtagttattgtaaatgaaatttccttattaatttatttttcagctagtttattgtccatgtatagaaatgccactggtttttgtatattaattttgtatcctgcaacttcactgaattcatttatcagttctaagagtttttttgctagagtctttaggtttttctagatataagagcatgccatctgcaaatagggacaatttaacttctgccattccaatttgaatgtcttttatttctctctcttatctaattgctctggataggacttccagtgctatgttgaataagactggtgacagttgggcatccttgtgctgttccatttattagaggaaaagctttcagcatttccccattcagtaagatgttcactgtgtgtttgtcagatatgccatttattacattgaggtactttccttctatacctaatttgttgagaatttttttattatgaagggatgttgaattttatcaaaagctttttctgcatctattgagatgatcatatgatttttgcccttcattctattgatgagatgtatgatgtttattgatttgcatattttgaaccaactttgcattcctgggataaatcccacttgatcatggtatattatctttttgatgtgttgtttgattctgtttgctgatattctgttgagaatttttgtgtctctcttcatcagagatgttggcttcttttgttgttgtgtccttgtctcattttggtgtcagagtaatgttaaccttgtagaatgagttaggaggaattccttgccttttaattttttggaatagtttaagaagaattggtattaattattctttaaaggttcaacagagggtgtgggataggggtagggagtgcataccttatgcttctaatctggagcaatgcagctgtgcagattcctggcagctctccaaactggactcagggcttgcaagaactgtgagattctccttttgcaaggactgtaggtgtttgctctgtcaataggagttgatgaggtccttctgtttatcttttccatgcaataagaagtccctcctgactctaggcagattcaatctgagcaggggatacagggctgcagaggctgagtgcctgcatgctgcctttcgggactgccattcatcacagttgcatcttcactcccccaccgtactccagcaccctcccttcaacactccagtcaaatcttactgtttattcattgccttggtccttttttttggtgggggtaggggggcaggcagaatgccaggcatctctaatcaaccatctgctgacagcactcttccaaatgatctggagtttatttttatttttaagaaaaaattgtattacacagattctatatttataccttgtgctagtagacttaaggtcattaaaatataatggaacccctactttacaacagaagtggatatatagtcatctatagcatggtagaattcgaacatcatttctatggctttagtaactgtgactggctctatctggatgtgcaatttctgaggaaatgttaaaatcaaaacttgggcactgattttttttaaaaaaggaattatataaaactcaccaaaattatagtttttttccccaaaatgctcattgtgcttttaaaataattaatattaagtatccctctgtgtgaagaccataattatgaccatcatatcactatgtcaacaatgacctttgagagttaaaagaataaaagataggagagccatcttgttggtgcaaagaagattcttagaagtaccaactgagagatgaaagtgctggcctagaaactagtaaccttgtcatgatgtcattaaggcaaaggttcactacaactggagctaagagacaccggggttatctattttgcatttcatggttcttttttcctctctctcatcattttgggtttccagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcagtgagtacttgttattgtcaccattttcccctcatgtttcttcctacctctcagctcccacatagtgaagagctgggaggagcttagctgtagagacccttggctgcctttcctgggaagggccctttgttggttgggaaggtggggattcttccagagtgagagatggcccatgtgggtcatgcatctctagaaagaagacttttctgccacttgacagagagagaaccttctcaagtgcagctgcatcccaggtctgaagcatctcttgggaaactacccttctaagaaggtgggggtaatttcctcttgttgaggcagcttggtgtcctgtgatcatattaagcctgtaagataaacagatggtcccctctgaccgagcgatgaaaatccatcctcctcctaactctgccctccagctcctgagcaacatttgctatttgtgtcacccaaggctcttctgagattagtaatatatagagagcagttgctgcttctaatccagtggcttgtggtcctggctgcatgtttgaataacttagaaagatttaaaacctaccaatgtccaggctcctccccaggcaagctaagtcagaatgtctaggtgtgggaggcaagggtggctcccagatattggcatgcttaaaaaggctgagaaccactgctccatctacctttgtgttccctttctccctaggtaaaggtctgagagggaacaggtgttttatgaatgctatgagcctcatcacaattcaggtctggttctacttagttatcaacatggccacaacaattccactttatttcccacttccaattggtcctgacaatcacaagattttctggcctattcctattaagtgtacatggcattatacatttagtttatcttgatacctccctgaagcctgcctgcacagtgagaccaattactttcagttttgccagtagcatgtagcagagtgaatggcacctggtaggtgcttccttataactatttgcttagtgaactttttcatggttctcctcaatagagagtgaatttcacctcgccattttcattcttttctaatctgacattgagacatcattgcaacattgcgtgttcctctttcacacatgaggccactcccaaattgactttctctgtaattctctcattcttttatctttggggttatttcttgtcgtctactccagtcttgggaaaattttagcatgtaaaaatagggcacaaagattgaggcacaataaatttagctaatttattatgtttctatttatttaacaaacactttcataacagttactaaatgctttagaagttactcatttaatttatttccatttttgaaaattgtggtaaaatacacataacataaaattcaccatcttaagtgatggtgattaagtgattaagccattgttaagtatacagttcagtggtattgaatacatcataatgttgtgcaatcatcaccaccattcatctccagaacttttccctcttccccaactgacactctgtacccattaagcaataaatccccatcccttcccctcttccagtccatgacaaccacattctaatttccatttctctgaatttgactactctgtgtacctcatagaagtgacatcatacaatatttgctcttttgtgactgacatttctcatagtatagtgtcttcaatgttcatccatctgatagcatgtgtcagaatttcctttctttcaaggctgtataatactccattgtatggatagactacagtttgctcattcattcattaaaataactcatttaatgttcatgacaattctagggggtagtattattttatatattgatatctacatgtatagagatctgtatctacatctatacctgaattttaggatgaggaaaccaggcccaatagaagctaagaaacttaggcagatccaccagcaggtgagtgctgagggagacacaaacccaactgtctggcttgcatcttggccctgaatcagtgcactgtgctgccttttaagtctgggctggcaaaggctgctatattattatctctttagccatacctgcaatttggatggagagtgtattagtccattctcacattgctataaagaaataactgagactgagtagtttataaatgaaagaagttaattgtctcatggttctacaggctgtacagggagcatgatggtagcatctgctcagcttctggggaggcctcagtaaacttacaatcatggtgaaaggtgaaaggggagcacacacattgcattgccagagtaggaacaagagagagagagaaaagagggaggtgccacacacttttaaacaacgagatctcatgagaactctatcatgagaatagcaccagaggatggtgctaaaccattcatgaagtatccacccccatgatgcagtcatcttccaccaggccctgcctccaacacttgggattacaatttcacttgagatttgggtggggacacagatccaaaccatatcattccacccatgttctccccaaatctcatgtttttctcacattgcaaaatacaatcatcccttcccaatagtcccccaaagacttaactcatttccagcattaactcaaaagtccaaagtctcatctgagacaaggctagtcccttctgcctgtgagagtctgtaaaatataaaaccagtcagttacttccaagatatagacattgggttaatactcctgttccaaaagagagaaactggtcaaaagaaaggggctacaggccccatgcaaattgaaatgcagtagggcagtcattaaatcttaaagctccaaaataatctcattttgactccatgtctcacatccagagcacactggtgcaaggagtgggctcccataaccttgggcagccctgcccttgtggctttgcagggttcagatgctgcagctgctctcacaggctggcattgagtacctgcagcttttccatgctgaggatgcaagctgccagtggatctgctattccagggtctgcaggatggtggcccccttctcacagctccactaggcagtgccccagtggggactctgtgtggggttccaactccacattccccctccatattaccctagtagtggttctccatgaggggtcctgccctgcagcagacttctgcctagacaaccaaacttttccatacatcctctgaaacctaggcagaggctcccaagcctcaactcttgcactctgtgcacctgcaggcttaacaccatgtggaaattgccaaggcttatggcttgcaccctcagaagcagtggtccaagctgtatctggacccctttgagccatgtctggagttggaaaaactgacagcagtgtgaggagcagtgtcctgaggctgtgcagagcactggggccctggggctggcccatgaaaccattccgtcctcctcggcctccaagcctatgaggggaggggctgccatgaaggtctctgaaatgcctctgaggccttttccccattgtcttggctattagcactcagctcctttttacttatgcaaatttttgcagcctgcttgaattcctccctcgaaaatggtcttttcttttctaccacatggccaagctgcaaattttccaaacttttatgctttgtttcctctttaaatataagttcaaactttaggtcatttatttgctcatgcatatgagaataggttgttagaagcagccaggccacatcttgaatgctttgctgcttagaaatgtcttccaccagataccctaaatcattaatctcaagttcaaagatccacagattccctagggcaggggcacaatgcagccaagttctttgctaagcaataacaaaattgacctttactccagttcccaataagtttctcatttccatctgagacctcatgagcctggctttcactgttcatatcactaccagcattttggtcataaccattcaatcagtttctaggcatttccaaacttttcctcatcttcgtgtcttcttctgagccatccacactcttccaacctcagcccattacccgattccaaagccagttccacattttcaggtatctttactttatagcaatgccccacttcttggtaccaattttctgtattagtccattttcacattattataaagaaatacccaagactgggtaatttataaagaaaagaggcttaattggctcactattctgcaggatgtacaggaagcatgatctggcatctgctctggcttctggggaggccttaggaaacttacaatcatggcagaaggtgaagggggagctagcatatcacatggctggagcagcaagagagagagaaatgggaggtattactcacttttaaacatccagaccttgtgagaactctatcacgagaacaccaggggatggtgttaaacattcatgaaagatccatccccatgatttaatcacctcccaccaggacccacctccaacattggggattacaattcaacatgagatttgggtggggacgcagatccaaaccatagcagagagtgatgcttttattctggtcttgcctaagtttttgatagaatatgattaactaaaagccagtgtcatgcattcttaattatattaggttacaccataaggacatctcttacatttgactgtttgaaacctgtcaaacattttatggggtttgacctaataaggcccccagaaaagtataggcctttattaaacatttatcaagccaatattaactgttggcttactttatgagctatcatcctctttccttttccttacaggagttgtctgtatactatgccagtgaatgttccattcactttttgagctcactgtgacctgatttctgtctctatcactcctcaaatatctaccaaagtcagcaatgactttctatttgctaaattaaaagacatttttcaattcttattctgctatgtatcatggcagtgtctagaatttttaataaattcattcttaaaactcccatttcccttggctttcatgatttcacccttcctggtcttcttgctacatttctggccattcttcttaatgtcttatgagctccttctctccctttcttcttaattttttttttttgagacagagtctcactctattggccaggctggtctcaaactcctggggttaagcaattcttccaccttgggctcctgaagtgttgggattacaggcatgagccaccatgcccagcccctttctctttaatattgttgttcttctgtcttctgttctagcttttcctctcttctcactttgtatcttctttctcagtggtctcaaatgctctgagtcttcagatactgtttctatactattttttcccaaatttctatctctagccctgatttatctccagaattccaatccacaattcagttttctattgagcatctcccttatttttacttaatttagtatctttttatccttaacattactatctctttatccttgccttttactaagtttgctatcttttaaactaaatttaccgttgttctccccattcagttccttctcctatatccccagtctgaatgactttcactgccatttacccagttacccaagcaaggactctgaggcatctctggatcctccctttccatccctccccacagtcattggtcaccaagtcctgttgtgtccactgtctgtctctctcatttccactcacttgtctcacctgcacgtcagtgccttagttctggtctttaacactttaaatctggattattgcagtggtctccttgctggtatttctgattccattattaccacctctcattcatcttccacaaggccatgatagaagtattatgttatgctcaatggctccccattgcttgcaggataaaattcatgttgcttagcatgacattaaaagtcttcacgatccagcccctgcccagctgcccagcatttaactagacattaccagcatctgcaatagacacttactgaaatattatatgttacccccatgttctgaatgtttctagattctatgatcttgctcatgccccattgttgttaccaactatttcccattcttccagacttagtgaaacaaatatccttgcaaagctctgctcatcagtcacactgcctctcccttgaatgacagcataccttgaatgacttcacttctgcttaggtcttaaatacatctgttttcttgaatatctgtttactctgacagatgataagctccttgaggacaagactgtattatatttatctttctatttctagagactagaatagtgtctggcccataatctgtattctatattcattgaatgtgtgaatgtgacacatatgcatatgtagctatatataggttcacaaacgtatatgtgaatatcgagagagagagagagagagagagagagagagagagagagactgacttcactttattgggattcagttgccctagaggaaaatgctccttcagcttttcttctgaaattgccagcaagaaggagttgcacagaatcttgacagaaccttggataggaggtcatttctggtcctttctcttccaccaaccagctgtatatggcttggtgtagttattgaacctctccaaactccactcccttcatcagaaaatgagggggttaaattagatcactggtttctaaactaaagttatttatgtattattaccgtaactagaaaataatgagttgaaattaactttctgaaatttttctaatgcatattaacacaattacctagttgctaaaatttttttaaaacctgcctttcagtgtgccagctacccactgctgttttcacagtgaccaccagggggccatggtggcaggctgaagctcacacagcccagagcctggacagaaaccgctctcacaggctctccgagtcaaggggtatatataatatttttgaatgagtggtgcttttcctgtagaaataaaatagttgtatcaacatgaacaatgttaaatactaattaataactcaaataagtgcctgctaacctttttgggatcaagtatttatttattttgagaagctgatgaaagctatggacttcctctattgcaaaaccacgtgtacacatgtacatatatgaaaactattgagtgtattttcaggagactcacagatctcctgagttattcgttcactccttagagggtctttggttcccaggttaataaaatttagtttaggataagatttaagaagctgtaaacatccagatacaatcagatcctttatgttttattatttttgttgtcactttgttcttaaaaatcacaatttaattcagcttttgagaaacactgtttaatcctctgaactcgtgtagaagagcaccctgggttatgttcagatcctgccagcagccaagagagctttaactatcttcaggggttaactaggttcctctgagggcagatatcggtactcaaatcatttgacccctcttctgtggggtcctctggcccagtggatttgcttgttggaggaataacttttgtgatatcctcttgattcctgtgggaagttcatgtatctttgccacaacaaatggtatatgctcaggccaccctataatagaccctctctgccctgctaggtctctctaattcctttttccctggtttacggggcagcaacacatcagaagtgagttccttagacaatgctgcagcggacagtttgggtgccctgtgtcccaatccctcggcctccctccgattccctccacaactgggaaccgtgctcacagtcggctttccactcaggcacccaacaggtttatcaggcctgtctgcacaggtgttctcggaacctgtgtgaggaggggtgggggtggataatgccccagcctacccagcctcttagggaacagttctgaggcatgctccacactgtttttttttttcttttctaggaggttcctactactaggaaccttttggccaatgggttccatttgtccgtgtggtgaccagctccacagtgaaccttttattgaattttcctctttctcactctagtttcttgggaatcacttcttcaaaatcaacctgtactcaggtccctgtctcaggctctgctgttaagagaacctaaatatagacagatatccacattagagaattagatgtcagtcttccttcttgcagggcacccccaatctttgtgagtgaatctagtggattttttttttcccactgggtttgagtagaagagtttactcccatgtgggccaggtttggataggcaaaccatggggtaggggagaaaaacgcgtctctcatgaagacccatttcctagatggccaacaggtgggtgggtattgagagtggtggttgattgcagaggtgctggttgagcagccccaggggtaggatgccccactccatcattagagattcagaatgcagagcgtttaggtctaagtccttcagctttagtttccaactctggagcaacaggaaatttctacctcaatatcctgtgacaacagggattagaagagaagagagaggcttctgttcctactgtgtcttccatccaatcaaaggaaagttatttttcctttctcctaagagagagagttggcctactatcatcacacatttggaagataattttctcatgaatacattgcatttctctaactatacaccccgtgcatttttccactggatcttcaccaatatgtacgtgaaaactggtcctatttgtaaccgaaattgtgtgtgtgcatgtatgtgtttgtatgcatgcgcacacaaaatgtcctttatcgaagaccttttcccaggggataacctcaaactcaagcaaacaaaatataacaaagtttaaaacaaagatctatcatggttttccagtggggcttatcaaggcagagccccagtttgcctgtccacatatttcccactagcatgcttcctttgagatgggaacagagaagatgaatgttgtgcagcaccatgatgcttttgggcagagtcattcttcctctggccaattgctcctcaattgcctttgaaacatgtgattctttatttccctttggttgtcatgtagggactaacacagcattcagtgtcacagaattcagtgatggtcagctctaagcccttgagattggaatcaagatacactgtatgagaccagaaaataactgttacagacacattttacccaggatataaaatgagatggctatgatacaacatgaaaattatcattactggctggacatggtggctcacacctgtaatcccagctctttgggaggctgaggcaggaggattgcttgagaccaagagtttgagacaagcctgggcaacatagtgagacccccatctctacaaaaaaaaaaaaaaaaaaaaaaaaaacaaaactagccaaatgcggtggtgcgtacctgtagtcctatctacttggaaagctaagtcaggaggattgcttgaactcaggaatttggggctgtagcaagctatgattacaccactgcactccagcctggctgacagagcaagatctcattgcaaagaaaaaaatatttgttattaccaacaaaccaggatatatttctgaaccccaaatcagatcaggagatggggaaccacaagagacagtggcatgccctgtgtcccactcccaggagaccaactccagacccttagtcatggcctcaataagagaagggagaaaggacaaggggggaaactaagttgtgagccacagaggacttctcagaacttgttttggaactattggattataaataaaagctcccaaataaaggtcttccatatcatcctctttgttcaaactcaactgaagtctgtcctgaggccagtggcatcaggcataactattatgaacccagataaatattcatgtgcctctcttgccgggtggtcatttctatgagtgggataagactgtataaaacaatgaaagtcagtttcctgaggaatgtgacttctccatgctccttactttttagacccaaatcatatatatatggaagaattataaagttacctgtattgtctctggcaattttacaacattcttttgtgctctcagaatggccttggtaatttagggcatcgtttattgaatgagcaagctatttctaggtgtaaagtgcacttcattggttctatgactggcccaaaccccttctttatcaccatcttcccaaagagggagagatgggacacacaagtcatatgacataaatttgataggatagtcatcagtagggagcagcaattagcaaccttaatcagaagagttatacccaactcttgttgccagaaatagtcatctgaaaggtggcactccctcaggaccgcatttttctaactgtgatgatgagaacatcggccttgttagttttggtcctttctgagactaaaattctgcgattccagcagtggcacaaagcaatttttctggtactctaacaacattaggggtctcagagaaggacctcctgtgttacatgtgaagatgcgtaaaccacagcactgtcactagcagttccggtgcaggattttctcacaggtggatttcctggcttctccttgccctgtcaacattctcacttgcagagccttctgaaggtggcctctcgagcaatgccaagggcactagagggcccagggggcctgagtgctgggctgggaaggaggtggcaatgtaggctcatcacaggcgtgcaccccttaacaagccggcacaggaaccacagacacctagacgatttcttcattcttttttcaatattcctgaaatatgcattcaaacagtcacatggtaaaaattgtcaatggaatgaaaacatttttcctgtgcaatttggagctaattttttctgtgatgtaggatcttattttatgaatggattttatcctcctttaaattattgatggaaaaggccaagatttttcccgtactggggtggtgccgatggagacctgtatgacactgtgggttccgggtgtgatcttggacacctgaatccccattggcactgagtgctgttctaacattctaccctgcatgtttttatttcttgcccctgagggatttgctcattttgcatactgattagtttacagcagcgatgctaatttgcagcgacatcagggattacactttgagaattattaaatataaaggggacaacattgcagaacacagaggaagcctgactcagaggacagaagatttgaaagacggaagcctgtcccttgcttcattactgagctacagtgtgtcctggggccatcactcagccatctgtggatccctttctctacctggagtaagaatatgagagacagacagaagagttttggttaatcacaggggattttcttatggattaagtaatgaatgtgattaatgataatatagagaattcccagttacccacctgtagctactctgtagctaattttcaattctgtgttgatttccttcaatgactctcatcccgacccagatggtatctatttaggaaattcaagaaacttgtactattagcataagcagagcaaattggggaataaattagtgcaaagaaatgatccaatgcaatagaaaagtgaatataaacggcttctggattttctaggacacagactcattgaatcattctataaatatttgccaagcccctactaagtgctgggcactggggccctcaccatgagatgagctcagtcccttccctccaggttcacagtcaggaacgagtaactgcaaacaggctgagactctgcagcccagaggaggaagtgcgtttcgttcccaccgacatcagtacctgatagtagtaggatggttttcttccagacatttcttctgatgcatataaatatcctcagacacattttatctttttttctttctcttttcttttttactttcttctttcctttcttttcttttttcttttctttctttctttccttctttctttttctttctttctttcccttccttccttcttttctttcttttcttttcttttcttttctcttcttttcttttctttattttctttcctttcctttccttttcttttcttttcccttcccttgcctgcctgcctgcctttcctgccttcctgccttccttcctttcctttctttgtggtattgattgccctgttgcctaggctggggtgcagcagcatgatcatagctcactgcagcctctaactcctgggctcaagtgatcctgccacttcagcctcccaagtagctgggactacaagcacgtgccactgtgcctaatttttagttttgttttgttttttttttttttttggtagagataaggtctcactgtcttgcccaggctggactagaactcctgggctcaagtgatcctcctgcctcagcctcccaaagtgctgggatgacaggcttatgctaccatgcctggcccacatctttcatcagaaagtgagtgctttggacatgagtacagtgttcattttcccgatacaaacattgagatcctggggagatcaacagcaagcttcttgaggatggaggcgttctgtctccatccccaaacagccccagtgtgagggtggggtctgtatacaggagatgctcagtggtcatttatcaagtcagtttgttccccatagttcgctccatagggaagccatttttgttatcatcatcactgtcattcttattttaaaaatgaagaaggtaaggttcagagagattaggtaagtgcggtgacacggtgtgaaaaaggcagaaccaagacccaaagcgtggcctctgcctccacaggctgtgcactctccacgttgcactgccctgctgatagccaccaagaggactcaaacaatgggtgtgtgtggatgtgactggaaggcaggggagatggaagttcctgggcttgctgagaacctaatggtgtgtggtatctgggaaagagcaggaacctgggactcagcctgatccgcattgactcctaaactctccttcctgctgtctgcatggccatgggctagaccctgacccaccgggactcggtttcctcatcagcaaaaccggtataatagcatcttcatcttaggtctgtaatgagaagcgaatgtgatcaaaagataacgtctggtgaacagtacgttcttgattcatagtactttattttattattatcagtttaaacatttttcttgatgctgctatttgcctttaagcatatgaaacaaagaatagatttctaaattatgtcatatgttacaataagtgacctttaagattattcagagaatccgatctttttggtagacttaggaacaaaagcaaggttcctttttctgtaactgctgttttctaacttacaaaaactgaggtgacatattttctagtattgtttctaaatgtatgaagcctgcttcattgcaccatggttggttggttcacttatttcgtaagtgtcaagttaagactcagcaagggggaagagtctcccccagctttaaagtctaccatcattggtccatgccttgcaattgcccatttcttcattgctttgtaatttttctgttgatgcatttgtctctcctgctccatggaagaaccaagaactgtttagcattgtgtccccagagccaagcacaatccatagtacataccaggcaagctcagtaatgttttttctttttctgaatgaatgaatgaaatggggtaggagtaaaaggagacaaacatagcacaacatatattaggatcagttactcattttcttttctaagaaatgcggaggcagtgcgaccctgtgttaatatataaataagaacatgcagcttcacgcttctcctcattgagccctgaaataagtacaaaggtggcagacaagatctagctgtgtgggagatgccacggaaggaggggataggtttaatttggcctttttaggatgctgagtttatgcctccaagtgtcagagctacagatgtctgctcctctgcaggggaagatgaccttgaaggtgatgttattgatgagctttatttaaaacacagacatgttcaagagctacaagactaattggctatgttaaaatatttaaatcaaaagtgcagctacttagtgtgtgttggcaaacattttatgttacagttgtaaaaatgatacatgctcactatggaaactttagaaagatcaatggaaagaaatgattccaccacccagagataagagctgatagcattttggtgaatatttttcttttattttatgtacatgttattaatatttttacaatggttcatttcatactttttgccataaaacctgctttagaaaaaacagcaataaatagtgaacattttccaggccagtgtatcttcttgtgtgacctaattttagtggctgcttagcattgctaagaggtcctgatgctggagcacgattagagtattttcagtcttgggctactaagaaaaaaacctgatttttgtagccgatctttgtgtaaaactatgattatttacatgcaatcaatacttggatgtgggaatgtagaatcccaagttatatttaattttaagtctcattcttattccctactctcaccaaagacttatggtttgggaaaacctttgccaggccagtttgttaggtgaaagatgatgttttatgttgtttggattttcatttaaaactatctttggaggctgggcttggtggctcatggctgtaatcccagtactttgggaggccgaggtgggcggatcatcaggtcaggagatcgagaccatcctggccaacaaggtgaaaccccgtctctactaaaagtacaaaaattagctggctgtggtggcgcgtgcctgtagtcccagctacattggaggctgaggcaggagaatcgcttgaacctgggaggcagaggttgcagtgagccaatatcatgccactgaactccagcctgggcaacagagctagaccttgtccaccctacaaaaaaaaaaaaaaaaaaaaaaaaaaaactttggataataatcattttccttaacacttcatttatttctgaggtgggggatcttgctatgttgcccaggttggtctcaaattcctaggctcaagcagttctctgccttggcctcccaggtagctggaactacaggtgtgcatcaccacgctcagctgtattccatctttttggaatttctggttggtgcacttgtcttttccttcataatttgatataactttttataaattagcaatattatccctttttctgccatatgtgtagcaatatatttttccccacttgtcgttcgcctattagttttagttgatggtgttttcttggacatagcttccttgaattgttgacgtagttttgcttagggtaaattgttttcctgcccacctgcattccattagaaatggattgttttaagggtgaatttgtcattctttggtgacaaataccaacaagtctcctttaaagacagctcaccaacataaggcccaaacctgtgccacattttcactagcatcactgtcaccaaatatgtcaactccggcaagaataagagaaggagcctaaaagattttaagtggttttgacagtctttagcaaattttttctgagaagctcgcatccaagcatctgcaaatcagtcacccctccttttaatctccatcaaggtcagctctggaatttggccctgtttggatagtccaaggcagtgctatccaataaaatctagtgtgagccatatacacaattttaaatgatctagtacgcacattaaaaaagattaagggccaggtgcgatgactcacacctgtaatcccagcactttgggaagcggaggagggaggatcacttgaggtcaggaattcgagaccagcctggccaacatggtgaaaccctgtctctgctaaaaatacaaaaattagctgggcatggtggcacacgcctgtagtcccagctattcgggaggctgaggcaggagaattgcttgaacccaggaagctgaggttacagtgagccgagattgcaccattgctttccagcctgggtgtcgcagtaagacattatctaaaaaaaaaaaaaaaaaaacaaaattaagaagaaagttaatcaagtgaaaattctgccaggagctcagttgcattttctagaactcttggcctaattttattaagttcaacactgtgataagtgctgggaataaaaaaaaatgtgatgtgggctctgcaagaagtgtatttctctgtgattaaagctgattgtgggagaaaatcttctgaaaccctcagtgacaaccttctcattgactagtgactcaaacagtagtgcaaagcagaagattctaaatgagcagaggaagggtggatgccgtaaaggcaagggaactggtgaatttcagaaatagtgagtgtgaattcaatactcctaatcatttgaataaagatcttgttatatttccccaaaattaataagaaacaggtgaaattaattttaacaatacatttaattcaatatatccaaaatattatctcaacatataatgaacttaaaaatattacgaatgagttattttgtactctttattttcatactaagtccttaaaatctggtgtgtgttttacacttttagcacattttaatttgggctaaccatgtgtcacatgtggtcaggggctaccttatcagacagtgcaggtcccataatagtattctgactaaggggaaaaagcaaaaatcacaagagattgtaattcaggtagaaacttacattaaggagctcatcctaaaaacaggtaagtaccctcctaagtatgagaacagatgggggccacttgctggagtttcttactcttaaaatacttgtcaacatgaggatttcagcttctgcatacctgtaccaataggtatgtgttgttttaagggccagcggagatgacacccacaccccactgagaatggagccgaggctgttggaacccactgctcaggacagcttgcacgtgtccatcacgagacgagactggcttcttcaggaaaagcagcagctacaggtgagcaggtgaaagatcttcaagaaatatgatggcatttttcttttctttgagacagggtcttgctctgttgcctaggttggagggcagtggtgcaatcatagctcattgcagccttgagctcctgggtgattctcccacctcagcctcccaagtagctggatctacaggtgtgaaccccatgcctggctaaatttttttatttttagtagatatcaggtcttagtatgttgctcaggctgctcttgaactcctgggctcaaagaatcctcctgcctcagtcttccaaagtgctgggattacaggcgtgagccaccgtgccaagctggcatttttcttatccatttaagccaaatgcagccaagtgggtctttgctttccttgagtgtagcaattagagccttggctgtcaagccggggagtacaaaaaggagagatggtgggaatgactagaaggcttgtaggaatctcattacaaacgagggttgaaagctcagcagcatttgtgcctgttttcgatattcctcattaccttttgaatatgcttttcttgtctgccaggccaatttgccacttcttatcattttgacctttagaagcttcctttgaaaggcagaaagacatctgtgctgtgaaaatcctttatggaaattcctatcatggtagactgtgagctgcagttgttaagagacagagttgtaagtccggactgagcaaggcaggcacatctggaatgattagccggctgcttggaagcccaaggttggcccagaacagaggatgcaagttggctaagaatcatcgaggggctacaaatctgggtgcagcactgagttaaagccagagctctggaagttgacagggcaccccagaggcagggaatcttgaaacagggtccatgcctgcttgagcctggagctgtgaagcatgagtggggagcgatgaggacacattgattagaagcaacgtgacttcatgggaagagcataggtcttcaacacccaagttcaaatcctggcttaggctggaggcttcccatctctgatctggtcatagagtattcgtgttatctgaatttgccccatccaggtcactgcaagagtaaggtggcaaagggaggaaaaagtcagggcaatttatttgaaattatttcccccattaactgagcacttacacagtcaatgtgcatcattataacgtttggatagctgaaaatgtgaaatctggtttttgatttttaataacatttgccaattaaaggtctacacaattcctgagacagtcagagtgtacagaaaataattttagccctgggcacttagtgtttgaagcactctgggaaaggtacttgaatattcatttattcaacagacatttattaagggttcactaagtgccagatactgtttgaagtgcttgagattcctggggagcttttgatccactaggggtgagaatggggagatagacaataagtgataaacataataaaacctctattagacaactggtatgttatagggtgataagagcttcacagagtagactaagatgatgtggaagaggatggagtctactcattgagaagtgagattggacccaacagttcaaagaggagagggagtaggccttgcagaaatttctgcaagaggatcctgcagggggataccaacatgaaggcttagagtgggagtgggcctcctgtgttcagagggcagctggaggcccatgtggctggagcagtgtaaatgagggggaggatttggggaggaagtcagagataaaggggccttgtaaggatgtggacttttctcagattgcaacagggaaccattggatggtgttaagcagtgaagtgacatgatctgaccacattgtaaataatttgactcctgtattaggaataggatgtaagacaataggaaaacagtatgcagcttccttaaaagattaaaaattgattgactgtgtggtccagccacccccccttctgggtatatatctgtctcaaaaaaattgaatgcacagactcaaagagatgtttacacacccatgttcatagcagcgttatacacaatagccaaaaggtgataacaactcaagtgctcatcaacagataaatgataaacaaaatgagtatgtacatgtaatgagatattagtctcggaaggaaattctgacacacgctacagcatggttgaaccttgaggacattatgctaagtgaaatacactggttgcaaaaggataaatgctgtatgattccacttgtctgagttacctagaggagtcaaattcatagagaaagtagaatggtgattcccagggacttggaggaagagaggataatggggaattagttttcaatgggtacagagtctcagttttgcaagatgaaaagagttctgtggatggatggcagtgatggttgtacaacagtgtgaatgtacttaatgccactgaactctacacttaaaaatgctcaagatggtgaattttatgctatgtgtgttttaccagttaaaaaactaaaagaaaaagaaatgaatagggtagaggaagtcaaaagtggaggtagagaggttagttgagagactttgtcagtaatactgtaatcttggagcaattggggacactgaggcattacttttttcttagaatgtcttggtagtagacattctttagtaactcccaattcttctccccactcccagacttgaagtgggttcaggaggtagaagttgtaggtgatgcacctcggggctgagagaacgtgaataagaggttaggagacacccaggattagagttgcactcttatccccacaaaacatgggagtatgttaattaagagtcttattttttattcagaatcatatgggcagtgagacgatgatctactataacactgtgcacatgacgggcattcattacctgctgcttgtttagttaattgaccttaatattaaatgatattttatggattatttggatttcagtttgctatattcgtagaaattaacatttatttatattttcatgaactttagactgcatggcaccatctgcagcatctcattcttctctcagtcctgtagacttaagaagccattttttacctttctctgtactctgaattcttgtgtttggggacagactaacaaagggtcagttgcatttcttgttttggtctgtggctggggtaacctgcttagctcagacctcaggtgcatgaggctccctgccctgtgtcctaactcatccatccgaaatgaagtaagtcatttatgtatctgctgggttcttccaagtcaaattcttggctcaccccccatagttatttaatgcttgggagggaatgtttttccttatgccaactcattagaaatataaagctggcatgatttttccagttcagcaaacctccaaaaatctgcctgcctcagaaggggagttttgtagttctggtgcatatggccaattctcatttaaacgagtcattatcctcagagcagtttgccatgagcagggttaatttataaaatcttgtctcctcattctctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggaggtactgctgatttcctaactgattttgggtcgctcgcctctttgacctgttcattggaatgattttgtctgctgtctttcatttctaaacatttcccaagcagtctgtatttttcagtggaagcaccattggtgttttgggtgggaaaattcttcacggtgtggggcagtcctgaacattgcaagttatttcacatcctggccacttaacccactaaatgccagcgaccctccccattccaatatgcaccctccccatttccaaacaccctcaggacaccctctctccctttgagaactgttggaattcaattggttagagatcctaatgccaacttttgctgaggacgatcatctggatgaactatgcctctcactaagggaagaggcaagctattgagagagggacacccaatggcaaagttcccatctggaagaatggattgttactggtagctaaaatgtattgggtgcttaccatgtaccaggcagtgttataagctgactctatgagttacttcggttgttgtattcattttacaggtgaggaaaaacgtttaagaaggttataatttgcccaaagtcctaattaataagagagaaaactgatatttacactcctgttcattaattctgaagcccggtcttctccactctactctggagtgagaatcatccctgtattctgtatcatggaatgtctataagatacacatctactttttgccctttatttatttatttatttttaagagacagggtcttgctttgttgcccaggctggagcacagtggcacaatcatggctcactatagcttcaaattcctgggtttaagtgatcctttctgcctcagcatctggagtagctggaatcacaggcttgagcctccacatctggctattttttttttttttaagttttttgcagaaatggtgtctctctatgttgcccatgctgttcttgaactcctgggctcaagcgatcctccctgcctcagcctctggaggagctgggaccacaggcttgggtcaccacatccggctatttttttgtttttatttttttgtagaggtgaagtatttctatgttgcccaggttgctcttgaattcctgggctcaagcgatcctcctgccttagcgtcctgaagtgctgggattacaggttttagccattgcacccaatctttcttgcccttcaagagctcatactctcatttctgagacatacagaacgcacacttacacatgttggacaaaaaagtgagtggcacccgaatgggtagatgagcagtaaggactgcaagtgctacgtgggtagagccgggagtgggagcaatggtcggcttggccactgtgctgaagaaaagacttcctacaactcaccacctgtagtggttgagaatacggactctgccacctgattgtctggagttgaaggttaactcctcactcaactcattattggccgatttgaggaaaggggtgttgataataatttctaccttatagagctatcacatggatgaaccgaggtagtacatagaaaactctcagcagagcctggatggtactaagcactttattgtgcttccagtcgtcgtctttacaatggaaatttcagtcttctgaaggccttcaaactacccgtccaaatatatcttactgtatttagtgaacgactgttctgtcttccacatgtatcacatcctatccagcctataaaagcaagcggcacatgctattctagggagttacttaagatctcctcccattccccttctatcccgaatatttccaggcagaactctccatggctcatgcccatggagagggggaagagatttggattgttgccggttttcatccaaatgaaacgggtcccttgaatacagcttgttctctcccacctgcactttcagaaccattcttcagctattgccttggtgtggtgggtaggctgttatgttctcattttgcaactgaggaatcaaaaactcagaaagtttccctgatgatgtagctagtaagagaccatcttgtgtacaactatggctgtctttgggcctgaatcaataaaagatggtttccttccagagagccaaggaagctatttctatgactaattctctttcctcatctaaaactaggagctccacagtgtggttggctgatagaactgagcccaggacttggtctggttttctacctgtatcctctggtttgccttttaatcaggatgagtcacagagaaggcatgaatgtgtgacttttactgagtaatctagtgctttgataggtttttatttgtttgtttgtttgtttgtatgttttgagatagagtctctctctgtcacccaggctggagtgcagtggtgcgatctcggctcactgcaacctccgcctcccaggttcaagcgattttcttgcctcagcctcctgagtagctgggactacaggcttgtgccagcacacccagctaattttttgtatttttagtagagacagggtttcaccatgttagccaggatggtcttaatttcctgacctcatgatctgccctccttggcctcccaaagtgctgagattacaggcgtgagccactgcgcccagccaattggataggttcttgaaaggcatttcaaaagttgtggctctctgattttatgatgctgttagggaaattatatatgaggatgatcttgaacatggggcactgctgtctgtggggtcctctgggagaatccaccatccccaatccgaacattcccactgagattacagaggtcaggtcaagaacaggctgccacgtttttgtgctgaggtgactataggaaaacctgggtatctcaaggactttcagaaaccatgaaggcttcatgtaggaggagatcttgggaatgtaaggatgaggctgggaacagtggctcacacctataatcccagcactttgggaggccaaggcgggaagaatgcttgagtccaggaatttgacacctaatctctacaaaaataaaaaaataaaaataaaaaaaattagccaggcatgattgagtgtacttgtagtcctagctactcgggaggctgaggcaggaaggttgctcaagccctggagttcgagattacagtgaactatgattgtgccactgcagtccagccagggcaacagagcaagaccctgactcaaagaaaaaaaaaaggaatgtaaggacgaagagtttcatgggagggtaggaataaaccagagcagttaaaaggtacaaaaaacctggacaatctaatgactagttaataacatgacctttttctcctgcgataaggaagttatacaggtgcctgcagcatggaacactcatggtgagcagaggccatcagcactggctggagttttgtgtggctggagtgtggccaccctgagacatcctcattatctgggtgattctcaagaggtgatccttggcatcagtctaatttactttgaggtgcagggaggtatcgccgcatctggagggcagtgtgggctgtgtaggtgcacactttgattggtcagcttcctttcttccaccgtagggaggtgaggcatcagactgctccctgccgtaaccatcaactagagaaacccgtcatcaatatttgggctttccatttgagaaggaagatatgtcttttccaagctgatgggctgcagcatggatctgcagaagtgaagcatttgaaagaaaccagtgtagaaccagctggctcaacaggtcagagagattgcttggtctagtatttttaactaattggacatgatcctgttaacctaatttttgctatgaagtattggttgtcttttagaaaatgctgacttagggataatatccagtaggtatatttagccaaatgaacccatcttacatacatcaatagctgccttcattgttcatgagaataggctcttcttaggccagatggagagagccagacaaattgtgaaacaggaaaaccttgaagtcttataaagagaagttgcagagactagtattgttacaaaacctagagaaacagatcactcaacatcacgactgttatcatcatctataaggattttcatagaggccagatacaaactcagggtgctgtctgtttgtaatttactcaactttctaacatgcaattgcaatatgctttgtttcgtggacaacgacccaacagcttgaaaagaaacttcctaatagcatgtgacatttctggatgtatcactggtggagacttacgtgcttacatggaggccatcgtttctgactgtggcttgttgggaaccccctggccaatgtcagagatgggctggaagtagagggcatgtgctggggtcaaggacacccagtgattttcggtttgggtgtgataacagaaatcaaagaagccatttgaattttccaatgtctgtgttctggatcaaataacttagcaggaggagatgaagtgttaccatcccagagacatcatagacactttttgagtagagccaacaaaaatggttttcttccagtgaacaaaaggagaaccctttttaagcactggagaatgaggagctccacagtatggaagctgacagagcaggggtgcatgaaaggacaggaaccacttaaaagatatgttcatttgaatttctctcatccctgggatttcaacccccctgctttaaaacaagtgccttgttttctcctgcaagtcttcctttgatgtgagggtcttagaagaaccacttttacccagtgagcttggttcttctcccacatgaaacccatggttcttgttctaccccctgctgactgcattcccattctctgtaatgggattgtgatgtgggggtgggggagggaggagagggaaaagatgggggacacagggaggaggtgacagtgtccaagattttctgtggatcacatccctccatgtgggcatgaggttccatctatttatttggcgtaaattgaggagaatggtgatttgcagctcctctctgtctagcaccattagctcagcctcccctggcttcttgttggttttatgtgtctggaaaaccaggggagggcagcctgtgacctcatgtagcatgcatatggctaacggcaaagtgagggaggaataattatagtaataatcacagtgatgacgtggagggctgcctaggatgctttctaacattctttagaaatgcttgactggcttgtattcatctggggttgagttcttcattcctcagctcctcggatttttcatgcttcatgtgaaatgtgttctggcagctcatggatgaattgtcgcttgttgtgcatttggaagaaacatgtcacatcttttgcaaaccattggcacaaagtgtgaaacaaactcaacccctggttacaggagggctggctgggccttggttggagagtctgggagcctcgcggcagggctgggctggggaggctcgcgggtggagaggagccaggccttctgcagtatccatgcccccagccactagctaaactgcccagggctccctggcggggggcactgattatgcagggtgctgcaggcatcctcatcacacctgtgctcagtccacaacatgcagtccctgctgatgtcagtcctccttgcaagtgagatttgaaataatgtaattcaccagctcacaactgaatgggaaaaaaaaatcaatagttcctcttttccctcagaaacatatcttattagagtgaggagacagtgaaacagcaaggcctgaattggaaaactgatcctgaatctaggatcctggtagagattctcaaagagggttgcgtggaagcagctgtgtgggaggggtcccattaatgctcttgccccgggggtagtgcgaggcagccaccaaactggagtcacgcacagactgcagagaatatccctgcagcatatcagcagtctccaagctgcttttccattcgtgaagattgttgttctttaatctccacttctgggctttgtctttctctctcctctgtctttgccttctacctgactggtttgccaagacaatggctttatgggactgagagcattagacatcatctggagaaagaggagagctttgcatttttctaggaaattctgattttccccctcttttttttggtaaggacttttctctcttttttagagatggggtttccctctgtcccacaggctggagtacagtggtatgatcatggctcattgcagcattttactcctgagctcaagtgatcctcctgcctcagccttccaagtgctaggattataggtgcatgtcaccatgccaggctaattttttaattttttatagagatgggggtcttgctatgttgccaggttagacttgaactcctgtcctcaagtgatctttccacctcagcctcctgggtcactgggattacagggttttcttttccccctacccccctttttaagtaaagtagacatcttgcttttctcaggaattcatgaggcagaaaaatatttgccaagacagcaaatgcagtgagacagaagtgtgtgagcaatgctggccagatgggtgcccggagtgaggcttccctgcataggcgacatctgcagcattcaggacctccctgcaggtgtgccctctccactcaaatttatcctgtctgtccttcttagttagactggtgttgatactcatacactaattttaatatctctgttatttacaaactgtcatacttgcttacaataaccctataaggtttgttgggcaatatattgtttttatgcccattttgcagatgaggctgctgagggtccaagttcacacagccgtaaaagcggtgccctcacgtctttggccaatttttaatgcagagggaatccagagatggttcacactgatggcctgggagagaccaggccttggacagagtgcttagtccagcaatggaaagaagtccagcccagcagagccgtgggtctgtgggcccaaggaaaagagaatggatgtccctccaggccagggatggttgtctctgtgtgcctagtgttgcctgattggattggagccaaggtgtatctaaaaatagacagcctgggaagaccaaacaggcaactgtctcaagtcagagaggtctgtcagacgttccaaagaaagaaatgtgagaggaagagaaactggaaagcaaggccccgccccagggctagaggaactggtattacttgtctgtgaaaagagggtttgaactgggtggcgtggaaggtcttttctggttctacaatactttgcactttagtattttatgaaataagttaaaataagctgcctaaaaacccctcataattctattcctaggagctctatgttaagttcctccttaaagttccctgggcaggctgtgaccatccacaggccacggtgctccagctggcactttccttagggctggtccctagagcatggacctgagcaaagcctgctttccaagcactgctgctgcagctcagagcttagacctcgcctcaccattgtatatcctcccgttttcttctggaaagtcgtcattacaggcaacgtggaaaagtttaccagactataatctggtaaaggaggaagaggattggaaaagaaggaagagatttgaaaatcccccttatctggctgggtacagatgctgctcaccaggaaatgtaggttcccaataaaacaggacccccatttccagttttcattgcgttgtaaattaaaaataaaatcttaagcccccaaccactgaacggattccctcttggccaaggagaccccagagactccatacaaactgagttcccagccccagtgggccgggaggtcggatttgccttgttataatccctcccttttgtagcttagacataacaacagagcagcatcaatgctaaaacgagatcataagaactgatggaacagactctcggtggcaataagataccaaattataaacaagacctaaggccatgccaggcagggataagtctcacacccctgcacctaaagagtaaactaccttctgactgccacctgggttttctttttctctagcggctaaacgagcactgtcctagagatgagctatcttaaaaccatggcagtccttgcaccgccagatgctgactgactgactctctgttccaccagctgtaactgcagctttcattagaaaagagactgatttcagtaactttcttctgatacaaagaccaactgtggactgcttctggcctatttagagacacttgagtgcctttgtgttctgaaaagaccttttacatagagggcctaattgtaatacatgtaaatgttaagtctccaccctaaggtgaacataagttgtatataacatgtatgcttattcagtatgcatgcattaggaccaccttcatgaatattcatagctcctgctataacctgtggaatatgtatacttggtcaacctattcttgtttttttttttttttttttttttttttttaagatggagtctcgctctgtcgcccaggctggagtgcggtggtgcatctcagctcactgcaagctccacttcccgggttcacgccattctcctgcctcagccgccggagtagctgggactacaggcaccggccaccacgcccggctaattttttgtatttttagtagagatggggtttcaccgtgttagccaggatggtctcaatctcctgacctcgtgatccacctgcctcggtctcccaaagtgctgggattacaagcgtgagccaccctgccggccttggtcaacctattctgtgtaaattcctgtcttacctgtccctcccttaaagtgcctgctaatggcttctgccggaggctatgcttcccagcctgttagaatggcaaccttgcaggctgtaacccccttttaagaaataaagctctccatattctcactcataggtgggaagtgaacaatgaggtcacatggacacaggaaggggaatatcacactctggggactgttgtgggctggggggaggggcgagggatagcattgggagatatacctaatgctagatgacgagttagtgggtgcagtgcaccagcatggcacatgtataaatatgtaactaacctgcacaatgtgcacatgtaccctaaaacttaaagtataataaaaaaaaaaaaaaagaaaaggaaagaatgaaaaaaaaaagaaataaagctctcctttctaaattgataaattgtgtgatttttaagttaacaggctatatttgagaaactcaagggaggaattctgttttacttgcagatgtaaaaaaagactttattaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcatctggagatatacctaatgctagatgacggttagtgggttcagcgcaccagcatggcacatgtatatatatgtaactaacctgcacaatgtgcacatgtaccctaaaacttaaagtataattaaaaaaaaaaaaaaaagaaatgcagcctcaggaaaaaaaaaaaagactttattttgtgctacagtaacatttacgatgatttttgaataacagaacaaaggagggtgaaaaaatggatatgtattttataatgttgtattttaatattttacaaattctctgggcttgttttctttaagaagcttacaacatgagtctattattcttagtattattattgtttaggtagctctttggaggcttgtgatttgtagactcatccatttctcttttatataatttaggcattagattaattattttcaactggagccccatggattatcaaagatgagagatagtcattttagaatgatcatagctagttctaatattgcagctgcaagtcaactctcacaaacatgaaagcatgtgacctattttaagtctttctcctagtcgatttcaacttttagtttccattattatcaccttgagaaccgttctgtacttaatttctctgtaatttacatgtcttttgcaatcttctgttccctttatcaaattctcttattctttcctttttgtaagttgtatgttactattccctgctttaacttttcagatgttaatttagtatgtcaggctaaactcttcttcagaccttgagctgaaactctgggagaagagcagaagttttggaatcttccagcagaaggtaatttagctctgctcagatagacccttctccagtgactgctgggaatatccccaggttggaaataccagctcattgcttgctgagaatttaatcagttaagagcacacctttttcgagctgtggaagggtgattaatctaccctgtgctgatagctaggctgctaagatgacccaaagcaaagccagacagaacctctagatttcctgtagctgctttcagtggggggtgctgtgtcttatatagagatcgttgttaaacattcatcttgactttcattgtcattactattttgtacttcctctttggcaaatttcctcagcttcctctttgagtcatgttgatattggtgtttggattctttatgcaatttctcctttagtcaactggatttttttcctactgttaattcattttgttcaccagtggtctatttttgcctttcttatccaataaagtatgtccatctttagtttacccacagaaacattttaggaaatgaaatcgacaatattccccagttttaggaatcaggctgatctgttgctttgtcaacagattttgagagatgcttgagagaaatgtgaggttaaaattgtctctgcagacttgagctgtgcatatgcttattcttagccagacgccagttaattaaagatgattcagaaaagaagaataaacccacagcagaaagtacaacgtttttggcaaactttacagttatggaaaatataaatacttagaaatttaggagaagcaagaatatattttaaaaattagtattaaatataaatgcaaatggctgggcacagtggctcatgtctgtaatcccaggactttgggaggccgaggtgggaggatcacttgaggtcaggcgtttcagagcaacctggccaacatggcaaaaccccgtctctaccaaaaaaaaatacaaaaattagccggctgtggtggcacgtctgtgtagttccagctactcgggaggctgaggtgggagagtcacttgaacatgggaggtggaggttgcagtgagtggagatcgtgtcactctactccagcctgggtgacagagcaagactgtctcaaaaaatataaataaataaataaatgcaagcagttctgggtatttatttaaaaactcagttgttcccatgggagcaactggacattacttattaaataatcagaataaagggagggtagtaattgaaatggaaatatgaagttgcctttggatcacgtaacagaataagcctggatgtagtatcattttccccttagatcaaattgttgtatttaatgggttgaactcacttgagtttttgggggtgggggaaagctctagagcccaagtactgaaatcttgtttggacatttaaatacatcgtggttatgagaatagttgaaaatatggagctgacttgattaccagtctccaaaaataagaggctggtaatttatttccttattattgtaaaaaagaatcattaaagaacttgtgaggaaggggtagaaaggagaatgattatgatctgaacataaggctgttcatatttctgattcctgttctcattttttcattattaaaccaccaaaatctcctacagacaaatgtctgtaagtcaaaatgtttttggcacatgaattacagtttcagtttggaataagattgtttgaggcaatgagaaagatctggttgaattaatacttggagtatttggataagccaaataccaagttcatcagttaaaaataaagctgtgatttttgatgaaactggacttcaatgcatgctgtgatgttgtgatgtcaggcagagcttcccagtaagcctggggacctgcaagagatggcacggggtgagggtgtgaacgcgtgtgtgtgctaccttactcatatgtgccaatttggaaagttcagcaaattcactattagggcttactcctttcctctgctcactgccttcgcatcagcacctcgatcacaggaaatcttttccaagaaaagatcagaaatccttacgttcatttttttctctccctttctccctccattatcccttatgatatgagttacatgggtgcatcttattaaaaagggttcatggtcttataaaatgtgacatcggccgggcacagtggctcacgcctgtaatcccaacactttgggaggccaaggtgggcagatcacgaggtcaggagtttgagaccagcctgtcccaacatggtgaaaccctgtctctactaaaaatgcaaaaattatccgggcatggtggtgcgcacctgtaatcccagctactcaggaggctgaggcagtacaatcgcttgaacccgggaggcagaggttgcagtaaaccgagatcgcaccattgcactccagcctgggtgacagagcgagactccgtctcaaaaaaaaaaaaaaaaagtgacacctcattttcagtttgctgagttatttggagaagttgtactttactaaaaggactcagaatatcagagtgtagcatcctagtggaagacacagtatccttgaaattcagagaaatagggagaatgtgagtcatgatgtgatgtatattcagagaaagagtcaaataactaaacgttcaagtatttccctggcctagttttctttggttcttttacttaatgtccttagccttggccagagagaaaaactctaaatatatttattccacccttgttaaaaatttatgtgcctgattttggtcagattactctaaaatattttcttactataatccaggtatggtatatgtctgcatgatttatgaaatggtctttctatactttattcctcccatgatcctcaaaagatgagctagttggtgagcacgaaggtgagtgtctggcttgagtccagcaaactctctggcttcagccaccaccgaactggaaagagataatgtgctttgccaaaggtggcaaggatggcaagcagaggccctggtgctcctacctctcagctcagatctctctccactgcaccacactggctttcccagaagtaaaggtctcagataaccagcttgagtcatttttatagccatgtagaatggcttgcttctgatgaatttatgtaccctgttgtgcctttacaagatcatctgaagtctagaggaattcatggcgtttgtgcctctgtgctccatgaatgtccgatgggtgccatgtgacattatcagctgtgaggatagaagggtctaaggaaagaaaaaggccaagtagataaatatgaatttcctaaagctgtttccacagtcattttgttatccacttgccctctgacagaaggtgaggggactgagcagtcattggcaaggttgttaatgtcaacagatttgtctgtgtgtgtgtgtgtgtgtgtgtgtgttattttatttatttatttatttatttatttatttatttatttagagacaaagtcttgctttgtcacccaggctggagtgcagtggtgcgatcatagctcactgtagcctcagcctcctgcactcaaggaatactcccacctcagcctctcgagtagctgggaccacagacacatgccaccatacttggctaatttttgtattattattattattattttggtagagacgggttttcaccatattgtccaggctggtcttgaactcccgcgctcaagtgatctgcccatcttggcctcccaaagtgcatgggttacagacgtgatccaccatacctggctgtgtgagtgtgttttcattaaaggcccaagtggcgcctgtgctaagatagctgtcattttgctctttccatcatttgtagtttgctttagtaataatctctcattcttaaactgagttttacaaaacaagaaacaggggatgggatagggaatgtagggagagggtagagagaaggctgtgcagagataaaattgaatttctcatctcctgtagctttttgctaaagtggaacttcagcataaagcctcatatacacaggcaggaagatgagcggacaactgtctgcagggagcaggccgtttgcacagttagcttcctagctgaaaaacacatccctcacttagtgtaaaaaatgacatgtatctcctgtatatttgtctctattttatatttctaatatctaatatatctctattatctattatatttctgtctcatctaatatattctgtatatttctgtctctattactctattatagagtgaaaaacaacatgtgtctcctgtatatttctgtctctattatcaatgttatctggcactttataaaacctttgtgttttttagattctctaaatatctaaaaataaaaaaggctagtaaaagatttttgaatgatagagcagttaaagaatatgggatagtagacctggaaggattttagaaataatttagtccaacttcctcattttgcaactgagaagatggagccccagatgaaagtgacttgttcaaagtcttgcagaaagttagtggggtagtggtgtaattctctaagtgtcgttaatattctttttctgcagaggtccagataagaacaggaacagagtttgttcttcaaaggctcatctttggggcagttgtgttgttgtcaccttggatgtgcctctaatgctgagagccaaggctttgcctccagtgccaggtgctaaggtggttatggctgggttactggtggtacgaggaactggtaataaactaccaaagattgtatggaatgagaggtggtttctttaggatataatattaaaggggtctatccaggcctgcctgacattgtgtcccagagtaaggggtcaaatggaacttcccaccttgtcttcctacccttgcacctgtcccacaccatggtaggttttatatggggacctagcctgtatgcccaggtaatatctacacccttcaaggtagcctgtgctcgactactgcttgggcctagaggtatgcccactgcactgcatccacccttgggagcagtgctctgagaagaggccctggcaggatgcagcctcctggctcttcaggaaggcacttctcgttttggctgcctgaaccagctttgggtggcatgtacctttggcgccccatttacccttcccctcaaggataaggaggatcaggacagagccctctaatgtggcagagagcaaggaaggcgttcttttgcctggatctaaagcaagtattggaagtattactaagagagggtgtggatttaagtatgctctaaggctcttgagataggcctccctaagggacaggatctggagaaaccaagtaaatagttgttagttgctgttagattggggcatgggattctctaaccaaatagatgcccaatgcagctgtcttagtccattttgttactacagactgagtaatttataaagagaggagatttatttcttacacttctggaggcttggaagtccaaggttgaggggcttgcatctggcaaggaccttcttactgcatcatcccatggcaggaagcagaagggcaagagagagagagagggaaagagagagtgagagtgagagcatgtgtgctagagagagcgctggagagagagagacagagagagaaagagagagacagagaaggggaggggaccaaactcacccttttgtcaggaacccactcccccagtaatgatatcaattcattcatgagggcagattcctggtaacctaatcatttcttaaaggtcccgcctctcgacacagttgccttgggaattaagtttccgacacgtgaattctggaggacacattgacattatagcaatagctataggtttttgagaaagatgagcaagatgctctaagcacaatcactctgaatttttggagccatcttctgatcttggcagcatgttggcagtgagaactcatctggcacttgctagaggcaggctcccagatgagaccactggtgccctttgcccaggcctacacctcacttccagacttctagctcttgccattctaagaggcaggaatgagtgaccctccacattgtcttccttcccatgccagcctgtattagtttgctgccataataaagtagcaccacagccacctggcttaaatacagaaattcatcatgtccagaagtccaagaatcagccgggcgcagtggctcatgcctgtaatcccagcactctggaaggctgaggtgggtggatcacttgaggtcaggagtttgagaccagtctggataatatggtgaaaccccatttctactaaaaataccaaaaaaattagctgggtgtgctggcgcaggcctgtaattgagctacttgggaggctgaggcaggagaatcgcttgaacccagaaggtggaggttgcagtgagctgagatcacaccactgcactccagcctgggtgacagagtgagactccatctcagaaaaaacaaaaaaagtccaagaatcaaggtgtcagcagggttgcttccttctggggactgttagggaaggatctgtatctctccttggcttgtagatgatcattttctccctgtgtctttttatatcatcttccctctatgcatgtccccgaatccacatttccccttttataaggacaccagtcatgtcggagtatggttgatcttaactcaaagtacatttgcaacgaccctatttccaactgcagtcacattctgaggtatggaggtcaggacatcaacatacgaattttgtggagaacacaattcaacacgtaatatagcccatgaaaggaaaccctctaacagagataaaccagagagtaagacttctgagagatgcaatttaaaaagaagagaggacatctcatgagttgactccaagtttttaacctctttctctgtcatgcaaagcttcaccccagccatacagtcaagagcagctgcagcctttaatccctgatcctgagggggcagtggtgggaaatggggataaagatggagccgctccccatcctgtggtttgagtgtgcctctagcagaggtgaggatgcttccaccccaccccaccccaccccacttatttcttagaagacaagaatgtgagtattgttcattaatcaaatactgattaggtacacactgtgtaccaaacacttcaagtacttctccaaaaatccttgcccacatgaaattctttttctagtagtaaaaggcagaaataaataacaaacataataaattagtaagttacatgtaggttagtagaaaatgaacatgacctggggattggggtggaagacgagtggatgtgaaatttacagctgtcaatggagtagtcaggccagcctcactgagagggtcagaggtgagcaaagacttgcaggtgggagggggttggcccattatgtgtgctggggcagaaggtcaaggcagtggaccctgcaccagccacagcagatttgaggaactgtcaggaggcctctgtggccagggtggagtaagcaaagaagggagctgtaggagaggaggtaagagacgagatgagagatgggccatataggcccttgcagacttggctcgactcaggtgtgatggagtgagtagtggcattttatttgacatgcttgtgaaggctcaccctggctacatctcaagaacagactgtagaggagtgagggtgaacgcagaagaactgttcagagacgattgcagcatttcagaggagaggtgcccgtggcttggagcagagtggtagaagtagagacagttctttggtcagatcagttatctttagaatagtttctcactcccaagtcattgaaccaaaattgcctggctgtctcctcctgtataaatgtctcattctggcccttgaccaagtcttggcttgtattatctagattagtgactgttattgacttaaattccatttgcccttctaattacggctgaaaagcaatctgtcccccaagattgaatttttattactcatatttttgacatcagtggttgcattctgtttgtgatattgcaagagtattgaagggagccctttttcatttctaatgaatcatttttaaataataattttaaaatcataatccgtaatcatttttaaaaatgatttttaaaaatccataataatcatttttaaaaatcaaagacattctcacataacattttcttagagccaccattcataatacttagctcctaaactatagacaagaatggtaatgttctacacacatttattgtagcagcccacagtctcccagttgggcagattgaaaagaaaccgtcagtctgaagaaaacaaaagagtgccgtgttttctgttggacctgctgctgctgctacatggagtagcaactctttttacctggatcgtgaagcaccagtgtgcggtgccctaataatacctataactcatcataccacaagaaatggaaaattccacatgcatgagtctgctagggctgtcgtaataaactaccatggacagggtggcttagacaacagaaatttattttctcacaattctgaaggctgaatgtctaagatcaaggtgtcagcagggttggtttcttctgaggctcctctccttggcttgcagacagctgtcttctcttttgtcttcagatgatcttccctccacatgtgtctgtctccgcatctcttcttttcttttcttttcttttttttttcaagatacagtctccctctgtcgcccaggctggagtgcagtggcatgatatcggctcactgcaagctctgcctcccgggttcacgccattctcctgcctcagcctcccaagtagctgggactacaggcgcctgccaccacgctcggctaattttttgtatttttagtagagacggggtttcaccgtgttagccaggatggtctccatctcctgaccttgtgatctgcccacctcggcctcccaaagtgctgggattacaggcgtgagccaccgcgcctggccttccacatctctccttataatgataccagtcatattggattggggttcaccctaatgactttattttaaatttattacctattgaaaagccctatctccaaacatcgtcacattcttaggtactggggattcggactccaacctgtgaattttgggggacacaactcaaccggtgacaggcacctttgcatttaattttcttttgccacagccaccccccaggctcatctgctgctgatgtgcgttctgtgcagcacattcatgtcagtagtctcaatttttgtaaggtttcatttgttgagggtgaaatttggtcatatgattggaacaccagtttgtgagtaaagaataatgtgtatttacaaatcatgatattgattatattgtacattgaacaaaattctgaaatagaattccaaaaatttgtctggatgacagttcattttaaataggtacacagcttctgggagcggtagttagtattgttcaatagttaggagagcagatagttagactgcctgggttactgtttaatctcccataattaccagctggttacccctgggaaagttacttaaacctctcttagtctctttgatgaaattttcttgtcttacaatgtagataattagagtttctacttcatagagttataataagaatttaaaatgctcatctacatagagaatttgggagagtgtctggtacatagtaagtgttcaataaatgttggattctattatttccagggcagccactttgaatgaagatactcatttgggtaaattaggtctggtgtgtttctgaaaatgtgttcgctaatttgtttggacaaattgtgtgtttctagggtaaggcataatttcatctgagaggataattcttgtttgttatgaataatatgcaagttttttaaaaagtggggattggtttcactcattaaagtacacggaactcctgcttgtcagcattgaactggtcttattttctggtttttggtttgtagtcctgctcctggaattacggtttggggaccacagtgtgatggcagcagcaacatgtgtgtatgtttgggggactaatgtgacatctttgtaccctaggccagacaccccacttcaataaaagcagattccctgttatctttattatgttttatagtgctgtgtaaactttggtttgagagaattcttctactataaatagcctgaaacccactagcatagtatatagattcctcatatcgtctgctcccccaacaattgcttttattctgtatataccccagggatacaactaatgttaatagtagcctgagcaaaacgtaattgggaaggcaaatctgttgcaaaaaggaatatagcataaattaattataaatcaaattaaatataaaacaatgcatttaattatctgcatcactgcccccttcctctaacatggatatctgagaggagactgattttctttctgggatagggccagatctcagcccagacaagtgaactgtgtcaacccctggaaagatggtgcttgacctccttttttgtgatatgttgggcattagctaaaggcactgctgttttggtcagctaaaatttcagtatcagtaagaggatctactacctatctgaattgttaatgcatgggctagtctttgtgtgtgattgggaacacctacttataatatactattaaatgctcatataggttcaatgatgtgttgaaccatttattaaaaatgtatttgttgaatggactctaacgagcccagcaagggaaagtgcatttctgcccaaggaaggttttcagtttgggcagcaggcattagccacccaaagctggtgctgctgttagaatcagaggaagaaccagtacgggtccatgttggatgccctctgtccttctcaccaccctaagtggtttcatctgccccaatctccatgtctgtgtgacactctgacttatgttctctcaaaagatccaatccctggccagccagagtctagcattctccaggcaggattccaaacattgttttccactgttcccactgagtacacgaatttttgtcagatggcagctcctgaattctgaagagtctggtgtcacatgccccacctctgtcaaacctcacttcttccatttgggctgatctcagctggactggaaaaccctcctctgttgaaagtaggtctaaagtggtaatgactgattagtacggacctgcaccagttcccaggtatttacaattgaaacgagtttgcttatactcagaagtgacaaattggtggatgtgataacatcaaaatatagttcttacagttgaagaacaaacaaacaaaaatcagcaaattggcagcttagctccaatacttggcaacctctggtatgagatttcctgacaccctgcacactttcccttcccctcccaacacataccccagaaaccttgacctttccttttgcaggtcatcatttaatcaagtaatcactcctcttctagcatctgttacattttctggcatttctagcagcagtaagtggttgagggcaggaaccatgtcttcatgctctaagttcctagcttgctgggtgcccagtagatagatatttgaagaatgagtgagttcatgaatgcatgaaagagtggaaaactctagaatggatgttctcactgctgtgagcatccacgtaatccagtcctgttcttccctcccctttctgacctctatcactctgcggggcccatggaccccatgacgggcttacactgctgaagaggcctgtctggttttgtcacattcagactttcttcctccaaatcatctctcatagtgccgcccagttatttttctaaaaaacaaaaacacttctttcatattgctctcttgctagaaaacggaatgatttctcattgcttgagggataaaactcaaaactccttagtctggcatttaatactgactagagcttgcccttgatatttctttaaaaatattttaattgtaaatatttcaaacatatttaaaaatacaacactcatttatccactactaggattaaacaaatagtagaatttaccccatatttactttgattttctttccctgactaaataaatttattttattttattttttggagatggagtcagggtttcaccatgttggccacgctgctcgcgaactcctgacttcaggtgatccaccccccaaggcctcccaaagtgctggaattacaggcgtgagccaccacgcccggcccctaactaactaaataagcaaacattatagatacagataggccccaccccatccttctctctcttttcctaccagaaatagtcatttccctgtttatctttcacaactcacctgtgagaaccatttagtccagttagatttatcttcttgctagaatttcattctcttttttttttccctttgaggcccagttcacttttcacctcttctggtaagctttcccaccaatctcctagttctaaattgctgcacaagttattttctccattgctcaaggcagacaatattctgcctggtgacagcttttatgtagcagttttctcctagtattgattttctattccccttatagtaattttttcctcttgctttatattatagcgaattgcatgcctgtgtttcttctctactaggtaacaaccttcagaataagatctgactcttaattgcattgattcattcattctacaggtattgactgagggcttactaacaagctccaggaattctttaagcactggggatgcaggagtggacacaacagacagtcgctgccttcatggaacttaagttccagtgggagagagagaaattacatgaataaataaatatgtcaagatgaaaagtgctacggagaaaagagaagcaggagaaggctaagggggtgctatctcagacatactttaaatatgtgtctctcctttatgctctatgtcaatgccgaatgcagagggctctgggtacatatttgctgaattgcattgtctacccaaatagatactatttgattccctgctggtgagacactactcagtgtagaccttccttctgggaaggttgttataggaatgcagattttaatcctttgctgccaggagcacaccttggctgttcttcccgttatcagtagatgtacactctgggcatgataaaattgtaatactagctttagtaaggcataataagggaggaaaggtctgtttcctagcaccatatttattccgtagtcaaatggagccaatttggcatcatctttcctcctgcacttcttcgtccatcagaccagtggaaggttcactttttgcagtgttcctaactgtagtggtattgaattgtggttaccaagaagaccaatctcctctttttaattcttccagcctccaggaaagaataaaatccctcaacttgtcacttaaagaaatcactactaaggtaagtacctttatattcccattttccaaagaagcctatgaagttttcgtttgacttgattttacatctagatcttaggatacctggcttctgcaaaaaaagatgtagactttgtcaagccattttgcaggcccaatgatgagttaaaagagccaggagagagtgcttctgtcatagtggaggtcttgacttgtggacaccccagaaatggactggtttggcctttgctacaaaaggagctgtcaatttagggactgaaaaaggactgccactatgcatattgaaagcctttgcttaaagatgcattcggggcttggtgcggtggctcacgcctgtaatcccagcactttgggaggccgaggtgggtggatcacctgaggtcagaagtttgagaccagcctgaccaacattgtgaaaccccgtctctcctgaaaatacaaaaattagctgggtgtggtggagggtgcctgtaatcccagctactcaggaggctgaggtaggagaattgctttaacccaggtggttgaggttgcagtgagccgagattgcaccattgcattccagcctgggagacagagcgagactctatctcaaagaaaaaaaaaatgctttcaggatggtagtaatttgagaaattaattacttttcttcccaggagggcaatgtctggtttcctcacaaatagaacagttggtgactgtttttttgttctttaaagcttttcagttggcttgacaatcattttgcctactttatccatcgtttatactgccatagcaagaccttggtttgtgtacagacagaatacgtcttcactattccctgagagcacagtcaattaaatagtcaatgtcctcattagttaggataaccacagtttacaaaacaaaagcccttctcatatgtatttatacctggccaagttattgacagactgagaaacaggatcaattactctgtgaattatgactaaatgttgtggcagagaactgggtatgaatcattcattatttgcagttggtctgggaacgaggggtggttgtaccatggtcgaaatgtaaaaaggacagcttgctgagcagagagcaacgcagctgagagcctgttggcctggaaggactctcttccggtctctgtgcccagagaaagaaagtcttggaccctagatcaggaaacacgccaagggatcaccgcagctaagccagaatcagggatgtgatgttggcaaaaatgtctggagttactctgtgcattttctccatttctgtatctaatttatttctgaaaacaacacccagtgattttgctaaaggtcacagagccgcaggtttgatgggtaattataacttgtgtacaaagagagcttcctgttaggaacaagtggtgcccgtaagacagcatcggagccagggacccagaaatgcttgacttctgctctgctcacccaaaggttctttcacccaggctggagtgtaatggcatgatcatagctcactcagccttgatctcccgggctcaggtaatcctcctgcctcagcctcccaagtagctgggactacagacacatgctaccttgcccagctaaatttgtttgattttcagtagagaccaggtcttgctaggttgcccaggctggtcttgaacttctgagctcaagcgatcctcctgcctcagtgtgtcaaaattgggattgcaggcaagagccaccgcacctggcctctcttacattttctgctgtttatcaggtgcgtcctgatttctatgtagaattaaaagatgggaggactgtcttgggtctgagtttattgactatcttcagaacatactgtatgggtaatatgaatgcatctgtacaccaacgttgaggatacaggtgtgcctattatataatgcagatggtgcttatatgggtgtgtgtatgacactgtatattgtggatacacacatatactgatacgcacccaatattaggatttgctgaaaatttccaactactattaaagatcttagattttcccaaatatcaaaaatgggttgttttgtttgcatacagtcctactccatttgagttgctataacaaagtactgtagacgaggtggcttataaacaacagaaatttaattcccatcactttgaagcctggaagtctgggattagggttccagcatggctaagttctggtgagaggccctcttacaggctgcagacggttgacttcttgttgtattcctgcatggaagaaagagggcaaggcggggtctctggggcttctttataagggtactaatccccttcatgggggccccaccttcatgacctgatcacctcccaaaggccccacctcctaatgccatcaccttgggagttagactttcaacctatgaattctggggggaaaaaaacatctccaaccattgcacataccttctctaatacatttataaaactttataattacttcgcttttccataaaattaaggaactcacatctttgattttaaaatgtaaacataaaagccccatttgataatgagttccttggtgtccaattttatttgtaaataaaaaggatacacaggttttccggggatgtgtatgtgtgtgtgcagaggtggataggtgtgtgtgcacagacacgaatgtgtgtgtgtgttgtgggcaggggcctatattagtccacagagaattaaaacaaaactgtccagtcacacaaaacagctttctctgtactttaaactagattgaccagtgaccatgagctgagaccaaggtctcagcttgacatagctttctttctctagtgtgttagacacaccacacacacacacacacacacatacacacacacccctacctgatattctttagactcctgtctcagaaagaaatgaaaccttccttgcactcattacatttcttaaactcttatgggttacccaaaccaaaagtaattaagggataaatgagatggaagaaacagttggaaataaatgggatatctggagattggtagatattagattacatccagcagagcctgaaagaatgaacattgcaatttaataagaagattcagaaaggttgtttagtattaatattgacagcttgaaagatagatttgctcaacaaaggagaaactgactcaattatgattaacagatactgttcactaaaatcagaaatattggacatagactggatgagacataagaattatggctggtattacagagttaatggaaatgccctcagacctcagatgacattattaaatagataggatgggatgtgccagtcatctggtttgagccaaactaagacttggtgctgggggaagggatatcttccttttaactctgaaaagtctcaagactgttgaaagggtctcggaattaattactttggacatgcggatgcccaacatcaccagtgcatgctttggtttagaggctaccaaactgtcgtcttcatccagagaatgatttttataaaaaagatgttggaaaattacagccactgaatagaacatatggaagtccatgagagaaagagtggagtattttaggcaggatggatgaggtctgctttgactccaaaaataatctcaattcaaactgatataagaaaacatttaaagttgatggtgtcccacaaaccctagattcttctgggaaattaaatttttctaggtagctcattaatctgagtctagataacattggcatatgaaaagtcttgagactgttgaaagggttcaaaaaaggaaaaaaatgtgatgttttagcctccaacaaaataaaagataacctaaagacatttggaaaaagaaattaagatttaagatttttgctatttttgaaaaaccaaagaaaaaaactgtaggatgtgtttggaatgtcatgggaaaatacatgataaaactctcaaacctcactgagagttacttgtctatttttcaaatctgacttgccagcaagtatctatctgccttcaaagtttccctaaacagtgtctattaatactagtaattaaatttagcttgcagctttgaccttcatctcaatggccatatctttattcactgcgtactatgtgccaggcacagagcaaagtccctgctcacatagagctcgtatcccggcagagagacaatgtggaaacaaaggaatagaattacatggtgtatcatctgagaggaagctgtggaagaacatcaagcggagggagggccaagggaggttgctattttgtgtgggtaatcagtaaggcctttcctcccaggcagcgactgagcagtctggaagggtatgagtgagccaaaccacctgggactacaaaagtgatgcagacaggaggattcggcagaggcctggagaaggcaggaggcaggagtgatgcaattatgttaccttgtggttgctctctgttagctcctatcagttttgtaattggatgtggggtgatgatgggcatatgcttggaatatgccattgctcactttatttttgttcttcttcctacatttccctccctctttcccttctctttccttcccttcctttcccttcccttcccttccccttccctccttcccttcctcccttcctcccttcttcccttcctccctttctccctctcttctttgtctttctttttccattgcttgctttttgaacattgtcttccaattacttttcatcaccccttttaattacttacaaacccagaaatctctgacctggctgttccactgccttctgatttttagctgaataaatgatgattcctggtcatttctctccccctaggtgtgtatgagtgagaaattctgcagcaccctgaggaagaaagttaacgatattgaaacccaactaccagccttgcttgaagccaaaatgcatgccatatcaggtaactggcagtgtaggagacgttgaagctatccaactaaaataatgacagctaccagcacatcgtgttttgtcctcgatgaacattccactgttattatgtcattctcagacatctgaaagcttttctgggaagtttcactaatatgcacataatatagcacaaggtgtttaagtgagtaccgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcccttcctccctttctccctctcttctttgtctttcttcttccattgcttgctttttgaacattgtcttccaattacttttcatcaccccttttaattacttacaaacccagaaatctctgacctggctgttccactgccttctgatttttagctgaataaatgatgattcctggtcatttctctccccctaggtgtgtatgagtgagaaattctgcagcaccctgaggaagaaagttaacgatattgaaacccaactaccagccttgcttgaagccaaaatgcatgccatatcaggtaactggcagtgtaggagacgttgaagctatccaactaaaataatgacagctaccagcgcatcgtgttttgtcctcgatgaacattccactgttattatgtcattctcagacatctgaaagcttttctgggaagtttcactaatatgcacataatatagcacaaggtgtttaagtgagtaccgtatttgggacttctagttcctgtttcttgaagagtttagagactaaatgtactctgtgtgccatatgattctagcagatgtgtatgtagcattgtgtatctgtaaatactgaatgaggattattgggtgtgatcagaccctttctatagagggaaggatggtaacatgagacaaattaatgtcctcagtttgaaaatctagtcatagaaacttggcgaatcctcaaaggattatgctccctcttactctggcagttattaaggaattgatttttccattaattagtagcttgaagtcaagagtctctgaaaacagtatcttatcctatcattagtgctttcaaacactcctctggatttgttattttattttcacaattgctatattaggtagatgggagagagaccgtgatccgaatggactgatggggaggttgaggctgcgggatgtgtcctttggttaaggtcactcaattagctaagcagtggcagatctggggctaaagtccaggccctctctcggtgtattatatatggatttttaacccagttatgtaatgacagcttcaaaaagttctctgagttttataggttgaatggacccagagctcatcagcttcaaaagaatcataaaaatttaacaaaaagttataataattacatgtatgtgttttaaatggtattttaagaaggaatacaataattggcagcttctgctcctcagatcattaaacaactaatgttggcagctaaagagcaatttggtccctggtgcagtcacgcgtattatttacaaccagtagaacatggcagcgcaaatgtggggcttggctcttaacagcttcacatgccatttacttgaaattatgggcccatttgctgagagaaaaaaaaagaagattgaacacagtcttgcttctgagttagggtttttgcctttcttaatcaatatatctttcccaggaataccggtggatgagtctgtattaagcccaagggaagaaatgtataattcaggcagcagagatagcctcactccaatgtgaacaatctctcttcagactccagggaaaatgcccaagatggtatattgcgtatggcgcaggtttcctgttttagctctttggtcagctgagaaaattggtgaggcctgatctgctgaaggatgacctgaattaaccctcctggtaactgaccttttgacctcactattttctggttgctctgtatgctctttggtggaccggcctttcagtcaatgggctgtccccatgggtgatactagtgttaaggtggtcaacatttgtttgcaactcctgcatataatgctatttctgtttcctcctgtttcaataccttcagaatgggcaaaccctcactccattaggtaagattcttaaaagccctattgaatggaaaggatcttggtttttttttttttttgagtcagagtctcgttcagtcgcccaggctagagtgcaatggcgcgatctcggctcactgcaagctctgcctcccgggttcataccattttcctgcctcagcctcccaagtagctgggactacaggcacccgccaccacgcccggctaattttttgtatttttagtagagacggggtttcactgtgttagccaggatggtctcaatctcctgaccttgtgatctgccctgaatggagaggatcttaagggaggtccttaagattcttagggggtcttttgtctctcttcaagtttctatgattcgcttagatttatagactgattgatatggtttggctctgtgtccctacccaaatctcatctcaaattgtaatccccacattcaagggagggacctggtgggaggtgtttggatcatgagggcggtttcccccatgctgttttcgtgatagtgagtgagttatcatgagatctgatggtttaacaagtgtttggtagttcttcctgcattcattcttcttgccaccttgtgaagaaggtgccttgctttccccttgccttccgccatgattgtaagtttcttgaggccttcctagccatggggaactgtgagtcaactaaatctgttttctttaaaaattacccagtctcaggtggtatctttatagtagtgtgagaaaggactaatacatccatcctgactttgatctatggcctgaggtcctttcttaatttgagaactatttgccatttgcagagagtaggaataacaaattagtttcattttcaaacctggccagatctagctcctttacatgtaacagtttattctttaattcatctctcttctcttgcatttcatcacaggcattgacaggaggtcagtgggcacttctgtattctgcctggaaatctccttggatgtctaactacaattattagggactcttttttatattgcctcagttggtaactgagtgacttttttgccactacaaggatctttttttttctagtttctgatatatttttcttacttttttctatccttcacggaggcccatgaggcttctgcctactaccaagtcccaaaaccaatgcctcgattttaggattttgttacaatagtatcccatatccagataccaaaatctattttcattatctactgctgcctaataaaaaataagtcactttaagacgtagtgacttaaaatattaccagttatttattttgcccatggaaatacaatttgggcagggcttggcagggacagctagggtggctcaactggggtgggagaatccacacccaagacggtgcatacatatggtctggctgttgagtgctctctatgtgggcctctctataggcagcttggcttccttacagcatggctgctgggttccaagagcaagtgtcccaagagaaaggaaatggaaatttcttattcttaaggtctgaattcagacactggtatgcatctctattaatgtgtaataagtggctcctcaaacttcatagcttgaaacaacaaacctttatctctcacagtctctgagagacaggagtccagagtgacttagctgggtggctctgactcagggtctcataaggtcgctgttaagacacactttggagctgcagtcgtctaaaggcttggctggggctgaaagatctgcttccaaactcatgcatgtgttgttaacagacggcttcagttccttgccacaagagctgtgccctaggacctcttgcaacatagcagctgatttcctcagagccagtgatctgagggagagagaccaaataagacagaagccacagatgccaggcgcggtggctcacacctataatcccagcactttgggaggccgaggtgggtggatcacgaggtcaggagatcaagaccatcctggctaacatggtgaaaccccgtctctactaaaaatacaaaaaattagctaggcgtcatggcgggcgcctgtagtcccatctactcgggaggcggaggcaggagaatggcatgaaccgggaggcggagcttgcggtgagccgatatcgcgccactacactccagcctgggtgacagagcaagactccgtctcaaaaaaaaaaaaaaaaaaaaaaaaaagccacagtgtcttgttaggacttagccttcaaagtcacacagcatcacttctgcttagtgactagaagcaagtcactaagttcagttcagcccacaggcaaggggaaggaaacaggttttaccccaaaggaggagtattaaagaatttggtgggcatatttttataaccactgcagtgttacttccattgtgttttattggtccagcattcctggtgtgctgattcaagggaagggccactataacaagtctcaatgagaggtgtgtcaaagagtttcagtgccatgctctaaaaagtgccacagtatttattgagacagaaggattttgagaactgaagacctggacagagagcttttcagtcagaggaaatggcctgttccatttatttactgaaaagaaaaatatcatggagcatctaggaagtgtcagatctggttctaggtactgaggatgcagtagagaacaggacaagatcccccttcctttttttttttttttgaggcaaggtgttgctctgttacccaggctggagtgcagaggtaagatcatagttgactgcagccttgaattcctaggctcaagccatccttagccttagcctctggagtcacgggattataggcatgagctcctggctcaatgtctcttcttttttgatagctgtgttctcccattggccacagtggaatggagctagatatgcctgggctgaatatggaggaaaagctcagctatttcttcaggaggaagagtagtctagattggcccaggtataggattagtattgtggtagctcttcagagttggttaggaccaggatacacagagctctgaattgtaggctaaggataagagcattttagggagccattaccatgttttagcggagtagtgacatgattaaaaccagactttaggaagcgtaatccggccatgttgtacacagagggatggatgtggcaacaccttgggagtcatggaattaactaggatgttagaaatgaaaaaaggaagaaaagtaggctagtataggaaatctactacagataggtaattattgatttttggaagaaccatgatgatattaatatatccagttgagtgtggtgtaatacacattaagaaaagtaatttagagagcccattgtttctctcccttttcactgtacacaccttaagtgtgttttagtcacctctttttttccattctctatttctgtttcaattttcctgttcagcagaggatagtttggtttaaagccgatagcaaaagtggattctgttgttgctgtccttcctagacatatcagtccgttctcacactgctgtaaagaaatacctgaggctgggtaatttataaagaaaggaggtttaattggcttatgattctgcaaattgtacaggaagcatggcagcatctgcttggcttctggagaggcctcaggaaacttacaatcatggcggaaggtgaaggggaaaccagcacttcacacggccagagcaggaggaggggggtgggggaggtgccacgcacttttaagtagccggaccttgtgataactcactatggcaacagcatcaccaagagggatggtgctaaatcattaatgagaaactgcccctatgatccaatcaccttccactggtgctaaatcattaatgagaaactgcccctatgatccaatcaccttccactggtgctaaatcattaatgagaaactgcccctatgatccaatcaccttccaccgggccccacctccagcactgaggattacattgcaacatgagacttggatggggacacagatccaaaccatatcactagtgaaggaaagtacagccctgagctctatgcatactgacgtagaggaagaaactcaccagggcagagagatttctcagtttttgagtgcaggggccatacagttagtagagagaaacttgggctttggaatctgagaagtgtgtgttcaagtgcagctttatcatgacttggctggatgatcttgggcaagttgtttaaccttttcaggtcttgtttcttcatctgtaaaatggagctaataataatattgcccatcacattaggttgttgtaagaattaagtgaggtagtaaattagaataatgtggtacatcagtatattaatacatgagataataaatatatgaacgtgacgtggctttccacagagtgaatacatgcttagctagtgattgttagccatgcatctgagttgggggagacccagccagtgggtgactctctgatcaggtgtcactcagtgctacaggttcccggccagtgtacctgtagtaaaagggcagcggtggcatccatacctcttaatccaaggcagctttggcctcagtgcctgtgcagtctcctgactggccaactaggctgggccacttgtcaatggggtggattcgtttttttgtttggttttcagctccgagttcaaaagcctgggagacctgctggcttctctcccagagctgggccacatattgttaacctgggccctggaggtctgatcagtgtcctggctggatccagtgcagtaagagaagccaaggagaagacagtcttccaaggcctgaagcaggtctgacctaactgcccaatgtaggaggtttgccctgggacaaactaaggtcctgcagggttcgagggtgaaaggcctcttctcccaggaggcagccccagacccaccttgctgaactggctgcctggaaaggaagtgagagcgaagatctcaaaaaagagcagctctttaacctctgtgctgctctcactgaacgctcccgccctctgcccaggacttgatggctttggccctggccctggggcagagcgaagggaaagcgtcagtgccctctagggccgagagtgtggcactacagcaagtgtgtggtgggtgcggctgacttgtgctctgtggctactacccatccccatcagaaacctgggcctgtttccttctctggaatggtgctgggactttccaaaccacggacctgtagtgatgagagttggtgtcttgagtccgcgtccaccgtctgcatgccatgcctgccttcccactgctgggggccctcaaccctcctccagttcccgtgtctaagacttagcaacaagcatccttcctgtgtgttggactgcgggtctgcaccattgtgagacacggtcctatattgggccctacctctatcggtgctcgttgacctgactggtatcacagtcctcatctggaacggggccagccaagctctggccactcccttgtcctgggacgaaggctcagcccctgaggcccggcgagtagtcaaggctggctctctgatgcctggctgctctgatgctggcatcctgcatgcacttccagctccagccttgtcctgctcaaattacccctcattattgatctggtccatctgttgagtcaccctccaatttttttcttccactttgtttaatgcctggcactcaaaagacagccagtagaagtatttgtttttcaaaaaatggaccctcattcattggttgctgatccctagaatctgttgttttcatacctccttcacttgttaagattttcatctcctgccctgacttcagtgggtacgtctggttttaagccccggtcctccttctcataggatccatcctctgtcaggtgattggagctggctgatgttccagcttctggatgctggaagccagcagcagcagctgcctgggtgacagcctcactgtgtgttggcaggcttctcactcaccttttttaatcaattggacctgaaaatcttgaagctaaacaaacacagccctgctattttggcacaagatgaaggccagttttaagtggtctataaaagctgtgaaaaaaacttttaaaagagaattatatccagggcacccaagctgcttccagatgccagaggcagccctgcatttaataatatgcttgctggaatccctttaaaatggtagatgttggccatctttttcttttttctttgcattcccaatggaaggacttccaatgtatggccctggtattattccctgtatgttttagagaagctctaaattcctgtagccgtcaaacttgggtttttcactcagactgcatgttaggatcatctggggaaatttaaaaatactggtacccaggcagcaccaaattccttcggtcagaatctctagggatttttcctgaatataggaaccttcataaacagtttccaggtggttttaatgtcctgtgagggctggaaccaccgtaccagtgagaggagagctggcctgccctgctcactgctggcagatggactcttgagtcacatctttgcacacccagaagctccaggcccaccgtgtaccatggctaagtagctgcaactgcaacctggccttggcctggaagcacatcttgtaggatcactgatgttactctcccctggccttccccttgtcctggaagatgtgcctaaggctgagagacttcattgtttaattcatctagctgtctgttctgagagcccccagctaaactgaggttccagtcccagaacagctagcaaaccgccctaaggggaaatgaaggggagatggacatggtatttactgcgtgcctttcataggatgctgcttttacctggtagatggcccaatgcctagttgtctgacctgtgaccaggggctcctcgcctgggaaacttgtttatatgtctttgtggctcttgcctttcctgtgttcagtttatgcccccctgcccattgctctggcgctgggagccaaaccttgtgctctcttgggcatcccaggtaaaacctggcctggggcatcccctggtcttcagatggaaggtgcaaaggcaatatacaccacagtaggaaacaaattcaaaaagtgtaatttacggatcctgggcagggagggcacagagagtcgggagggcagtcctttgtccctgggccactccagataggaatgaagcatcatgcagagagagagaaacaaggcacatggcaactggcagtgtgtatagggagtagggtctgggccactgtaagttttcaggcaaatgtgtgaatggcctgtttaaaggaagcaatggggaagcagggagcccagtctgctagtcaggggagatgtctctaagtttttatctctcgccactggcttgagccattgggtgtggtttccttctaatgcctgggcagctgtgtcattcccgttacagtcaccacatgattctaattgccttagaatttataggaaccagttggcagcccaacaagtgggctcctctggccagtgagggagcctggtgagggaatcttcccaggacaggcagagacatctgcctggttcttagattggccatctttggtctcacctcagtttggatatattttttttttatctcacctgcccccttgttatctgcttccaagaagcaaacagctcaaataattatttattttaaaataacataagaggatgtctctgatactccaaaagccttttttttttgaaaaaaaaaaaaaaaggatggttctatccaatttggcatttcatttatagagaataaaaactatctatacccaaaatgtattcattgcacacaattgtatttgaatggcagctggaaatcttctctcctaactgatgcttttggggaaaataagaacatttggacaataaactagattttctagataaacacaaaatgggtgaatttcacacatccaataatgaaagtagttttttccttaaattagaaacaaggatttaaatttccgtcttcttctgaatgaatatttggcacccaaccaagaaatatatatcattttaaattttcttgaggaaatatccttttcttgcataattaatttaaaggaaattaaattgaccatgtcaattgtcaaacaaggaaaagtaagaattttgcttatttgttattaattttatttacaatagtatttaaaggtaactttgtaaaataacccctaatgatataatctaaaataaaatagattgtatttaaatcacttttttattatataccacgaaaaactactgaatgattaaaacattcttaagtgggttcttaacattgtatggaactggaaagagcagttcagatcacagaggcatgggcactgtgttctaagtggtcactgcactgattcagaacagcaggggctggctctgtactgggtgggtgggtgctcaaggccagacctacacagtgctcctgtgtctgcagctgcagggaagcaggagaaacagtgacgatggtccaggagaggccacctgacatatggcagaaaaacaaaattcagggtacagacagtggctgggagcatcaactcaatcgctttctttctttactattttccctctttctaaaaaagtctgtgatttagatcagtggctgcaggagggagacaagagacccagtaaagatgttttcaaagatgatgcctatctggtgtgaaaagaaatgaagacctacccaaagagaataagcacaagctattatgcagagcttgctacagcaagggagtcagacaccatcatttgcaatttggcagagactcaaaggtgggcagacgagtgggagagctttatagtggaaaaaggcgaaggcttcaggtgtgccctgattggaggttatcaatgcggggaagctggaggcggctcactagaagcgaacatcctgtgtgcttggtcaggggaccatatttggctttctctggtgggtcctaagttggaatcggggacaaaaattagggaagccatcagttattaatccagtcctgaacattttgagtcaattgttacagaagttattatttagcttcctggatagttactagagagcaatttggcttccagcaggtctgatttagagcaggccagcttccggggttgctttttgtgggtaagggtattgttttctgggaaagttgctgcaccttgtggatcagagttccatcttttgctatggcctggctgttgtccgattgtatatttagtcagtcaccaggcaccacattttctcaagctgttggaaagttctgtgtgtccagtgttatcttccccttgtattctatgaaatatatggctgtctgaaatgtttgatgtgcaaagccagccatggggctctgctcacagcaaatgcttttggctatctcaggaagtcatggtgactggaagaaatgcacaaccctgacagaaaatggcaaattctagctgaagggacctccagggagaagggggttggggaggggagcagttggctggggcttcttggccgcctccattgccctttggttcagccagcccaggctcacagcagatatccttgacctcgccaagggaaggctctgaaagacaaaggtagatcttgatcttgcttaactgtgcacttgagcttgcagttccttgaaagatctggtgtcacgcaagacaaattatacagcagtctactatttctggagtttgatcattctcagcactggctttatttctttttttccactaaagaagtatagttcaaatgtggataggtgaaagtagataatcttaggaggatcgttacaaactgaaatgtccatgagttcaggaaagtgccatgtgtgtgaggggtaccccaggtgagaggcctgaggattgggcaggtgaaagggaccatgtgggcacaggattcatccccctcaccatgtgctttctcactttagtgatgatttctacccaggtgttgactaagtcacttattgacatgagatcagaagaaacaagttcaagttcagcaatctcgcatgggatcttagaactctgaaactctgtgaccttcacaaggttacctctgggtctagattttttaactggaaatcaaggacaatcattaagagactccccttcctggattgttgggaagattaaatgatacaatccaagtaatgagagcattgtagtctctaaaattggattctcaaataatgacctcaggtgaaggaagaactgttcaaaatgccccaggtgctatgaagtacagagggcaggtattttttttaagggatggggtcttgctctgttgctcaggctacagtgcagtggtatgatcatgactcactgccacctcaagctcctgggctcaagtgatcttctcacctcagcctcccaagtagctaggactaaaggtgcataccaccatgcctggctaattttttaatttttttgtagagatgggggtcttgctatgttgcccaggctggtctccaactcctcaagcaaccttcccatcttggcttgccaaagtgctgggcttacaggtatgagccaccacacctggctgatatttgaattcagagatgctgaggataagtaatgttggaacagagtgggtaaagtcagcttcagcataaattgtgtttatttaatttaaacacaatttaaattttgtgttttggctatctcaggaagtcatggtgactggaagaaatgcacaaccctgacagaaaatggcaaattctagctgaattttaaattgtgttatttgcggaataaaatatgtggacaagtgctttaaaaaacctatgagaatacccaggtttcattcccttgttgaagagcaggcgggcacaggcatattgggatgccataggtggcatattcttctccacacacatcctccttggcatttagaaagggcctgtgaaagttatgaagattcaggtcacagatctctgatgggactttcttcaggtatcagcattgactttccaaattttcatcactgagctcctgaccaatttcagcagtcagagaggtctgcatcaagcaaggtcttggtctaagcctcatgggattagatctgaggtcaaaatgcctataaagtattaatcaagggcattgtagcattttctcatggcttgggtcttgatatgaatggtctctttgggaattcacactcactctgctcttttaaaatgttcacttttatcactgtgcattttcccaagccttatccctcaggatcaaagaaagggcctaggctttaattaatgatctctcctgtgttttaccaagggcactggtctctcgagcttgcagtgggttgcaagggattagagggtgtatttgcagcaaaacttctgtaccggcactcgctctgtatatatagtctcttccaatttgcttttagagatcttttctttctgactgtttgcaggaggacatggcacgctgtggcatattctgcctgatgtctctggaggcatagttggtgcccatcccactttttattaactctcttggttgaaaacacagcccagaagacatgttgggacttcataagcacagcctaaggaggaacattggaaggtacaacattgtacatgtggccaccctgccccaacgcagtcacacctctgtgctggtcctcctgcgagctccccagagcatggggtcccttgaggttctttgtggcatgcggtagggggctcgatcctcagcttccttgacttggccattgttcaggatggaaattaccgatccgggaaaagttttatttgaggttactgtttacagcttgaagctcatggaagtgcagtctgctctcctgtggactttgtgggtttttcctaaatgggtccaacccatcagcttggcatttggggcactattgttttgaagcaacttccttgtgagtttagtctcacctcctaccccttgcccattgctctctaacctgggttcctgtttcttcttttgggactcttatattcttccctcctgaaatctgcctcagtctctccttctggaataatctctcttctcctctgacctctcctagtatttggtttttctttggaaggcaccttatcccctttattttatggtaacttcctggagagcaggagcagtacttgttctcttttgtgcttgtcatgttgcttaaaacacatgagtgttttaagcagtgagagacaaacacatgagtctcaatagggtctttatccaatcatggcattggaaactatggacttcagtgacagatgttatgtgctaggtttcagaatgcctttaaggtgggaaaacattttgtatcattttcaacatttgtatcagtttgaaatctgcctgctaagtaacaataaaaaagttagcaacataatttatgtttaaaaggaagtgttctggggtgatgttcgagttggaaacttgccctatgctttactgcattgtgatcttcagcaagatattttagttctccagatttccgctttcccagctgtaaaaggagacaacaatatgaatttcagtgaacataaaaagcacccattattttatacattgcaaagaaagaaaaattgctgtcaattaagcagtaacagtgctttctatggtttagaatttttatcttatacttaactgatatagctcttttagatgtatttaggcttttgaaaaatcacatatcactcattaaaaaggaaaataaattggttaaggttttccttggcatcttcttcttcattctgagtcttccgaaacacatttggactcaatgttgtcgaggtttgtgtttccccacacgtcatcatcctgtgaaccattgaagttgatgggaggcaactttttctcccccaagaataaagagttttctgtaggattgtctgccaaactgctaacacctttcttcaagttttgaatgctggtgctttcccagtcttacaaatccacatcaacacaagattttcaggcaacagccagtacgcagatggtcctaaaatagtttgtacattgaaacaccagggggttgcagatggtcagccaggccagggaaaataatccagttataaccactgcatcctgaccacttcctggctgatggtgattgtaggacacatccctgtttcagagatgttaaaatgtaaaataataataataataataataataataataataataatataagatataacctgtttcctaaagttgtgatgacatttaaaggtgagaaagtttgtagctattattgtgattatggttactataaattctgagaaaacacagtggggttttctaattaacactaactaatttatgggacactcattaatgttatatatttatttattgttcaatgttcatgcttaaaaatttcttaatttttcctctttttaattgaggtatggtttatattcagtggaatgcacaggtcttaagtgtttacagttcttgaattttgacacctgtgttacgaacagccctaccaagagatagaacagtctcatcactcaagaaacaacaccctatcttgtcccagtcatcatcgtccctcctctgttctgatatcttctaccatggattaattttggctgttctagaacttaatggaatcatgtggcactactcttttgcatcttttctaaagacatgtacatgttggctgggcgcggtggctcacgcctgtaatcccagcactttggaaggctgaggtgggtggatcacgaggtcaggagtttgagaacagtctggccaacatggtgaaaccccggctctactaaaaaatacaaaaattaactgggcgtggtggtgggcacttgtaatcctagctacttgggaggctgaggcaggagaatagtttcaaactggaaggtggaggttgcagtgagctgagatcgtaccactgcactccagcctgggcaacaagaacaaaactctgtctcaaaaaaaaaaaaaaagaaagaaagaaaaagacacatacatgttgctgcatgtatgacgagtttgtttctttttattgctgagtagtctttcattgcatagctatagtattatttttgcatcttcctgctgatggatatttaggttgcttccagtatggggctggctctcaggcataagacactgtgaccatttatttgagtgcaaatatttttgatgacatgttttcatttcttttgtgtaaatgcctggaagtagaattgttggattaaagggtaggtatacattgaactttatgagaaactggcagaacttttcttgaagggaccattttacatgcgtgagagttccagttgctccatacccttgtgaatgttgacatttttagttgagttaatttgaaacatttgagtgggcttgtagtggaatatttatggttttaatttttcttttcttaatgattaatgatgtcaaatgttttttcatatgcttattagccatttgtgcgtctactttgtaaaatgcctgttaagtcatttgaccatttttcaatggcaccatttgtgttttaattgtcaagttgtagtattcaattccttgtcagttaaacataatgcaatgattttctccaagtctgtgacttgtcgtctcattttttagttgtgtcttttgatgagaagtttttaattttgataaagcccatttatcctttttaaaatagtgttttctgtatcttatctgaagttcttgcctactccaaagtcaatcaaatattcattttttttttgtagaagctttatagttttaacttttacatgtaggcctgtgatccacctttaattaaatttttgtgtggtttgaggtatgaatcaaggttaatattttttccatgtagatagctagttgttccagcaccatttattgaaaatactttcttttcctcattgacttgctttggcactttggttggctgtatatgtgttaatccactcctggactgtttattctattccatcgatctgtttgtctatgtatattcaatgccatattaccttgatttatagtggctttagcattagtcttgaaaccaagactcactttttaaggattgctttggtcatcctcctcctcctcttccttcttcttctttcttcctattcttcttcattcttcttcgtcttctccttccttccctccctccctctttcacctcctcctcctccttcttcttctttctccctctccttctttgaggtggggacttgctatgttgcccagacaagagtgtagtgcctgttcaaaagtgcaatcatagtgcactacagcctcaaactcatgggctcattcttctagattttatttgtttagatatgaagtctcactctgttgctcaagctggagtgcagtggcaggatctcagctcgctgcaacctacacctcctgggtttaagtgattctcctgcctcagcctcttgagtagctgggattacaggtgcttaccactgtgccagattaatttttatatttttagtagagatagggtttcgccatgttggccaggctggtcttgaacacctgacctcaagggacccaccacctcggcctcccaaaatgctgggattacaggtgtgagccaccatgcccagctcactcttagacgttttagaataagcacataaatttctacaaaagaacctcataacattttgattggaattatattaaatcaatgaatcaatgtggggaaaattgaaatcttaccaatattgaacttccagtgtatgtatacagtgtatcttttaaattatttgtctttaatttgtctcagcagtttttgaaaaatagttttcactgtagagctcttgcacatatttaaagaaagtatccctcagtattatgagatttaaaatattttgtaaattgtattttttaaaaaatcatcttctagttttttgttatttagacataagattgatgtttgtacattgaccttgtatcctgcaatcttgctacatttaatttatcatatatttttctcagtgctttacagaatttcttgtttattcttgtaactacctatgagtcaggtgttattgcaattatattttataagaaatttgccccagatgtgctaattttcttgctccaggtcacacaatttgagtaacaggggaggaatttaatttaggtcaactctgattatatggcccagtccccttccacactgctataatatgtcatctctttgacatttgtatattattggaatggagtgacacattgtggtttctctggattccactgggacatttttgggtcatcatactttacgggagatggcttcaccaatggaactcctaaaatggacataacaagaataaggtgataaaaaagacggtgatttttccagtttaaggagagcaatatttttccaggttctttccccagaggactgctaaggaaattgtacataatctcaaagtgcagtttctttgcccatgctgtgaatgtacattagctgctgctagatcttccatgtgtgtggatgctgtaaagcttgttttcccttcttctctcccacaacgtgctgtaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaactgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatattttacaaagtatgcttatttaagaagaaataagaaaaaacggggctgataggaaccagatttgaaatagggcttttgtaaatactccgtaaattgaagtaaatgaagagtagtatttataagctagattgagaaatataaaatcagctagctgaagttaagtgcatcaatttgggatgaataaattttcttttaaaatgtctatcaatttgtgtagagagaggtttcttcatagagatattagaatcaaagagtatgttcagtagttattctgtcttctttgtaatgaatacccttaagttggcttaacagctcagtacttatctttttttcttttcattcttaaaggtcaagccttgtttttgccgtatatgtaactagagacagtacgtttgaggctaaataactgtagtactagggaatgacaacacgctcacccaagacaccgcagcctggtttactctgtcatgataggaatgaggattgtacatttgaaataggtttctgctattgattttttaaatgtataaacgatggaaactacggaatttctcatgttttcaccacatagttttttgtcataaaatgaagaatatattatatccaagaatgaagaggaagtgaacaaatttgagcaaatttagtccagcaatattttcatttgaatagttgagcccctgaaagccattaatatctctttttaaaaaaagaaccatgcagtatttttgaatctcatcatcgtcacttcactaagtattttcacaatgatgaataaaacataaacaaatggaatgagagattgttaccatggatgattctaaattgcagatggctcattactgttgtgaagcctctctttatgtttttacacttggattttgctggatcagccaccctttccctatacattgatttacacgtgcttaattttttttaaccaatttgaggtgagttggctttaggtgaaccaaattaataatctagggttgagagtgtgggaaacaaataaataatgaattcctgaatacattgaagcttttatttattaaaatgtgataaaactggggcaaagtccatattcagctttttttgtgttttgtgggttaaaaattcagagggagctctgtgttcaagtttaaatgtagagaaagtacaaaggagagtgtacttatgcacatacacatatgcatgcatgtaccatgactctttttagccttagagaatgaaaccatttaagaaatgagcaatatgtagtattcttaaaaaaagattttgatttccaacaatagttgtggaatgcagcgttcaggggaaaaaggcaactcatggatgatcaagccaccctgcttgtcaggaacccagactcttctatcttgttcttctctgccccacaacatgtgccattcagtccaacctggctgacccagccacatgcatgtccaagtccagtcagaaaaaaaacaaagaaggaagagagctcatctatcccctttaagtacgcttttagaaatctgcacacatctctgctacggccacatccctgtgaccttaaccttgttatatggtaacagctacttgcaagaggggctgggagctgtccttaccctgggcagcaatgtgccccactaaagtgatgaattctgtttccatagcaaaaggggagatttgcagtcttagggaacaattagcagtgtctctcgtacagagaccttttaatgatgtgaagtgtatctctaatgatgcacctgagatgaatttgctgcatgcatcacttaaaatatcattgtatcttgtgtctctggctagattgtgagtccaccgaggtcagaacattgttcttaggtttcactgtactgctttggtgtccagcatgatgtcttttaaaatagtaaatatactataccatcaatatttgttcatttactggggccagatgttaaaatgacacatgaatgagtcctctcttcctgcattttagattgcagatctggaccttgaatcttctgcttctttattcattttccaaattaatgagggtagtgataagtttgtctttcttggaaggtgcttgagttgtctgagttggatattcagtttggagtgtcagtaatagaacaatacggtgatagaaaaggaactgaaatatgccaaggtactcaagggcaaagggagacagacctcatcaccgaatccattggcttttgttgccaagacacaatctctataaagagatgataaagaagtgtgctttaactcctgtcagctgttcttgagacttcaggataacacatttgaattcggagcaatgttaagtgcagtgaaatagaaggaaaagctaaatctatcttccaagccttgaatatttatggaaattaactataaacatttaattattgtggattccaatgtgtgtgtttatttaaagaagggtggaatgaaaaaaatcagcaacttttacagtttgctacatctgcttttttttttttttttgagacagagttttgctcttgtcacccaggctggagtgtaatggtgcgatctctgctcactgcaacctccgtctcccaggttcaagcgattctcctgcctcagcctcccaggtagctgggattataggccagctaatttttatatttttttagtagtgacggggtttcaccatgttggccaggctggtctcaaactcctgacctcaggtgatccacctgcttaggcctcccaaagtgctggaattacaagcgtgagccaccgcgcccggcctacaactgcttttcaagttaaaaggacagccctcagatttacgcagcagtttttcaccatcccttgtgtataaattggtaatctgtattgtactttattaatattgttgatttcgcactgtaactcagctataaaggaaaccgacgtcaaggggagagatttaatcacagaataatcaggactagaattttaaataggacatcattagcatgttaatgaattttcccaccttatgccagctgcctgagtagaaaagatactgcagatgtagctcaaaaatctggctggttccctggcccagtgagctgtcaggaatctgtgtagggtgatccataagctaagtgaagggattctaagtgagaataccaagcagcaagattttgtttttctgagaacgatggctaactgtgcccagcctaaactcatttgtctttcggtgagtaagaggggaatgggaggcagagaaggggcagttgaagggcaatgaggttggagtagaggcacctttccaattatggtttgggattaggaccttttgctttagatagaaaagttgtaagttcgcaatgacaagatcctgccctaattcttggcacagtctcacaatttttgagcttgaaatagctaatgaaaggaagcatgagtgtcttagtccatctgcgttgctatagaggaatacctgaggctgggtcatttataaagaaaagggaattctttggctcacagttttgcaggctgtctaagaagcatagtgccaacatctgcttctggtgagggcctcaggctgcttccactcatggcagaagatgaaggggagctggcctaggcagatcactggtgagagaggaagcaaaaagagagagaagggacatgacacactctttttaacaaccagctctcccagaaactaatagagtgagaactcactcattgatgaccaagctattcttgagggatctgcccccagacccagacacctcccattaggctctaccttcaacattgggggtcaaatttcaacataaggtttggaggtcaaagaaaagaaactatagcagtgacagattatactgagatatcggtttaactctgaagttcccagatgcagctacttgcagaatttcacttcacacctattaagaaaagtcttttagtttagaaatcctgtgagttacaagttctgcatatataggcagtaattcttttttccatatatgtcagatatatgtagaagaaactgatgaaaaagtagaacaaaagaataaaatctatgggtctcttttattggcagggagagggaggaaatggagagccgggacaatacatacaacaaagataaaaacaataaaattagcaaacaacaataaaatttaaaaacaaagacagaagaaaatgccaatgtcaagtgttaattatttggttgagaatatgatgtgataatgaacttcctagaagtcacagcaaagaagacagttgaagcatcatccttcttcctcaaaagcaccttgaaaagcacagagctttttgggaattcagagtgatgctaaattcttcaagacacttctcttgaaagcatagtggaaagtcctcctgaacagatttataacacatgcagaaagctcttttacttgtattattattttttacaactttttattttaggttcaggaatacatgtgcaggttctttatataggtaaattgcatgtcatcggggtttggtgtccagaatattttatcacccaggtgataagcatgttatccgatggttgtgaccaactacctctaggaaaaaaacatgttggggatcccttcaaagcaggagggactgtgcacaggagagactgaaaccacatacacattttagatatgtaggtatggacagtttttcccacaaaaagatccagtttttcagcagatttttaaaggggtcattctaagagtcctcaaattttaagaaacattaagatattaaactgtcgaggtgaattagggcttgggctagtgaagtttaaatacggcatcttccaatttctgacattatttcaagatgtaacttagcacctaaaaagtggctggagaacatatcctgtacactcaccaaatgtcacttctttcctctgagctttggctacgacctatgtataagaaaacttagctctccgggccagaacggtgatagtgctcttgataacagagggccaagccgtctgctttggaaccagatgagtgttgcggtgctatgtggcaagaaatgtagatgtttatatgggaaatagatatgtgtctgcctttccaaattcgaaatctttggtcatttagatttaaaaaaatatgtcaaataggatcttttggaagaaataaaaaaaattcaaaatcttttccctcaggtttttctgataggctgaagttttaaatctctaatcatttatctttgatttgccttattgattacattatcactttatcaggaccctgactaaatctgtttgtgtttttaatttctctccattttttcctttccagttacatccttgcatcactattagtgtgattatttcccttcagccatttttgcctgtgaatttctaagcttgaaatttgcagctaactttctccctcctttattaagtcgctgtgataattcttttgggaggcatcgccatacagtggaaaaagcctggattaggatgtagggggtgtcagtttaatctcagtcctgcccttccctaatcatctgcatagcacctgatatatatagcatcagaatgtgaggctcaatgagtgaatagtcttcagcaactcactgaattttatctgagtctcagttgcttcatatgtaatactgtagaaccagatcttgaagttgcatttctatccatccatccatccatccatccatccatccatccatccacccatccatccatcctttccacaagcatttattgagtacttacgatatgctaggcgctgtggcaggccctcatggtccagagatgaattagatagtccctgtggctactgaggtcccttttaactctagccccttgtatgtgaatttccacaattcaatttatactttgttcatttattttcttgctctcagctacttttgatctccttttcccacttttatccatatatatttttaaaagtccctactattgttacatcttttttcacttgtctctctacttgtttctatactcccttaaaatacgtaagtcacttaccccctgggtggaaatacaatgatgttttcaattatatttcataccaaattgcaacaggcagttttttttaacatgctaattcatttagagcagaaacttgactctatgtaatagggtgggtacatgtgtctcttaaatatctgccagattttctgctttgtagattattcttactaatcagtgcgtattagagtctctttgtacatttcatatggactctgggctttgataatgttggtagacacatgtactcacacacgctcatataatgtcctgaagattaagctaagagtgatggtaagtggaacttcatgatcttaaagaagagcctgtttgccatgttttgggtgaggggattattttttgcatggggaccctatcatgtattgcagaacatttcacatccctggtcattgcctgcatccaactcttcttcccacccccatttttcaatgcccccaggtaggagtggtaccaccctcagttaactgcataacttcagcctaatgctttatgttttagtatcattcctatgatttgaaaatatgttgtcatgatcattagaacttgcctggaattaataaaaccaaattctattattcacattatctttcatatagatccttagaggtttaaatataagttctttgcagatttcttcctccattgctctttactgtgtatattcagtatgtatttcttgggcacagatttctgtatgcacagatgagctacagctattgtggatttaatgttttctttgaagaaaaggaatgatcccttgtacgaagtcaccctctttttagtaacaaagacttatctctttctttttgtttctcaagcacttgagaactaagcactgtgctaagacttgacatactttagtcatctcatcctctggaccactgtggtactggctccactggaatctctgttttaccgatgaagaagctgaggtttaggaaggatcctgtcacagagccttcagggggcaaggccaccatctgaatccctcttacctgccattttacctttgacgttgctttatgttctttatgaatttgattcctaacgtcagtctctctatccatcccgcaacctcatcaccctacctaaataccacactcatagattcataattacaaaacaaaagtctacaaaaagtcatctattgatgatgttgaacatcctgaaaagacgggtatttttttttcatttttgaagttttcaagcaccctccctatattttgtgcctgagatgatgatccactatctgccatgttgctatagcagatggataatttaactcagtagtaggaggttctataggttatcaccctatgaaactcatatcttttgtattaaaacctcaattctttattttcgaagggtgactaggagaaacttggcatactaccataaatcagagagaagttgaactatagcaatttaattggatacatattcattgacttcaaaccagttttttgtatattttcaaataactgttgctagttctgcttcctgttctaaaatgctgaaatggcaatcttttcctttgtattcctataagtaaatgcattggttattagattgatacattactcagttcctggtaaagaagtagttagaagccctgtttgcttttaagaatttactaatttgtcatccttttgattacaaggaattcaatttgcaacatgtgatgtcaatctttctaggcttcttttgagtgagttttgaactttagttaaataaaacaactttttttttttgagacagagtctcagtctattgccaaggctggagtgcagtggcacgatcttggctcactgcaacctccacctcccgggttcaggcaattctttgcctcagcctcccgaatagctgggattacaggcgcccgccaccatgcctggctaatttttgtatttttagtagagacggggtttcaccatcctggccaggctggtcttgaactcctgacctcatgatccacctgcctcggccccctaaagggctgggattacaggcatgagccactgcgcccagcataaataaaaaaaatttaaactattatataatttaggattttcaggaatgaaggttgattctttataaaccaaatttgattttgtgaggttttgcagaatttaattttacttggctaaatatgactcattatatggtcacagttttttcagtgattaatttggtaagaaatattttgttttccttcttggcattatcatgagttatggcttcctgtacacattcctgccattttagctgtgtactttttctttgaagctgccatatgttaacaacccaagagagatggtatttactggagagatcatcacttgttgctaatttgatttttcagattctctgagctcttataaaagagagagagcatgctgatgaatgttttcctgccctgactgctttgaggagctagtgtttgctgccctgggcccttagtcctgttatgttttggacttggggatggccactgtgtctaatccactttccattgaggcttttctgtaactggggagggctggatcactgtaggggtggacaaccctgagtgaatgcactgcaatttaatatttatggccggtacagaaaccatcaagaattgcttaaggatttactgacttggcatcatcaaaaatttatgaggcaggtatgctcatattccacaagcctgcatagtcatagaatgtcgttttatttttcttttgacattatgctttctggagtcttaataactcattaacaactgatgacacactttgctttttggtttaattataaccaaattttatttgccaaaatgatgtttaatttttggtgtattaacccattatgaatatctctcttttcctatgtttactatgactgctttacatttccagtctccccaaatctgatattttccttccccaagaaagaaccaaatacaattatattacgattgcatggtctgtctggtttggacagggtgactgaaatcttgggcttctttttaactctgaattggatccagcattctactttgcttcgtatgtaccaatcttgttgggtgagacatatacattggaatttggcaagtgtttgtatacccttcacccaactccactgttttcagagactgagtaacagtagtggctggatgccaacttcatgtctgccctgagaaggtcaccaaacacggacattcccccgtggtctggaatcctgcaaatctgtcagcctttggaagtgaagtgattctcccctaaagattatagagaaattctctgaagtcaaagctgatgaaatgtctggagttactctaggataaaattttaatttatttcaaaaaatacctttagcataaaataaaatttttgaaatgaatgaaaaatgtttatcatgcaacttctataacagagcccctggttgcatttttttgcattatcttctgtgcttgcagtacaggaaagctttttacacacttgtactgagaaagaggatgcaattttacatcctctgtctgtccttaaccttataggacaatagtgagagcatggcaccagttaatcctcgtaactgtagtttgagacaaatttatcattcccaatctaccaatgtgtgaaactgaggctcagtgaattaacagagtggctcaagtttctgtatatgggaagtaaagaactggaatgagactcatctgtctcacttcagagccatactcttcattatacacttctgtgtccctggttgcattataatattccaatttattattttttatgtacataacagtccaaggatcaatatactgtgacttacttaactacctccttattctgaggtgtttaatgattatttcatgaattttttctgaagataaagtgccaagattgggattaatgacccaaagaatgcagtcatttttatggcttcatacatactgcagattgatttgcaggttatagcaatttaattgatactaccaatccatcctttctaataataagcattattttttaaaagattattagtataataacagagtggtatttaattcatgccttgtttttgcatatctttgactaatacattcaacttgtttttttgtgcctttataagttttttttgagacagggtctcactctgtcacctaggctggagtgcagtggcattatctcggctcactgcaacctccacctcctgggctcaagcaatcctcccatctcagtcttccgagtagctggaagtacaggcatgtgccaccatggcctggcttggtagagacgggattatgccatgttgcctagagtggtctcgaactcctgggctcaagtgatccacctgccttggcttccaaaagtgttgggattacagagtgagccaccatgcccggcctactttttttcattgtgtgtttcactcacgtccgtgtgaagagacaccaaacaggctttgtgtgagcaacgaggctgtttatttcacctgggtgcaggcaggctgagtctgaaaagagagtcagcgaagggagataggggtggggctgttttataagatttgggtaggtaaaggaaaattacagtcaaaggggggttgttctctggcgggcaggagtgggggggtcacaaggtgctcagtgggggagcttttgagccaggatgagccaggagaaggaatttcaccagataatgtcatctgttaaggcaggaacaggccattttcacttcttttgtggtggaatgtcatcagttaaggcaggaactggccatctggatgtgtacgtgcaggtcacaggggatatgatagtttagcttgggctcagaggcctgacattcctgtcttcttatattaataagaaaaataaaatgaaatggtggtaaagtgttgggatggtgaaaagttttggaggtggtatggagagataatgggtgatgtttctcagggctgcttcgagcgggattagggcggcatgggaacctagagtgggagatattaagctgaaggaagattttgtggtaaagggtgatattgtgcggttgttagaagaaacatttgtcatttagaattattggtgatggcctggatatggttttgtatgaattgaaaaactaaatggaataagagaaggagaaaaacaggtattaaaggtctaagaattgggaggacctaggacatctaattagagagtgcctaaggagattcagcatagtcctgccagcaaagattatttatttacttcaaaagttaagagcggcagtttggggatagcaccaggagatatcagctgtgatggcttggaaaaacagtgtaaaccggcagcgtaaacaagagcagggcatgtatgagtagttgagaatggtgaataggagtataactagacagaagatagtagggatgacaagttttttggggcacagtccaagttggtctggtgtctggaatgagactggggcctaataaaaaggagcgtccatacaggagctcaaatgggctgtaccctgtagcattccgaggacaggcctgaattctgagaagggaaagtggtaaaagtattgtccagtcctttttaagttggtggctgagcttggtgaggtgtgtttttaaaagaccattagtctgttctacctttcctgaagacggaggaccgtaagggatataaaggtttcactgaatactaagagcctgaaaaactgcttggctgatttgactaataaaggctcgtctgttatcagactgtattgaggtgggaaggctaaactgaggaattatgtctgacagaagggaagaaatgactgcagtggccttctcggaccctgtaggaaaggcctctacccatccagtgaaatggctacccaggctaagaggtattttaattttctgacttggggcatgtgagtaaagtcaatttgccagtcctgggcaggggcaaatccccgggcttgatgtgtagggaagggaggaggcctgaacaatccccaaggggtagtagaatagcagatggaacactgagaagtgatttcctggaggatagatttccaggatggaaaggaaatgagagattctaagagacagggtagcagcttgtaacctatgtggaagaggttatgaaatgacaacagaatagaatgggactgtgaggctgcaaggagatattttccttggtctaagaaccatttgccttgtgtgggaagagactgataggtggaagtttcagcaggggagtaggtgggaatgactgatgtgaaggagaaaaactggccgtgagggacagaagttggagagctagctgcttgtctagccaccttatcagcataagcgttgcctagagcaatgggatctgacgccttttgatggcctttgcagtgaatgactccagcttcctttggaagtaaagccgccttgagcagagtttttattaagaggcattaatgatggaggacccttgcgtagtgaggaaacctctttcagcccatgtgaccacatggtggtgtatgatatggaaggcatatttagagtcagtataaatattgacgtgtcgtccttttgcaagagtgagggcttgagttaaggcaactagttcggctttctgagaggtagtgggggggggtgggcagagtggtagccttgatgatagatgtggaagctactatagcatagcctgcctttgctggtgagtggcgattaggcctggtggaactgccatcaataaaccaaatgtgatcagggtgaggaacaggaaagaaggaaatatggggaaatggggtgaatgttaggtggatcagagagatacagtcatgagggtcaggtgtggtatccagaataatgtgggaggctggattgaagtccatgccaggaacagtggtaattgtgggacactcaacaaagagtgagcacagctgaaggagccagggagcagaaagtatatgcctcaggtgtgaggaagaaaatagattttggaagttatgagaactgtagagagtgagttgagcatagtttgtgattttgagggcctctaaaagtattaaagcagcggcagccgctgcacgcagacatgagggctaggctaaaacagtaaggtcaagttgtttggacagaaaggctacagggtgcggtcctggctcttgtgtaagaattctgacctcactaaccatgcctaggaaggaaaggagttgttgttttgtaagggattgaggtttgggagattagtcagacatgatcagcagggagagcatgtgtgtttttatgagaattatgccgagataggtaacagatgaggatgaaatttggacttgactgaagtaatgggggctgtctgtgaagccctgtggcagtacagcccaggtaatttgctgagcctaatgggtgtcagggtcagtctaagtgaaagcgaagagaggctgggatgaagggtgcaaagggatagtaaagaaagcatgtttgagatccagaacagaataatgggctgtggagggaggtattgaggataggagagtatatgggtttggcaccacagggtggataggcaaaacaatttcattgataaggcgcagatcctgaactaacctgtaaggcttgtctggttctaggacaggtaaaatgggggaattataaggagagtttataggctttaaaaggccatgctgtaacaggtgagtgataacaggctttaatcattttaaagagtgctgtgggatgggatattggcattgagcggggtaagggtgattaggttttaatgagatggtaaggggtgcatgatcggtcaccaaggagggagtagaggtatcttatacttgtgggttaaggtggggggatacaagaggaggatgcaaaggaggctttggattgggaagaagggcggcaatgagattcagctgtagtccaggaatagtcagggaagcagataatttagttaaagtgtctcagcctaataagggaactggacaggtggggacaattaaaaaggagtgcttaaaagagtattgtcaaagttggcaccagagttggggagttttaagaggtttagaagcctggccgtcaatatctacaacagttatggaggcaagggaaacaggcccttgaaaagaaggtaatgtggagtgggtagcctccatattgattaagaaggggaaggacttaccctccactgtgagagttacccaaatctcggcatccatgatggtctagggggcttccaaggcgatttggcagtgtcagtcttcagctgctaagctgagaagatctgggaaggagtcagtcagagagccttgggccagagttccaggggctctgggagtggctgccaggtgagttgaacagtccgattttcagtggagtcccgcacagatgagacgcggcttaggaggaatcctgggctgcgggcattccttggcctggtggccagatttctggcacttgtagcaagctcctgggggaggcaggcctggaggaactcctggtcactgcggtttaggcatttggaagttcttgtgtgctggagatgtggctggggtttgtctcacagtggaggcaaggaattgcaactcagaaatatgttgctacttggctgcctctactctattattgtacaccttgaaggcaaggttaattaagtcctgttgtggggtttgagggctggaatttaatttttggagttttatttaatgtcgggagcagattgggtaataaaatgtatattgagaataagacggccttttgaccttttagggtccagggctgtaaagtgtctcagggttgctgccaaacgagccatgaactgggctgggtttttatagttgctgaaaaagagcctaaacactatctgatttgggataaagaaaaaggagcattaaccttgactatgcctttagctccagccacctttttaagaggaaattgctgggcaggtgggggagggctagtcatggaacgaaactgtaagccagaccgggtgtaaggaggagaggtgataaaaggattatagggtggaggagtggaggccgaggaagaatttggacctagcttggcctggtgaggaggggagaggtcagatgggtctgtagaaaaggaagattagaaagacttagcgacgcttggggttgggactgaggggacaggcaggagggaaagaaggaagatttgggatgagttgtactgggaacagagactagggagggaccgatgtgtaaaagaatgtctggacgtcaggcatctcagaccgtttgcccattttatgacaagaattatttagatcttgtaggatggaaaaattgaacgtgccgttttctggctatttggaaccactgtcgagtttgcattggggtcaagcggcatcgcagaagaaaataaggcatttaggttttaggtcaggtgtaagttgaataggttttaggtttttaagaacacaggctaagggagaagaagggggcaatggggggcagaagcttgcccatagtgaaggaggcaagcccagagaaaagagagagtagagacacggagagaagggatggggggttcttgccccctagaaaagctgtacttgccactaacggtgaaggaccaaggcaggcgtccctgcatggtcagacacctctgaaacgtgggtgaataatcatgcagacatccccgtgtgattaaacaccaagcgaagactgtcttcccgagtccgtgaacagcgccagagttttgggtccacagataaaacgcgtctccttcatctctaccagaaaaggaaaggaactgaaattaagagaagggagagattgaagtgtggcgccaagattgaaaggaaaaagaggttgagggatagtgagagaggttggagaagagagtaaaaagaggccgcttaccagatttaaaattggtgagatgttcctttctgaggaccagaggtcataggtggatctttctcacagaacaaagagcaggaggacaggggattgatctcccaaggggggtcccccgatctgagtcacggcaccaaatttcactcgcgtccgtgtgaagagaccgctaaacaggctttgtgtgagcaacaaggctgtttatttcacctgggtgcaagcgggctgagtccgaaaagagagtcagcgaagggagataggggtggcgctgttttataagatttgggtagataaaggaaaattacagtcaaaggggggttgttctttggcgggcaggagtgggggtcacaaggtgctcagtaggggagcttttgagccaggatgagccaggagaaggaatttcaccagataatgtcatcagttaaggcaggaacaggccattttcacttcttttgtggtggaatgtcatcagttaaggcaggaactggccatctggatgtgtacttgcaggtcacaggggatatgatggcttagcttgggctcagaggcctgacagtgtgttgtctatgtcctttgtctattggttttattttgaaggaggcacctagtggttttcttctctttatataatatggttatcaatcattttttcctatttgtatgtgtgtgtgtatttgtgaaattaacccctcatcatgattaatagtggaccaagaacaaagtataaaaaataatatcatgttgagataacggcgtagaatggattttaaacttcttaaggcattagggtgcaaatgatgtactaaacaacatagaccgatctttctgagtaaaaacattctatttccactctgtgtattaatatgcattggacctggcctttcaaacaaatgtgatattcagggaactgccgcaattgagaccttaataaaccagtttcacttttttcagtaaatctgtgaaagctattattttacattttctccactgttaaaatacagaaactgagagaagtactcagtatcctacccaagaccttatttttcttcaggatgcatctcatgttttgtacttcactgtctttggctgtttttttctttattatttcccattttcttaagttgatccattataaaaacaactcctgcttacaggactatttttttccttccagaggcgtgctgttgtttcataggtgaacggatagtgtcctgatggtgtctgtggcccttgaagctgcagtttaaggagggggttcaaagaaatggtagagaaaggtcgtccctgtcctggaaggatgccagataggatgacctttgaaactgtcatcaggggcatgaaaaatgggtttgcaatagttccctgcccttctctgcacaaacgatatacagcatttgatattaaggcaaatatccttttccattgatgatgtgtaatcataaatcataagaaatttctatgatttcggattcaggaaggcacctttctacctgttggagctgttgggagtcattctccctccagcccgaccatgtcttcccacggcttttggctgctcccattggctttcacattctcctctccacctttggactatcccctacccttatctatccacacattcacttcctacattccttccatgcctaatcaggacagctcctctgaccaccttaacttcccaggatgtccgcgtgctctggataaagtgcgctaagccccgccccgcccctccccgtgtgatctgagtcgggccccactgactttcctgtacacacatcctctgtcctccttggacccatatttgtagtcagtctctctgttcccactctgcatggcacttgacctgatgctgggaaggtaatcattatccttcccttaatgtttcaggattattcattctattttgccacatctaatgtaatatttaatagcatctatgaagaagactgaagactataaataaatgctctctttagtattgagaaggttttatacaatataaaatttagagtacatttttttctcaggaggtctgacattaatattaatcgtgagccccaaagtagaagcttttatattttagcataatgaagtttaccatatgtttcaaagtcacttgcaattgtgcttctcataatgacaattagaaaggtcatcctgtcttgccaggctccattaggtatataaaccagctcgtggctgtcaccgtgaaatgtgttaaggcacttgtatgcaaattcaaggggagacatgatattttttatcccaaagtgtagctgtttacaactaattaccaaacacggaacaagcctattgtttgcctttacatgatatatgggcatagaagtttctaaagcaaattctcctctgtcttttcattgattaaattatatgaagtcaccctcttccatgaagcattacatgatgaggtccccaaagcactgaataaagaaatttgtcattaagacactggtgtatttctgatctatatatttttttctgcttcactcgaaaaacttattatctgcatgaaagtatggaaactgttattgtatttaactctctacatgtgaaccttgaagaaatgatggggcgaaggtgaaatgaaagggaggaggtgaggaggtggcacaagtaatgttttcttatggaacttgtagagggataaacctacattagaatcaaagcaggtaattcctgggaaactgaagcatgccattgtggatgtgggtcatgggaactgatgctggaaaaaaatagttcctaatctggtttgggaatggcaaatttggttgccacaattgaaatattaatatacttctttgtatgaatgccctttcatttatgccttttttttctttaagaggcattttttctctaagacaggctaaacttctgtattcaagcctttagagtttgcaaacatttatcaatagataagaaagatagataaaaagtcctggattcattaatgcacagccatggtctctacagttttgaaatttctcacttgggagaatactggagaagaacctgtggcccgtgaagcatttgactgttaatatttcgtactattcaaatgctttaatttaaaaaattaatctatgaatttaacatatattcatgggatgcagacactgcagagagctgcctcttcctggactttgtgtttgaactgtgttccggttgcttaagcacccatctatctggaatggtttgtgttcaggttttccagaggaaaggatgactccatgttcctcaaggaactttccaggcaaatgaatttgttattttttaatattaaaaatgatcctctttattgagagtgatagactaagggaggaataaacagttgtaatagccctgtgacacataagcggagaaaaaaaccccctccatgcttatgtaaataggaaggagaacaactgtagcaagaatatagaaaaggactcctttcttctctcttccactctcgttttttgccctttggcctaaagctgttaacattgggtgaatgtccctgtcgtcatcttgcattatatctcacgttctgtttgttattgatagggatggatatctgagagtctatatcaagagttacatgtaagtttgtgtaaggcccttcttttgcttctacatttttgctcgttgtatggatgcattttgtaggactgtgagcttatatttaaaacacctgtgcggcagtggacccttgtcaccgcctggcctctcattcagaagccttagctgttcctcaactcctacaacacatgttgagcgcctctcaggtgccagctactgtaataggcactggggagtggaagggtgacaagatgtgattcctgacctcgagagctttgcagtcactggtggaggaggcacatgtacacagcaaatagggcacgatgtgttgaaggatgaaatgaagcaataaacaataggtatcaagacagcagagataaggacaaccaaggatgccttcgaggagccagggagagcctcacagaggaggcagggcatgcaccgtggcttggggatggaaggggcagaaatagtgttgttttagggaagaggagagcacagactcagaggtcggaggaacgtggcacatctaggagacagggatccaatcccagccctaccacttagcagctgtgtaactttgggaaagtttgctaatcactctgagtatgtttcctcccacgtaaagtagaaatactactactactaatattgacctcttaggaccatgagtagataaagtaataatacatgtaacaatcttggcttagtgccctagcgtatcataaggactcaataaatattagtttatgtgattattgatctggctggactgaagggtgtaagagtgagaatgataggagatgaggctggagaagtggacagagccaaaccatgagataccttttcaccaggctggggttttcaagatttctgaaaggtcgtggctagccattaaaataacttggtttctgtatcctccactgctcctgaacattcttgtattacagttgtgttagtctgtttgcattgctatcaaggaatacctgagacagggtaatttgtaaagaaaataagtttatttggcttatagttctgcaggctgtacatgaaatatagtgctgccatctgcttctggcaaggcctcaggaagcttacaatcatggtggaaagggcaggggagccagccagcgtgtcacatggcgagagagggagcaagaggcgaggtggaggtgccaggctctttttaaacaaccggatcttgtgtgaactcattaccacagaaagggcaccaagccatgcataagggactcgcccccatgacaccagcacctcccacaaggccccacctccaacattgaggaatcacatttcaacatgagatttggagggggcaaacatctaaactatatcaaaagtcgatgattaaacacagtctcatataaatgttctacctcaaaaaaacccaaacattgcacacctattatagctaagataaaaaatactgacaacaccaagtgctgccaagaaggtggagcaggccaattgctcatacatctctggtgggatgtgtcagtatcgcaggtggggttgtaagagtagagccatctggaagacagtgccagtggcttatggagttaaacattacacttgccatgtgacctggcaattccactcctgggtacttatttatcctctagaaataaaaatttatatcccacaaaactgtaatgaatatttatagcagctttattcataattgcctaaaactgaaaacaagtcaaatgtccttcactgagtggatagaataacaaactatggtaccttcacatagtggaacacgactcagtaataaggaacaaactatcaatatacacaacaacctggctgcatctcaaatgcattgtactgagtgaaagaaaccggtctcaaaaggctacagctgtagcatcctattcatacgatgctctggaaaagagacctctaagggcagggtttaggaattgggagaggggctggggaagggtctgattagaaattaacagcccaagggaattcttggttttgtttttatttgtttttttttttttgttgttgttgttttttgagacggagtctcgctctgtcacccaggctggagtgcagtggcgcgatctcagctcactgcaagctccgcctcagcccaagggaattctttaggggccttgggattgttctgtatcctgtttgtggtgatggttacaagttacagcccatagaactgtacaacaagtgaattttactgcgtgtaaatttttaaaaaattttaaaaacttgaagacatatagctcatttaccacgtgctttacctgtcttatctcattaatcctctctatgaggttgatgttattattacaggtcgaacattcctaatctgaaaatccaaaatctggaatgctccaaaatctgaaactaattttgaggcctgacatgatgctcaaaggaaaagctcatagaagcatttcggattttgcattttcaaattagagattctccacaggtaattatgcagatcttccaaaagctgaaaaaaatctgaaatccacaacacttttggtcctaagcatttcagataagggatactcaacctggatctctattagtgcattattatctactactattattattattgactaagcagaggctttgtgaggtttggcccaaacctacataccttccagggggcaaagcctggcacaagccaggtgtgcacactccccagaccctgaatttccacagcattgcgagtcacccctcaaggagtcacagagtgggtggtagatctttctcaggctcttgtacaggctgtacctcagtttatccagctcattggtcagtgtggttgctctgtgcatcatgctggtgcaacttttacaaatgtgcaaatgttctaaatgcttagtatcagagagggagttgcctactgaatattttctgacctcttaacttgtactgttggctaagttaaatttggcttcttttcaaggaactattaccttcctagagggtttgtgtggtgacacccataaaaatcttattcagtttttgttcaattcacagctttaacttagtctccttaaaaatcactcaggttgtaaccaaaggctgctctatggctgagtagaattgttaattattaataactgttaatcaactacatagtcaacctcagacaagagggcaagagataattccttagacacacacacaaaaagagcaaaatgttaaggttagaaaacagtaaaaacgatgaagatatttaattctttttgcatactttgtaattatttgtttaaatatctatttccctagcctctgtgccagtttttctcgttgttttttatttttatttttttaagagagggtcttgtgttgttgcccaggctggagtccagtggtgcaaccatgactcactgcatcctcacactactgggctttgatcctcccatgtcaggctcccaagcatctgggactacaggcatgcaccaccatgcctggctaatttttaaaacatttatttttgtagagataggatctctctctgttgcccaggctggccttgaacttctggtctcaagcaatcctctcaccagtcctctcacctcagtctcccaaagtgctgggattacgtgagccattgcgcccagccttttcgaggctattagttttctgcccccagttcctgtaatccttgcatagaataggggcttagtaaaggtttgctgagttagaactccatttcaatggatattgaacttgagaactgagtgagacttgtggagtatggtatttcaaagtattatttatccaacagtctgatatttcagaatcattcatttgccaactcctatgtaggtactttggagatattatttgagttattccttatgacatcccatgcagcaaacatattccttcctaaatgaggaagctgaggctaggagtgatgagctgatttgcttgttatgcacactggatggagtgtgagctgtgtcagacacgtgaattcagatcctcttgtgccacatcagagggacatgagatggggtggctgtttcacttctgtgagcctcactttccccctcattcatttatgtaaccaatggtgggtccaggttttgtgaggactggagcttacataatttgagtatgggtcttatttaaagaaaaaaatatataggattatgattcaaatttggatacagggtttgaaggagacttgtgacagcgggagaccctgaggcttatgtgccattagattcatggtaaatctgtccttgctttcaactaatttttatagtgagccactacgtgccgggctgtgtctgcagctggttacatgtgctgagcctaacagtaccatcctggtcctctagaatgctagagcccactgggagacaccaccagaaaacagacaacggcagtacagtcagataagtgtatgatgggggggtatgaaaagccaggaaagatttctggaagagatgacatctaagctgctactcaggatatgtaaaagttaaaatggagaaaagtatggaaagcccatttgaggcagaagaaagaacaagcatgagaggtgatagagaaaagcttccttatggggaccgcaagaagtttagtggggctgcgttgttcagtggggtggaggagtggggagagcttcagctccagaattaggcaggggccaggtgggcttgtgtaccacttaaggagcttggaaatggtcctaagagcaataggaggcacttggacagatttaagcagggagtgatctgataagatttgcattggggggatgaaaaaaaggccacactgggtccagctgcagaatggagagagaatccactccacactgggcacgagggccatccccctgcagggaggccagtggcaggagagaggaaggtgacaggagagcagctgtgagaacgaagaggaggggatacattacaaagttgttcagcagtgagaaccaacaggacttgagagtggatgcttagaggcaggaggtgcaggtggtcatgagggaggagataagatagaagcttagctttctggcctggaccaccggtggggggtattcattagaatcaaggccataagaacagcagatttggaagagattgtatgtctcctttgagccagttgagtttgcagtttctgagtgacatccaggtggagatgttcagtggagagctggttgcaaagctgaggaaggagagctgactgacggcagggctttggctgttctcagcatatggattataattagagccgtgcagatagatgagagtgcatgggaaaagccagtgcagagacaagatggtgcaaaggagtatcctaaagaacattaatctttaggggacaggcagaggacaaggagccacaaagaagcatgagagactgtggtcagggatgagggaggaccggcaggagtgtgtgaggagcacggattgtttttgtttgtggggttcccctgcctttagggacacactaactctttggatatcaactggttgtcccggaattccatttagctctgtttgacttgtgtgcagagcccatggttttcacagcccctcttcctttcagatttgataatttgctagagtggctcacagaactcaggaaaacactttacttatgtgtacaggtttattgtagaggatacaactcaggaacagccacatggaagagatgcataggacaaggtatgggggtggcgcagagcttccatgccccctccaggtgcgccacctcccagcactgccatggcctcaccagtccagaagctctctgaaccctgtggtttagggttttcatggagcttggttttatacattttagggagacatgagacatcaatcaaatacatttaagaaatacattggtttggtccagaaaggcaggacaacttgaagcaagttgggcgggcagggaggcttccaggttataggaaggtttaaaaattttctgattggcaattggtcaaaagagttattatcaatacccagcattttgggaggccgacgggggtggatcacgaggtcaggagatcaagaccatcctggctaacacgtgaaaccccgtctctactaaaaatacaaaaaaaattagccggacattgtggtgggcgcctgtagtcccagctactcgggaggctgaggcaggagaatggcatgaacctgggaggcggagcttgcagtgagctgaaactgtgccattgcactccagcctgggcgacagagcaagactctgactcaaaaaaaaaaaaaaaagaaaaaaaagaaaaagaagagttattatcaataagaaggaatgtctgggtttcgataaggggttgtgcagaccaaagttttctcatgcagctgaagcctccaggtggcaggcttcagagagactagattgtaaatatttattatcagatgtaaggtctgtgttgatgttaataccggaggttatattgaggcatgttcaaccctacttcccgtcatagcctgagccagtctttctggttaaattttagagttctctggcctggcaggaagtccatttacatggttgaggaacttagaattttgtttttggtttacaaagagaaagcagagaagggtgatgaatgactgagccacatcctggtgccagctctggaccgggtttggctgtggtctccacaaacatttttgaatgaatacatgagtgagcaagtgagtgagtgaatgggaggaaggccggcggggggaggtttgaggagagtggggaaaggtctgctgtggtgccttgaaggtggggagacctggcacggggaacacagaattgccaggtggatttggtgcccatttggaaggtggcccagtgacttctggggacagtgtccctgagatcatgcattttccccagctgtgctcagcagcctgcttcagggagagggaatggcaacagcgagcacgccaggctgggggtttccaggcaggtagaggagaaaggcaactgggttcgggagccgaacggagtggcaggaaggtgagtgaagtgatggatggctatgtctacactggaggctggtaaaggagggaaagtgataggttgaggggtgggtggctggatgtggtcgtggaacaggggcagaaataactagggtgtgggaaaagtagtggcaaggtggctgggagcttggtggctcagtttgggtgcagatgaagccaaggtgaagtgaggtgggatggtgagaccaaggacccagaagcccaggtgtcggcctggtgatgcaaggatggcggcagggctcggggtggggaggaggtggaggtccaggatcaaggcccccagagaagggggatgtcccagatgagagcaatgagaaggacagcttggggtgaagctgaatgccctgagccttcaagcagcaacagattatacctgaaggtagagccacgttagggacgtgggaggacactgactgcttgggtaggggtggggagtgagcatccacactcgagtggctgcagatgccatgagaccctccagggatgaccaggtcactgttagggcagagaggaggaggcagctttcagaaggagctgggcatgcagagcttgctaaccagtgatggaggatccaggcagtagggcaaagcccatggaggggcccacaggacgggacaactgcgaagacactgtctgccttggaatgcgggcagcatcttcatagccatccagggatttggaccctggccttcctaagtgagagctatactttttctataatttctgccactacataactgccaaagttaaaggtggaaaaagagtctctgtcctagcttttcagcgaccttttcaaaaggaacagaaaatcgtcgcattctcttgcttctacaatgccagtgattgtctgatgcatcctgggtttgacaaaggcaggtagacactcacggtgcagggacacgccagttccaaatcgcatctttactttttaaatgttgaaaaacaaaaaagacagtgcatcttagaatttaaggcaacatagtaactaaagtggcggaggcttttaactgaaaccagaagaaacagcatgagttttgttgttttatgtttcttagctgaaagaaactcaggcaggataacgtgataaggaaactcaggtatttgcctgtgattagttcaggaactgttgaaaaaagactctgggattgggcagaactagagtttagatcactagcttgaaggacttttaagtccagtttaagatttggagagagttataaaggctaagccagcatttataagaacatgtaccaattagagaagtacaggagaatttgctgttttctctgttattataaagatcattgttcttaaatttacattagtttgctaggcctactgccacagaaaaccacagactgagtggcttggacaacagatgtttattttctcccaactctgaaggctggaagttcgagatcaaggtgtcagcacaaatggtctctccctaagcctctctgcttggcttgcggatggctgtcttctccctgcgtcctccctcacatggccttccctttgtgtgtgtctgtgtcctcatctcctctcctcatagggatgccgatcagactggtttagggctcaacctcttgacctcgtttcaatgttatcacctctctaaagaccgtgtctccaaaaagtcacattctgaagtaccagggattagggattcaacatataagttttgggggaggacacagttcagtccatagcagcctattccatacctcattttataagaagagaatttaaaatcagatccttgcctagcactcttctggtcacacacagaaaataatccagaaagttaccttggctgctcagcctcatgtggctggaccctctgttgctgtaagacctcaccggacccttctccgtcctcgctccttcacatgctggaaccttccttacatgtctagatgcaccgagcttgttcacaccttcagggtttgttccctcatcctaaaatggtttctccttagttttatatggctctacccttgtgccgttttggcctcaagttaaatcctgttcctccaagaagcctccctgaccatccaatggaaagcagccacccagcaatgccagatctcattaccctgtctcagtgctcagtgtggtacttattgctggctgatagggcctcatttatcttgtcaccaatgtccccagcactgaagcaatccccagcagatagtgtcactcaaatatttgccaagtgaatgaataaaaccagaagagttaggaagaaatgaagagagctgctgggaagaatctggatgttcctgaagtccaagactttatttttttaggtgggattcatcaaaaggaggcagtttgcctgaggtcccttccctgggcaaagagagaaacagggctggtctgactccaggcctgtctgtgactttgattgttttaacaagcagatggtatttttgtacacagtgacttggagaacttggagacgcgtatcaatgccgcctttcttccctgtcccttgcataacaggtttggtgtcttggatcaagtttggggcagcatcaaactgcgccactagactgcatcccatgatgcagggattatactgtattcataccctgcagtgtttgcacatagaagccttactataaatgtttgctgagtgaaaaacagtgaataaatgagcgaatatttaaatgacaagaactgacagtcttttgaagttcctctagggtggtgcttctcaaacttcaacatccatctgaaccatctggaaagctagttaaaatgccaggtgtgattcaggaggtcctgggtagcctgagaatctgcatttctaatgagtttccaggtgatggtattgctgctgttctcacctctcctttgtgtagcaaggctctaggatgtgtccaggatggtctatctacttggtcaaagataatcttgtgagttgactagtcatcaaaagaccccgatcacttctcagtttgtccaaaaaataacacatgcaactttcagccagttacttaacctcagtgatcttcagtttttgtgcataggtgaattggagatgggtgttaatgccccctttcttccctgtcccttgcatattatgcctgatgtcttggatcaagttttgggcagtatcaaactatgccattagatcatatcccatgatgcagggattacattatattcatactctgcagtgtcttgcacatagaggccttactgtaaatgtttgcagtgaaacaacgaataaatgagtgaatatttaaaagacaagaactgacagtcttttgaagttcactttggaggaacctagtccaattatcaggagatattatttgttgaacactttgtacctgctgagcttcttgatatgtgttacgtttacttatcacaacaatcctgcagggtggaattattatcctcatttttttttttttttttgagacagaattttgctcttgttgcctaggctggagtgcaatggcctgatctcggctcactgcaacctctgcctcccaggttcaagtgattctcctgccttggactcccgagtagctgggatcatagggatgcgccaccacgctcggctaattgtgtatttttagtagagacggggtttctccctgttggtcaggctggtcttgaactccctacctcaggtgatccatccgcctcggcctcccaaagtgctgggattacaggcgtgagccaccgtgcctggcctatcctcattttacagaagaggaaactagtgctcagagaggttagacaacatgcccaaggtccccaagtcaataaccaggagccaatagcagggctctgatgatgatgatggtggtgtgtgtgtgtggtgtagtgtatgtttgtgttttcatgtgtatatgtgtgtgtatgtgtgcgtgtgtttccctcataccattttgcttatcaaatgatcctttaggttctttccaagtgtatgattttaggtcaaagacaaagcatgacacagttcactgtgaattgtgagttattatacaagctcgtgaaagagtcggataccttttctgatcctcaatataacctttgtcttctcaccaccataacacgttggtttctcttcaggaactgattttatattctcatgagcacatatgcggtttctcctatagactgtaagatttttaagagcaaggactgggtcttattttccattttgttccctagtgtcttcgatccttattgcattcagtggtttgatttgaacagaactttggaagcatgagacagactctgtacattaaaacgcttccatagcactcaccatggtgtccaaagtgtcactaaatctctgcttgcttgagatttctctatcttaattaatcttgatttgtgctgtttttttgtgaaagagtaaatgcctgtgggagggctgggccccacctacggagaactctggtagtgtgccaagagcaggactgcataattggtgcatgtgacaaggaacagaggagggtggaggggtccctggatgatgggggtgccttccccttggctgtctttattgtgtccccattggcattactgttactgatcactaaatcagggaacagacggaggcgtgaggtaggatcctacgacagacagcctttagtgagttaccaatgacgccagagttgaccatcaagtaaatctgttgccttttgaaagacatgtctgtctgtacaatgctagggcctgagttgcttaaccttctagtaaaccatgaatttctctcacatgtccttggggtgatgaaaatcttcccgagttgtgcggagcacaaagtagaacctgacagggaatgttctgaaataattgtgtggatggtgacaggtaaaaaaatacactgtagagatatcgatcctgtacgaatgcaacctaagttgttgctctgttaagaaatgtttttggagttctctatacactaaaaaaagaagaaaaagaaaaagaagaaaagtggaaaagaagagatttctcttgtcttgtatgaagcagcaaaataatattctatcagaattgttttaaatatggtaaagtggggcacttctatttaaagggtacgtctttggttcattttttatttttaattgccctgatatctcttgcttttgggaaagtccgacgctctggctctctgctatctgttcaaccagccttcagtagaagtgggaacacaaatggctcattgttttaattttggatttccttaggctgttgctgtcacctagtcatctcagacactcttacagggaaaccagcactggcagggtgtgaaggtcatagcaagggcagcagtgcttcccaggatcatgtgcctggagaggtcggtatgccctgacttctaaagggggcctgccttccacaggacgagcacttactgagcgcttctcctgcacttactgtacattctcatccatatgttagttgttgttaccataaatgtcctcacacatctgtggcatgtggatgacaagagcttctgagtatattttttaactgtgtttttcgaaggcaactttaagtgctaacaatccagtggttatatgggtggctattgactttcagattcacggcactgttctgagtgggtaattcgccgcctttctctaactcttatgtccttgaggaacctgaatgtacagatgattacctgtacctactgagcgtcctctcgcagagttggggtgataaatattctgcaaaacctgctataaaacagtcagccctgagcagcaggaaactgaatatagtcactcacatagctaaacccaggctcaggcctacattcacccctgtccgaagggggtggaaatgagatcatttcacacctcacgtggaagtgcagacctgaaagaagacttggggctcccccagcacaggtgtccccattttacaggtgccaaaggctgtggcggagacagagatggggagaggagttggccgtgatgcgtcgtcatggagcatctcacatgtaagggccatgagaagtgaggacagaagggcagccaggctggctggtcttcatgtgggccagttgagtgggaatgcggcactcatgggccggcggaagaatgagcatttgaggaggcagagttccccactcttctgaacctctgttttacaaaaggcttagaatataaaattgggaccttgtctttggaaaggagggagcaaagtgttaacctggacagctttggtgcacaaggtgagaggtttaccaagggctcacacactctccttcatgggagagggtgcttaggaggaggtctggctgctgtgaggtatgggacctgtccaggaccttctactgctacagcaggaacagcactgtgagggagggatgttgctcttcctatttttcagtcgtggaatggaggctttgaaaggtttggtaacttgctcgagatcacacagccagcgaggggtagcatgggattaaacaccagtcggctcgtctccaaaggcctgactgacaaaaacaaatttcaatcgattttacttttcctctgtaatagatgaggaatatctcatttcagaatatctgaaggtgacatttggagtcgctcattgattcaattattctgaatctttatttcagagcttatttatctcaggttttagatgtggaatgctccaaaactattcattggtttcacttccctttgcattgctaagtaaaggtgatataggagaactactcacaggggtgagcacagcaagggtacgaaggatgtaaaatcagacgcagcttttctatgcatctttcttaaacacattactcttaacccaagagacagtcaggatcattaactttcctaatattttgtaaagcattcatatagcaacatttggggcacatgcgcacctggtcttaagtcagggcaggagtggctaattaattctctgattcctcaggcttcacagtttcaaccagccataattattttgcaattgaggttccctctctgcctaaactggcattgttatcaagggctaaatgcatcagctttgtaataatgaagatgggtgccaattccatcttccatatgggatgaagttggggagagagatggtggagaagcactggtcagactgtaaatgatattgagtagaaagaagtcagggatttttgtttttaacatgaaaaagaaatagaattgtaactaagttgaagtttctttactgtttcatcttgtttctttacaaatttcatcttgtcatttacaagggtttatgccacatagctatggatttgggcccaatatttgaccttatagcagctctaaaagattagactgcagttaggaaatgccctctggatctgatttttaaacagaaccaaatgcattctactcttttctgcttttaagagtaacactgcttgaggatgcattgaagccctgctagacatctttgctgatatttgcctttagcattctttctggaggtatttagaccttaataaactaccattatcctttaaaaaaggactgaagagaataatatttgtagaaacaaaataatcaaatacagtcctacatcatttaatgttggggatacgttatgagaaatgcatcgttaggcaattttgccattgtgtgaacgtcatagagtgtacttacacaaacctagatggtgcaccctactactccacacccaggctacgtggtgcagcctattgctcctaggctacaaagctgtgcagatgtgactgtcctgaatactgtaggcagttgtcacactgtaagtatttgtgtatctgaacatatctaaacagaaaaggtacagtaaaaatgtggcattataatcttaggggaccaccatcacatacatggtctattgctgattaaaatgtggttaagtggtacatgactgtactagcattaaagttcttccgaactgagagggtggaatgggaacaggtactggcttcttgttttaagggctgactggtgaggaaggtactggcttcttgttttaagggctgactggtgaggaacttgccacacagagcagtaggctcaactaggctgaagacaggctacagataggctccagggttgacccagggccaagatacagcagctgccttgtcctggctcgctgcagacttggcatctccagtgcctgtatccctgaatttgtggttgaacttaagtttggggagtcccagtggccctaatgagactggaaataccaccctaaacaacctcctttagcagctaaactgacaataataatctgttgtttactgcacaggattgagatgagtgtagcaatctcctagacgaagggccaagctgctcacccacctgggtggggtggtcagtctagggcggcccaaggggattcttgggtcacgatgaccctggggctgataaccaactcacaaatacataaatcaacaacatgaggctagcttctgctggggctttgttgtctggtgggcctgagttttaatcccggctgacctcttactaagcgattgtgggtaagtcattctaatttttttctctctgagcctcaaattcctcatctataaagtgagcatgaaatcctattctagtcattctgagggacaactgaagtgatatatgtgataatatgaaatatgatagatgtgatatatagaactgtaaaacttttaaaaagtaaaatgcctgttaaattgttaaatatgtgtaatatgtgaaaaactcctggcaaatatacctactaatatccatttccatatagttcttttatataaaaggtagagcagtatatgtaaaccttctaataaaacacttagctataactatgaattctcatgtgctcttcctgctgtcagcctctcctcctgctgttaaatctttgcaaggcctcctctagttgttatgttctgaaaagattcaagtttgtatcctagacttcaaagttatgtctctcctatgtggtgtgtagtgtatcaccctgtacttggaggtatgtgatacaagaaactaaggaactaaaataattcttttttttttttttttgagatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaatgagctcaagttatttcatccacagtgatagaatgttccccatttgatgcaagcagttaaacttaatttccattaagacaaacacacaaataacaatcctccttcccaaacttgaaatcccacttctctttttgaactctcttcatgaagtagtcccttttcttgcatttacaacataaagcctaaaccacaaatattggagggcaggggttgaggatgagcaattgagatgttcctcatgcccttaaaccaagagtccttatgttctctccttcctaaggatggcttattttcctttccatgaaatgactttaagggtgattatatccaaagggaagtgacgtttccccttctttctcttcagttggtccattttcacagcccacaaaagcaagtctctattttgggacttgattcaaagtctgaaaaaaccctaggcacatctttcttccttgaatatgttcacgtgcatattccaaaaaaggttctcattgctagttaggccattaattttatgtgatatccaaatcaaacagctgctgtactgtttaagctcagatcctaaaatggcactttgaacatgaaagtcgtggctgccactctctgggtgactatctggcgatgacacttctacctttgtttttggcttgacgtgcatatgccgaaggcttcagcaaacataaactcatacaaatgtttgtcaagctgtgtgagcctaaacagctcattagttgcaagaatgatcagatgggagatgggttgcccaatttggatggtgacctttatgagctctcggttggattgcagatttatgtgtcacagtatattggaacataatgaatcctgtggcatgtggatggtaaaatgcagggcagaaactgtgcaatgaagaggcaggaagaaggtggcaagtccaggagcataagagcagttaatcatctcctttcccccttcccctattctgcttcccctctgttctcggggtgcccattaaaatgcagttggtaatgaaatgctgtttgaaatcaaagttgctgaaacgatattgtggatattgtggaaatctgtcatatttattttaaggatgagcttacttccaggtgctttcagtgactgcagccccgttagttcccatgcattgattctctctcatgtccctgctccagggtaattctcttgtgctcaggcacatgaccttctagttgaaaacctgcccctgccatttctttatgtggctgcggcccagggagcttgcctgccctgcgtgagcaggttgcaatgataatggttcccagtgctgctcagtggggaactgaagtcatggtattttccttcatatcctcttgaagcttcattttgtgaccttgtttcatcctgctgaacctatcattggaattaccccaaaggtggtggcaggggagtccccagaaaggagtgccccaaactttcccaagatggggcctactgagattccaaagaaagaagcagtaaaagccggagtgatcaggccaaagcattcattaggggaacttaggcagagtgggctgcagcaatcctgcggcggcagcatgaaaaaaggggtcttccacctagaaacatccacagcgaggtgctcaggggatggagtttacatgagggtttaaggaatttggctcagggccagggccagtttctttcagtgttttgggcaaaagcttagatacctttatcaatgtgtgggaatgttcaaggccctggtttgggttcaagcctgctgggaaaaacctgcagctgtctgggtcacagagcggtcaaggcactctgtgagttttggtcacaacagaaaggcaagggctctaggggaccctccagaactacaggctccaatgtcagccccactttcccaagtacaaatttatttcagaaattaaagtactactcttactttttcacacatttcgaagtcatgtgttgacatggatagcctgtctagcacaggaaaactctgatctatttaactgatttaaaatgtttataattgattatctggataagtgtcattgatggcactccaggtgtgtgaagacgccactggcctgggaatcacgacatgtggggtttgtcccagatccctgccatgccatttaaacaccatgggcctcagtttcctcacagcaaaaattagggttatactagatattctccatggaccttgtcaagtattttttgtgatgctgggattttataactaacacaggcaaacaataacctagaatgattagaatcttgaaaaaattgtttgtttgtttgttacagagaatcttgaagttagctgaagtctgtttgactttcttccggaatcagcacagtccaaatgcagccatgacttctcactgtcagaactagacgggccacactgagaaagaatgtggaccggctacccggaatctggccgcttagtgcattcaagaatgctgcttggtttctatggctgtgatttccaagcattttctaaaaggtttatagaggagaaacctaagtgcctgccaccaccccaccttgaagtcaaatttccctgaaggcactggagcatagggagaaaaacatcagctaactcttgccgctataggcctgggttaaattgcagctgggaaattcattccagtggcttgccgggctaaacacaattgtggatggagcctggagaagcatccaagcaaacaaccacttgtgtcagttcagttgtttcaccaaaaaagcaaaataaaacagattttactaactcaattaataattcagttgccccataaaatatagcctcactgaatttcttgtcttgtcttccaagacattaagtcagggcttatttatagccatggctctcttccctggctaagcatccgggccacctgccccagcaggtgagcccttggtccaaggtggtcctggactcagcatgtttttcagagttctccaggtaattccaatggttagtcaatttatcattcatttggggctgattatcagtcttccatgtggataaaaccagttaatttcctgtggatcttttttgaaagccttattaagaggagggagccctgttttgaacttgtgtcatgagctctgcctgtctctggaggtggcaagggtgctcgtcttcattctggtctgtgtcgcatgctgtcttcctctgtctccctactctttctcaaccttcttatttactattccacacactcgctgggttagacaaccttttctgttgttctgctgaaggttacaatttggagtcgattcctgtagtcttcctttttctattcactttcagaaaagatgttgcaaagtccaagtttcttcctcatgttccgtttctctggggagtgctgtagaagtttccataccttcctgcttctggccttcttagtattttaataactcctgccttgttcccaggtttctccaagtatctggggaaagtagaaacctcagagatggggtctggaaatgtaaaacgttgatgaatttcagggtcacccttgtgaaagctattgattggtcagaggtattctggaaaagtctgcaaaatccagaagctaatttctattttaaaatacaccctataactcttgagtgcccactcatcctcagctggctctggggaatggtgtctgagctcacggtctcatctgtgggagctgcatctcatcaacctattttggaaaccagcatacttctggttctgagaattcagcttaaaaacaatacctagtttcctgtataatccccccaccaaaaaaaagtttgcaatgtgccccatgtctatctgacacattttcacttgtttcttcattgatgatctaggtctgtccaccctgctctatttcttttctatttatctccattatcttagtctatttgggctgctgtaacaaagtaccatagactgagtggctcataaataacagaaatgtatctctcacagttctggaggctgggaagtccagaatcgaggcagtggtagattcggtgtctggtgagggcctgtttccaggttcatagatggtgccttttcaatatgtcctcccattctggaaggggcgagggagctctctggggcctcttttgtaaggggactaattccattcacggagattctaacctcatgacctaatcacctcccaaaacccctacatcttaataccatcactttgggggttaggattttaacaaatgaattttgggagggcacaaacatcagtctgtaacatccatttgatgcctacttcaaaattttttgttgctattacatcaaaatctcttctggctttttctgaaagtggatttctatgtaaccactttttcttttcttttgcattatgactgagtttttcttcttaagaaaacaagaagcacgggtagatgatggagagcatgagtgccagagagtaaggaagcctgggctcttctgccagattttgtgttagtcgaaaactgaggacttggagggttgatgagctgagcttttcgttggggctcctctttcccatccatgtattgttccagcagtacaaagtttgtcaatcagagagaatgtgggttcccatggcaaggtggcttccagttttcatactctgtaaaaggcttagtgatggaaggagattaaatgtaatgctttaatgtggatttaggtagagatcttgtaccacagaaaattggaaatcaagggtgaaaaactgagaaatggagtgatgtctttttcttccatacaatttcatatttgcaaagtaaattaactctaaatagtttagggttttattccagaaatctataaaactttaaagaatcttggcatctgattgatttttctagtttatgaaaaactgacaatattctaagccaaagacacattcaacataataatgcaggttgagtatcccttatctaaaatgcttgggacaagaactgttttagatctaggatttttttttgaatatttgcttatttacctgttgagcatctctaatcccaaaatccaaaatccaaaatccaaaatgctcctgtcagcatttcctttgagcatcatgttggtgctcagaaaatagtgaattttgaagtatttcaaatttcagatttttggattagaaacctacatatcaaaaaatattttgtgtaatgtcttacgatgtgtgtgtttggagccttctcagggttaagcagatatgaaaagcccacgttttcaggaaagaatttaagaaaataaagggccaacattttttccctcctggctccatgtcataatatttttgccggctgcagagtctattcttttctatcttcagacttatcactatcaagcattttccattccccacaattctcattttttgttatctttttgcacttgcaaaaactgaaatttggcttgaatgagacacatttccctaccctttatctctcactgattcattccttgaattgggacaaatctttctaatctaagccagtttcatcctcttgcaatacagtaacctgtgtcagcagagtcctgtgtgggatgagtttggcagaattgcagactgcatttttggacctagcagttgaagatgattctgtccctcatcaatttttttccgcaagggcacttttgccttcaaatggtattgtgtttttctatttcctttatctaaagaaagtcttcaacttagttttgttctgttcctgtgaatgtcggcacaggaaagtccttgaagaacatgagaaacaggagcttcatctgggctctgtgatggtgccgttgtatgaattgaaatccatcagggtgggactggttatctgtctaacaaagatgcaatgagacatgattgagagtgtgcttcgggtggagtgtttcttacattttgaggttaaaagccttttctgtcattgtttttattatttatttatttatttttattagagatggggtcttgctacattgaccaggctagtcttgaactcctagcctcaagcaatcctcccccaccttggcctcccaacgtgctgagattacaggagtgagccaccgcacccagactctgtcattgattttgacaagtttttttttttttttttttttttggttgttgtggttttggaagttttttctcagaaaggacatacttgactgaatttttctcagagcctaattattatttagttatttgtatttatttctttttgatttcactacagtagccactatatcttgagtaaatttagcttttaacttgctttatgttttggtagatcttagtgattatgcaatttgatgatgccattcaatatcaaggtcagaccacagcatgtacaagaggttgctgtcacgtgatagttttccattttcatctcttagtatgctctcttatttcttgctttgctcattcaatgaatgttttaagagtctgattgagatattacctcatagtagattactttcccattaatgtttgctcactcatctgtaggcctaggaagctttatatctatttacaacagcgactaggaccaatagtgtgctgttaaatgcttaggaaccagttctccaggaaaaaaaagtcctgattggcaacgtctggccatttccatagtgtaaatctcccactgtggctgatttccagctatttctggtttaacaagtggctcacaaaattcttgaaagtttatcaactggctttcaccaggaggatggctccagcacccaccacacctgacaacagttatattactttacggatgataaaaagctttatcatcgttttatttcatttctgatttacaaaacaaccctgtagagtaggtggtgttatacatgaggcatctgagactcagaggcctaagtggctggaagtagctccagcagctattattaggcagagcagagacggaatgctgcctctgagctgagcattcttggtgttctcatcactcatggcaactgtttcccattgtgaggattcccttagtggtgtcatatttggactccaaagaagtatactcaagaaatgactacttcgatggttttagcagataatttttagttatttgaggataagaataatagtctgcttatgaaagaacttggtaaatttttttcttctggttttcagacaccatttctgtcttaaaatgaagtatctggtgtatgattgctttgtaatattttgttacttaagggtggtatccagacaacccttagttaatgttatagaatcagaactagaaagacctcttcattcttcacttagagaggatttaagtgtctctggccatttattgggttaataatggtgacttcaggtgacccaggaaacatctggatatctttgctgcacttggaaagacatttagtttggtaatattttcaaatcatgtgatcatttcaaaatgacttgcaccatggagtgatgatgtgatgctggcagcagctgctgtttgctggagatttcgtgtgtcaggcacagttgggaatactttatgaatattagtttatttctcaccttgaaggtagacattgttctcagtttgttgaaatcgaggctcatgtaagtaaaaaatgcccacattcatagcaaataagtgacagagttagtctctgactctgcaaaggacttatatggcttttgtataataaagtcggtcaccccattttggtaataaaagggataataaaagaccaacatgtcttcattagcttgcagataagctccaagtttcagcatgtgcatagtttgtaatgccttcacagggtctgcaggctcattgccatgaaaatatagaactaacaagaatttagttttgattgacatagtttataaaatgttcttttttttttttttttttttttttttttgagacagggtctctgtcgcccgggatggagtgctgtggtgcgatcttggctcactgcggtctctgcctcccaggtttaagcaattttcccacctcagcctccacagttgctgggactgcaggtacccgccaccatgcctggctaatttttgtacttttagtagagaaggggtttcaccatgttggccaggctggtcttgaactcctggcctcaagcaatttccttgccttggcctcccaaagtgctgggattacatgcgtgagccaccgcgcctggcctaaaacattcttttaacaaaagcatagctttatgttgaattcaggtagattcgaaccattgcttttaataacacaatatgggttctttcagactcttggggtagattgaacttctcataaaactgtcatgggacagattgcaacttctttccaatatcagaatctctaggtgagttcatccatttctttgccctgggctttttaagaaagtagggcaatgagtccctggtttctcatctccgtaagaatgaaaggatgctggagccaaggtctagtctactgccagtttctccaggaacaatgtggaggaaaaggaccagtgtagatcagaagtccatgagcggaaactcagaatcaaagcggttattcaattcttcttttcttggaggaaatcactgtgtcgcctgaagagaaaaatgccctttgctcttgcactggggagttctgtttagtgcctttccacacaaaagggctgtactggctggtactatagactttttttatgaagatctttttcataaatccttttgcagagtatagccaggtagcagtatatgaacattggaagtgaaacagttttcgtcacacaaaattaacaataaaaacacatgcaactcatcatttataaaacgatacttgcaatttttcattattctcatttctgagggcaaattttcagatgaaaacagaaaggaattttagaagttttcatttttttttcctacatcaggcttccctatatgtcgtctgtataacaagcaccttgatctttcattcagttataagaggctcataagcgttgcctctgttttctatatattggtagtgtcattagaaaacctgagggggtgggccgggcgcagtggctcacgcctgtaatcccagcactttgggaggccgaggtgggcagatcacgaggtcaggagattgagaccatcctggctaacacagtgaaaccccgtctctattaaaaatacaaaaaattagctgggtgtggtggtgggcgcctgtaatcccagctacgcaggacgctgaggcaggagaatgacatgaacccgggaggcagagcttgcagtgagccaagatcgcaccactgcactccagcctgggtgacagggagactcgtctcaaaaacaaaataaaacaacaacaacaacaaaaaaatctgaggaggtggacaccattttttggtactgaacgacgtgatgaccgtttaaaaagaaaggtagatgttaagaaggcttccttatacaaaaattcttgtatattgttccttccaattttatttttgttttgatatataaaatcctatgttaaatctctcatcctgaatatcagattactccagaaggagaaagtagcagtctaattattttatttggttgcatggtagtcttagtacaattaaatctcctttgaaagtttctcagttatgtagttatgaatagcactccacaccacggctgtggtagacctggagcggtattgggcccaggtcacagaatgatcacggaaggactttagagatcacctattgagtccctgttttagagaggagcaagcaaaggcccagagaactcactccatttgccgaggtccgacaagtgtgtaggtgagctggagccagaaccctgtctttcggtcttcactctagagctctttccaaacaaacatgctgacctgggagtctgacaattgctgtatgctgatgtttcctatttgaagtccacatgtctttgcaggggaagagaactgtctagtatcattcgttaatgcccactcttcatgtttgccaaagaccaccaatacattgggcagtgattgtgttacactggtttgtttatatgtcggctttcagtgatgccagaaaatcaaaaggaggttaagaaatcccagaggttcacccaggatgggaggctaaacctttgttgtattatgagtcttaattcaagataacataatctttagcctaataaacattaggttgaattttgaaaatgtaaacactaactgatctgtagactgacgtctatttccttggcaatattggccacacccattaaataataacttctcattctcccttcccccagcctctggcaacctctgttatactttctgtctctgaatttgactactttaggtgcctcatataagtggaatcacatgacatttgtccttttgtgatacgatattttctttaaaaagaaaatgaacagaaacagtacatgagagaagtcaggtctgcagccagtgtgcctcttagttccatattcatacaaggccctcttggaagctcagctttggagttggatattatctcagaagatatggcagcttaggaatctggtactctaaaaacagatttacaagcattagacttttttgtatatgtgtgtggtcattttagtcttcctgaaagtggttaagaccaatatttctaggcagactatagttcacatcatccagttctgtaagtcttggattatcgatctcattgtcatggcaaaaaaggacagggattactcaactcattactcctgtgtccagacctctgagcctggtgtgtgtgtgtggctcagtgcctttcccatagtggcccacatccccccagggccctgcatgaagttcctgcaagtctaccccctgcacgtgcagagcaaaaagagcttcctatgggagctgttctccagaaaagacagaaacccgggccctagagaaccagaagatttaaattccagtttcagctctgccattgactaattaggcaactgtaggcagttcactttgctcctttggaccagagatttctcatctacaaaatgaaaaacttggatttaattatctctgaagtcacttcaagcagaaatgtaacaattctttgatttattaaaaaaaataacatcaatgataatgaccaacagctaacacttattacaaggctccaggcactttcgaagtccttaatatttaatgttcactactaccttaggatataagtactgtgatgcagagtcctggacacagagaagtcagcaacttgcctgaggacagcctgcaggacacagcactgtgatttgaacccagagagtctgacttcagcccccagcgctcaactactattaattgaaagggcattgaagagacatgatgtcacaataaaaagaaaaaaagaaaagaaagcatgtcttcgactttctagtcgtcgtgctttgtatggattcttctttcaaccttgacgaaagggtataattaatctgtaattaaagtcatgatagtttcttaatacgaggaaatgttgtcattgcggttctctgaacacaagagggcgctgtggcaaagcttaccgtctgctcatcctctgccgcaggagggtacaacttcgtgggacaaacttcaaaagaaagatgccatttctaagacctcatttatcacctcgggatagccagtcttcatgcctttaaaatacagaataaaaataacacataaatcaacacaattacattccttcttgatagcatcaccagtcttcttgaggcctggcgtcaaacctctgcttcagtgttacgttatggggtgcgcatgcctccttaatacccaccttgctggtattctccagatggctgtcttcttagcagtagatggaattaagcaccataatgagggatattttatttaaatctgctttaaaaaaatcttccatgacttattcacatgtctggttagctatcacactgccattccatgtgatcggaaatgagaaagatttaaagaaagtaattgtttagcatgcaacggatgtacctcttttgcttcagatgagaataggcagcatagaagaactggggctgattcgtggaaggtttcccgtagctagaccctggaggctgtaaaaagtggtttggaactgtgtttaaaaaataataataatagagggaatagtgaggtacccaggaggagcagagagcgcctgttccagccatgggagcatccccatcagatacatagatgctcttaattaattaggctgctagtaaaccctcctgagtgtgcaagacaggaggaattcattttcaagctttaaaaaaaaagatgagtcttgggcacacagccctgtggcccatttgttattgtcttgttacccataagtcagcagttttcctctcctgttgttgatagatcttcccatacagttagatttgtttagaaagaaaagttttaagtccttgcaaatgattacaaactgaagaactggaaaccctggttaggaaacaattggagcactatgtatggcttaatgaaaggacacagtctttttaatccaccaagcctgaatcatcagcttggttaagactatctgtagaaggtgagcagagcacttcaaacctggctattcgcaagggagagaaaaaagctgccactgtccccttagcattcctctgctaatcttccatttgtattgcaataagtgtgctttggcattgagtgtgttttaaagctcctgcttagctggctgggggacaagaaaaaacaaaacctcaaggacactcccactcagaggcataaaaaaataaacagttgtttctgcttttgagaagaagtcacatgcatgtggctggcattctcaggtgggcaaaggagagtgctcggtagcacctgccccaaaccctccgttctcccctttttaggtcggaagagattctgctttcctatcttgtctccagttttcactcttagtccgtattttccctccccttttccactctgtccttaactcctctttccctctttcatcgttttcctttatttttcatctctttctttattccttctcaagggtttgccggtggttttgctaggcaatactgagcttcaaggccattgtcatggaagtttccagtcctgggatgtgcttagaccagcctttaactatgcatcctcaaaacagctggcagcctaatcaaaccttattttttttctctttgtgagagaggtgaagaagatgataacatgaaatgaaatctagggcctttagaaagagtcagcaaaccaggcgcagtggctcacatccataatcccaacactttgggaggctgacgtggggatcacttgaggctaggagttcaagaccaggctgggcaacatagcaagaccccatctcttatatatatatatatatatatatatatatatatatatatatatttagctgggcatgatggtaagcaaccatagtcctggtcactcaggaggctaaggcaggcggattgctcaagctcaggagtttgaggcttcagtgtgctgtcattgtgccactgcactccagcttgtgtgacagagtaagaccctgtctctaaaaaggaaaaaaaaaaaagagttaccggttatacatttttgagaggagcaatggggaaatgcaatcatggggtaataataatcaggacaagagcaggggtatgtactgtcccccaccctgctgccctaaatgcgaggaagaagccacgttgctggacccataatgagaagcttcagaaggttgatagagagtgctgatcttgaagacatttagtctgggacacagactacatatcagcatgtcaaacatatcagcttgcttgaatgaatgagtgaatgaatgaatgagtgaatgaaaagtggtgaaggaagaagatggttgggtttgggagaagaatatgcctgaaagatatacaaccaccggggagtctgtcttgtctttacagatacttaactcgggaacagacttgctggttgtcttgagtgtgaagtgcaaaaagtaaaaatggccctcaacaaaaatataagtcaggcctgtgttagagatgtcaaggatgaagacctttatgatgatccatttccacttaatgaatagcgtcttagtccattttgtgttgctataatggaataattgtggctggggaatttataaagaaaagaagttcatttggttcatggttctgcaggctgtacaagaagcatgacactggcatctgcatctggtgagggcctctctctcttgcttcctctctggccatgtgatctctggccagagaggaagcaagaaagaggaggaggtgccaggctctctaggggaactaatagagtgagaattcattcacccccgagggagagtattaatctgttcaagggtgacctgcacctatgcctcaaacactgcccattgggctccaccttaaacattggggagcaaatcttaactttagctttggaggggccaagtatctaaaccatagcagagtctctttgtgatgatcttgagatgaaattgtttgggccttggttcctgagaggggtcttgccttattcagcagtcatatttttttctagataaaattcttactatcctttagacctggggagagcccgtgtatgaaaaacagaacacaaagctgaactttaaataggaaaaagctagcaaagggactacctctgggggcactacttgagcctgtaagcagtggttataggagatctgagagtacgggggtcctagagacaggtcagttcttagggtggggcaggatataagaaagggagagtgaggaaggctcagaagatgaggtttgaacacttggccaccattttgcctgggatcatcaggggaagctcctgatatgggaacatcactcccaggcaggacaccaagaggcaaaggccagtgtgctctatttagtaagaaggtaagataagggccagtgtgataagtgcatggagccccatgggcatccaattaataaaacagtgatggaccactacaatttaaagtcctttcttagatgagctaggcaaaaggttctaattagagatacctgtcttcccctcttttccctataatgcatccaaagatctcaggtgtaatagatttgcagcttgtgctaagtagttggccagagtgtgctggcttctgtgacctacgtctctgagcggcccgagctgtctgttggtgttatcctgagctcgttgtgggaaggcggctggagcagggtgtgctgcccatctgtggctccatcagtttccataaggcttcagcttgatcagtgcagcacgaactgtggcatgtttggggcttgggagattgacagccccccaaaaagccctcaaaacatggtcaagaggacaaacgagaatgatagacatatcttcactattgccagcctattaacctattacaaactctgtttttagagattagccattagtttttccttccaaaattattatgctgttgtcatttcctccacaaactgagatatgcctggtgaaatgacttaatttaaaaagtaatttagattatattttaaagaataaatattttcttcaaacttatctgattttcaaacgatcatgactttaattttgctctagtaatgcactttctgagaataaatgggaatctcagttttgtaatatgtacccagcatttttcttcttacagctattgggggtgcactgttggggatgtggtgggggctggacctgtgtggaatagggcagatactgtgtgcgggtctccacttctcaaaggagcttcaaagctgactgcactcattgatgcagcgagcccagggccttgtgatgttccctttcttgttggttggtgctggaaagtctagagtcacagactccttttggactaggctataaatgcatatatactttgcagagcattgcctattagtcgccattctctcctcagagtgtaggcaggttccgagggcagcacctaatgtgggaagagagaatagaaggttctggggaaggggacccactctgggcagagggagaaggataaggaggtggtttggggaagaatcacaattatccttactttaattaatacatttccttggatggcaccaacagcgaacacagccacacactcttctgcccatagtgctaagcgggttctctctttgactagaattgtgtcgttgatgtggaagtgcagttgaattcaaacgatctgtagctggtggcttttattcctgaagttcaaatatagacaaccctcttagcaggttctaccatagttagccaaccatgtgttaatctccgcctctttgtcttctgtcttaaaggaagtcaggccaccctaaatcgcggcctctcatgtgtgcctgactgtggagagtgtgattttccagcagtctctgggtctctataatgtttgaatttgcctttggggtgcatgcgtgtggtatgtgtggcatgtggggtcaggggtggtgagaccagctctgaattgtttccagggcagcttggtggcaccctggccagatcctgcatgtgacatttcccaacaactctttctggtctgtgtctcacctgtcataattcaaaggagagccatggactgtgtgcgctagattcaccttcagagactggagagtcccatctctgtaccaccgtggacacctggacttcctctggctttctcttgggaactctgccaggcagaggccctcagccgtgcagtgggacagttctgtgggcagtggcaggaagccttcagtcggtgaacagcgtgaagacagcctgatgcatgcaaggcacggggatgtgattgtgtgagcagatcaatacctatatctcaaaaatgagaactttcactttagtacttgatcacttaccctattgaattatgtaagtacttcagtctcttcaacattggctttctttcattctttgtttttttaatctcccatcttagtaatgaaaaaaaatgtatgtgtcatgtggttcttttgtaaggttatttctctccatttgcttgaaaactttcttattactcctaactccttttattgatttaatgaaaccaaatgctcctgaaagtttgaccctgatctagtgatacctgcactctctaggtccctaaaagaccccacagtctgatgctttggctgcagatggagtcacagagatgattcagctttaaagtgtctacatcatagattggaaaatgcctttctagggctgaagttgtagctgtttcctagacttctgtttattttccatttctttacccactcctgtttgaaattctgctgttgtttgcatactgtttgcctttgtgtccctctttccatctgttcttaaaaaaaaaaaatcaactgagttttattttaaaccaatccagatgacaggcacacagtcttcacaatgctttggaaaccagttgaagaaaattctcgttaaattactcatccacccaactcattttccatacatgatctattgttggggtgcctgcctgttttcaagataagtgcatatttcagaggcaggttccttttaccccagataagcaattatttaagaaattggctttgacatacattttcagttttaatttttccttttacattctgaaataatctctggttgcatgtagcttcccactactgcatataaagatgtattccaggcatccgtcaggagtttgtctattccatgaagaagacattgctgtggaagaagatggtgggaggcctgatgtcctttctgtgcagccctgcaagggccttcacctccagggcctaatctcacaagcaccgactctgcactcagatttccgacaagaacttccgctgtaaagtggccatgttaaggagaccttgggaagaacaaacccattatctgatattgagtcactatgaaagatttgggagtctttcccattagtgccccggtaagagaggcacaagaggatcatgcaaggctactaatctccatttcaaagccaagaagaggtcatcgatttatagtagggctgcagatcagaagcaaagcagacttcagcctgatagcagtcaaaagacttgtgtttcagcccctttctatgatgtcctttgactagcgccccttcctgtgtccctcccctgcattccatagcattgggtcttctacaagggaccaattagtgatttgaaaaccaaagtgaatagagtacttataaaatctggtggtgcactcacaggaggaaatgagttgggagggtttaggaattgtaaggacaagtttactaatgagaaggcaggttaggaatatccttaaggaaaatgcagatgacaaatttccagctgtcaaggaaaacgggttcaacctcataattagatcattcgcgcagagccaaggaactgcaaaacacatggatcttcactgccatgggagactgactctaagaagagaaagttgtcagaggggttctgtgtggaaaatgtaattggaatccccaaattatgacttctatcattggaagagggcatcttaaataatttttttttttttgagacagagtcttgctctattgcccaggctgaaggctgaagtgcagtggtgtgatcttggctcactgcaacctctgcctcccaggttcaagcaactctcctgcctcagcctccgagtagctgggactacaggcatgcaccaccacgcccagctattttttttatttttagtagagatggagtttcactatgttggccaggcttgtcttgaactcctaaccttaggtgatccacctgcctgtcggcctcccaaagtgctgggattacaggtgtgagctaccgtgtctggccttaaataatcttttattttttatttttgagaaaaagtctcactctgtcaccaggctggagtgcagtggcacgttcttggctcactgaaacctctgcctcctgggttcaagcgattctcctgcctcagtcccccgagtagctgggactacaggcgcacaccaccacgcccaactattttatttttattttttagtagagatggggtttcaccatgttggccagggtggtctcgatctcttgacctcctgatctgcccacctcggcctctcaaaatgctgagattataggtgtgagccaccgcgcccagccaatattcttaaatagtgatgttcaaacacatggcctggccaaagacttcctaactcactctcattgatttttgtcccttccattcaaaaacacttgttttcatagtcctgtgcttcaaaacgataaaacaatttaaccctgtattaaccatctgaattattaagaataccaggctgggcgtggtggctcacgcctgtaatcccagcactttgggaggccgaggtgggcggatcacgaggtcaggagatcgagaccatcctggttaacatggtgaaaccccgtatctaccaaaaatacaaaaaattagccaggcgtggtggcgggtgcctgtaatcccagctactcgggaggctgaggcaggagaatggcgtgaactggagaggcggagcttgcagtgagccgagatcgcgccactacactccagctctagcctgggtgacagagtgagactccgtctcaaaaaaaaaaaaaaaaaaaagaataccatagcattaagtgagataccaatgaagacatgaaaaaaatctccatcagaaactagggtggagacatcgtaagccctcaggatccaggcagagcatcatcaggatgtggccatctggttctctgccaaccttatgctgtcctctcacttgtccaacccatggatatcaacattgatagaaaaatcaatctctatctttgtaaaatctgccctgtctgtggcaagctgaatttttattaagctgtaatgtttggagtagatgatccaggatgctatggtcagtgatggggagaggagaagactctgcagctgaacctgtggggatgtgagccaccagcccccggccctggtgagtgaaggccacctgtcagctgagtaaggggacatgagccaccagcccccggccctggtgagtgaaggccacttgtcagccgagtgttagacagccaggggctcctcatcctgctgcctgggcgctctggcaatgtctgctgctgtaaggatggccagctgcctatcaaggtttgaaatcatgagcagtattgaccaccccttgggtacttgggcaattcacttccctggccttgacctcacttccctggccttgacctcactgttttctcatctgtaaatgagaaaaagagttgagatgatctataaatttccctctaacacatctaggtctatcattatttaaacatattagtttgaaggaactaaactgtactccctctgaattaccaagtacaaggctccatggtcattttcactctcctgtctggtgacagcaggtgtggcttggctttgctcttctccttccttccaactttctcctaaggtctataatggacaacttagatcattcacaattcccccacacagtttggcttgggaattggggccgcaaataaagaggacaaaagagggaaaaagcataaagcaaactgtaccagaaggtatgtgaatggcgaggacacgttggctaatggggccatggtgtagcccattaactcagcttcctaggaatgctcttgaactagtttctatttggaaatgactgataaatgtgggctgaaaaggcccgagagccccaaaatacagcaaggacactctgaaggaccccctctgatatacttgggatgtgtgtccctgcccaaatctcatgttgaaatgtaatcttcagtgttggaggtagggacctggggggaagtggttggatcatgagggtggatccttcatgaatagtttagcactatcccccgcattgtactgtcctcacgatagtgagttctcatgagatctggtcatttaacagtgtgtggcacctccccgcttgctctcttgctcctgcttttgtcatgtgatgtgcctggcctctttttgccttctgccatgaatgtaagcttcctgaggcctccccagaaaccaaggagatgccagcctcatgctgactgtaaagcctgcagaacaataaaccaattaaacctctctttttaatacattacccagcctcatgtatttctttatagcaatgcaaggatggcttaatacaccttcccatctcatatgtcttttaacatcttaagttcatagcaagatgtagcaacagtggctgcagcctacagagcaagcttgccttttgtagaaatggtgtaattgccactgacccgtgatagttgcaatctgggttttaaagctttgtgtctgaacactccacacgttttagcattcctgaatcctagaattcagtgctgcaaatgagtttcaagagggtttatggttttcaggggccatagcaggctgtctctgaagccacaacagaggtgggcaggctacagctggagtaatcatgactgattcttttctgctgctgcctcagtgacaggtgtgtggatttactttgtccctcccacctttctttgcttcccaccctcattgttaatggtaaagcaaaggcttagggtaatgggcagggtgtgtacagggtgcccactgctaaatggttccacctgggtggagacaggcctgatgggagccacagaagagtactgatatcatagccatccaaagggccactctggagggagagcggagagcagactggggttacatgatcagtgggtcaagtcagcagtcacaaggaaatctccccaacaagtaaagaactaaaaattagaaggggaagatttagtttaatataaggacccatttcttatcaagagctctgtgacacctaccattctcaggggtggctcacatgagcccaccttcttactgcagaggccaaccttgtacagccaggaaaatttactggatgttcacagacatctttgttgtatattcctgacataggttattgacaagcactgttacggttttgagcaccaagagaaaaaggtcatgttgtactagtgaatcaacataagtgtaatggctaaattcaatgtacaatgggactataacttacctcctttactgtttaaagaaaagtcaagatacacgcatccagaattttgtatttttatcttgttggcagagggaaaaaataagtattgatgtaatcccaccaagtaaaggttaaggtactcaagttaggctgcttgcattcaagtcctatttctggttcttactaaccagctttcaacgcaatacttgaataccatgaatttctggttcctcttcccattggtgttcagtggatgttaggtattaatgttattttaggtatactctatgagactgtatggtacagctgcccactatcagcctattggtggaacatatatgttcagatcagtttttttcctccatgtaactttgcatgattgcatttacatttaaaacaaaaaacacaactgaagaataggaatgcatgactgatgtgcatggaatcagcttatttcgactgaacagatgaaaataaaaaatgacttaatagctaaattcaaagatataaaatgagtgcatggtaaatggaaattgagtggtaagtatctcaattcatattcactgagggcaagatgaagacaaatgaactcaaattgcagcagaaaggaattaaacattaagaatcaaacttcttaacttcagaaaatagtcttttgaaatgtctgatgcaaagaaatgacactgataccttaaaacagttcattcttttattaatatttattaagcatattctatcaggcaggtgctgggctcggtgctgcagatacagtgatgaacaagacagataggcactctgactgcatggcccatagtctagttggagaggaaaacttaaaacaaagacacagacaggcaattataaattgtgacaagtgacatgaaggaaggtacaagagtgtgaaatggggcacctgaccaggctaggggcagggcacagagagaccgccctgaggaagtgacaagttcagatctgagggacagtagtaacagatggggagaaaagagcaccagaccctctgaacaagcaacctgtgcaaagactgcaaggccgcagggggttgctggcttcaagggatggagaaaagaccagtgaggtcagcagagatggggagctgagaggggtagccctgggttcaagacacaggcaggaaccagactaagcaggttcttgaagcaagtgaaggactttcatctttatataaagggcaatggaaagttgtcaatgtcattgtcattttttttaaatgccttttttactggagtgtaatatgcatgcaagaaagcacccataggggtgagctgggtgaatttcattgtgaacacatcaagcaaccagtaccaaatcaacaagcagaacattattaaccccccaaaagtcacccttagcccttccaagtcctcagcatgttccaaaggcaaccctatcctgactggtaacaacactaggttaattttgaccatttagaaactttatataaagggagtcataccatatttattctctgtgcctggcttctttcactcaacaacatgagactcatccagattgctacttatagccataaatcactgtgtgaatagaccatgatttaattatcagttttgctgttgtggacatttgggtagtgtctggctgtttggaacagtactacaggttgagtatcccttatctgaaatgcttgggatcaggagtgtttccgatttttttttttttcagattttgaaatatttatatgatacttacttgttcagcattcctaatctgaaaatctgaaacgtgaaatgctccaattagcatttcctttgagcgtcatgtcagtgttcaaaaagtttcaaattttggaacgtttcagattttgagattagggatgctcagactgtactatgagctacttgttgattctatttcacctgatcttcggtgtttttctaagagtggaatttctgggacttaaggtatacatatgttcagcactaatggatcctgccaagcagttttacaaagtggccatttcaatttgtactcccaccagcaatgcatgagagctcccttaaaaggtttgctatagccagtgatgtgatcagatctgtgcttttcaaagaccatatggcctcctgtgagcagaatgggctaaagaggcaggagtgcctggaaggacctgtgggggctgtgatggtaggtcaggcaagcagaagacagggaaaggccaggatggaaagaagtacatggacccaggagagatgggtggggaaatggctgatgggctcagggaatgttttgggtggggggcatggtgggcaggagaggggagaggtgacaagaatgaccctgttcaagacataggcaggaaacagatgggtggtctatgattggttagatggtagtgtttgaactctggagatggatcagagatggggaggtgtggatcataattctagtgcattaagagtacataatttgaggtgcattagctatgtccaagtgggaatcaaggaagcaattagatacagaggtctggactcagagtgaagtcccaatggacatgcaaactggagagtcattatagcaatatgggtgagtactatggtttgaatgtttgtgccttccaaaactcatgttgaaatttaatccccaatgtggcagtattgagagctggggcctataagaggtggttggatcatgagtgctttgcttttatgagtggattaatctattcatgaaataatgagctaatgggttatcctgtaagcgggactggtggttttataataggaagagagacctgtatgtagtatattagcatgctcagccctctcaccatgtgctaccttgagactctacagtgtccccaacagcaagaaggctctcaccagatgctgcccctcgaccttggacttttcaatctctgtaactgtaggaaataaattccttttctttataaattactcagtttcaggtattctgttatagcaataaaaaccagactaaggcaatgaggaaatgtcacctgggttgagagtagtgagaagaatgtctcattttgttatttcttagtttgagagcagttattcaaattaaagtttgaatatttaaaaaaattttgctcttgattttatttcaagttaaagcttcttaggcatgtgtttatttgtagggcagagatgataacactgttataggaccgacaggttcgtatgcccactgcacagtaatagacccattacatggagacagcaggatttgcagcagaaaaagagttaaaggtcagtgggcaccaagtagagaggggaggagaccctccaatccatcttcccaagttgttctgggttggagtttttaaggggatcatggagagcaaggcaaggtggggggggtgaaatcatcgggatgtggaaactgtattcttgggtgggtcagctcctaagggatccctcagaccagctgagtcagccattccctcagaatgcaggacctgaaggaatatctcgtaggaaaaacttaacgtttcatgatgttcaaggtgttatcaatagagcagttaaggggaactgtgatctagggtctatgtgattccaagacagtaggcagcaaacaactctgaggaaggggttggagcccaggctggcctcatgattagcgccgagtgtgctgcaagctgggtttattttcctttctcccctctctttcttccctgacgaattttatttaaaaaaagtttatagggatggtttcaacaccatgctgtgggcaagagaagagagataccttgttctctgctgcagggcaccacagtcaccaagagtggactttccctggcaacagggcctctgcattggtctgcttgagctgccataaccaaagaccacaaaccgggtggcttaaagaacagacacgcattgttgcactgtcgtggaagttagaagtctgagaccaaggcgatggcaagattgcagagctctagggaaggatctgttccaggcttctctccttggcttgtaggtggccgtcttctccctctgtctcttctcatggtcttccctctgtatctgtattagtgtccaaatttctcctttttattagaacccagtcatattggattagggcccactctaatgatcctgtttgaactctgattacctctgtaaagaccctatccccaaataagttcccattctgaggtcccaggggttaaggtctccaacagaccttttatggaggggggcacataattcaacccatccacactcccagccagggtcccgcttcaagacgagcacctcctcttccttcaccatgcactggggcaggtgactctaactagtgcccatttcgtgtctcattctggaaactatgccgatcagtcaaagtttccagagccagtgaaaatgttctcatcacacgaggcttctgaacacccagaaattttgaagcaagaacatgacaataatcatcactctcattcactgtgtgccatgtccttgcaagttcacagctagcccttacaacagcctgcacaggtctgattttccactctgcttcattgatgagcatctgagacgcgggagcataagggaacttgcttgaggtcacatgcttggtcggtagagactcagggtctgcgcccaggcttgccagcccatctccactcctccctgctgtgggcccagggcacagcggccacaggaggacttggctcttctttcaggctttgcgggcacagattagctagacagagtaaatatgggcatagcgattgttaacggctaacttttgggtgaatgcactattcttgccatctcaggctgatttatttgcagcactggtagtcagggtccctatagcaagggaagagataatctctaaatattccctggagccatgagaaacggccaggtaaagaagcatccttctttcagctggaacacggcgatgttttctgtcacctcaaatgaggtgatctccagaatcccctcaatcctgtctcattcattcaggcacaaaaaaggagaaacgtagttgacaggaattagatttggaaatctttcagagaaaatgtgtttgatttttctgtcccacacctcagcagtttatttcacactgcgcttattggtctctttgtctcacttctccttacataaatcctctgggtgtcgtttgaataatcaaaacgtattagatatgaaacataatgtgtatcatgttgcatcatgctactgtacctgcatgttgtaatttgtaccttatttgctgtctatgcaatgaaaaggctttcaagtttttaggtcagaaaggtttaatcactgtccctagtcaggtttgcagcacagagccaaatggatggtgtgcatttggacctgcccttggaagtcaggctgtgattagctagggcaaaagtttccttatctaggtgtgaacgtggaatggcctgaaatgtgtggacagtctattatgtgttcatcactgtgcataatgatgggcctgtagggatgtctatgacacgcaggatacagggctgggcacctggttgttggtatcagatatgtaggagaagaaggaatgggtgggggttggagagaacacaagcacaagcataagacggttctgctcccaagaggctcattcgtcactcagtgctgtagacacacgggagctgccttagcacagagcgacagatgccatgagacaggcgcccactgctgatgtgggcagaaagagatgtgcaagcgaagggcaacagatttggttgctgagattaataagaggaatcaagaaatgctcccaagagaaaaatgatacttaatctgggtcttgaataaccattcattcattcattcattcttctttctctctataatattaattagatttctgctaataagtacctagaaatgttctaggtgtaggaaattcagcaatgaacaaaaaaaacccaaccctccccccagcaaccccttgccgtcgggagctcacattcctataggtaagtggtagtggtgtggagaggggctggcctagtgaaaggaacagtgccagctgttgcacagggacttgtgatgaggttggtgtgagtgggtggccatgtggggcaggtcagagaggaggcatcgagttgccaggtgctgggtcccacatgaggagtctgtgtgccaagccaaagagctttctcctgaaggcctcaaggggccactattggtctcagcaaggtgggaggtcatattgtcagacttgtgctgggcaggtgggtgcaggttagaggcaggtgaggccacaggcagggagcctgaggcctggtgagagctggtgagagaaattcaaggtaaggatgaggatttcaggatgagtctcacttgctggcttctctaactacatggggatggtgcaattgactgagggtaggatagaggaaaaggatcaggtgcaggagaaacatgatgcgttcagggttagccaccttgcttgtgaattctagaattctgccagcctcacctgagagcccctcagaagtaagaggggcttcttactgtggaggaagtgtcagaatgccaaccaaagatggccagctaaataaatgacatgcctggtggtctgacatgacaaatcctgagggtcccttgcccagggtgggtggcaggggaatggcagttcacattcaagatctaagttttgagagatgagaatcatctcctttggggtggggcagctgcattccacactcgggacccggccactcagtgcggggtgatggtgcagttcccagggactgatgtacctgctctgcagtggcaacctccgagtgtgagagaacccagctcttttttggacaattttgcatctgactcattgttggtatttgataacatttgttatgctaatataacaaatacaataacaggaaaatcagaaaatccatgtgtactcaatgtttagctcccacttataagcgagaacgtgcagtatttggttttctgttactgcattaatttgcttaggataatggcttccagctccatccatgctgctacaaaggaaatgatttccttctttttttgtggctgtgtagtataccatggtgtatttgtaccacattttctttatccagtctgcccatggatgggcatttaggttgatttcatgtctttgttattgtgaatagtgctgcaatgaacatacgcgtgcatgtgactttatgatgaaacaatttatcttccttcgggtgtataagaacaatagacgctggggcctacttgagattggagggtgggaggagggtaaggattgaaaaaccacccattgggcactatacttgttacctgggtgatgaaataacctctacaccaaaccttcatgacatgaaatttacccatacaacaaatcatacatggacctccgaacctaaaataaaagatggaaaaaaaaaaaaagaaaaccagaatataatctgagttctgtctttgtgtgatccggttttacaggaggaattaacctgggatgggggaaagaatgcatttagtgctggaatatataaggagaggctttcctttgtcccctcctctcttctctctcccccaggattttttgtccttccgtgttccacctgatccatggccaactggctttagaagttgttattaatagttcaccatgctcattttcatgaaacagagggaaaggcagcctcttcatttgatgtctagttagcaaaccagaggtttgacaccagctggtcataacagacatttttaataaaacttacctccaagttaaaataaaaatgctgccttagagattttgtcctgaaacatacgaaaaaatgacaggtgggatctctcatgcaaaacttctgctagggctaaaggaaaatatctgataaggttgtttgcccatgggggaaggattaattggattttctgtcttgcccctagtgtctgaccctctgttattatgacaggaccacagaagttttgaacgctgaatcatagtttatagttttagcatttttgagctatggagataagagtgagggaaggagtgtgataggggagtgagttcccacaatactccggtgatagttattgtctgcctgaaaatgtgaatacatatattcaagcccgatgtagcctgttcgaagcaacccagccgggcaatgaaagcctcagctgaagatcataggattaaatccaggctcccctctttcaagtaccttctcatgctactgcatttatgtgggtagtctgggattatgtctgtggtttgtttcactattttctggatcacttctgaaccagtccgtgtgtcagtcctgtggatatgcatttcatgaatgagactctgaggaattttctaatagtgtctatggtggcagtgggaaaaggggaggaggcagagaaagaggtggtagcaagagaaagaactgtgtggagctcgagctaaaagcaggagctaagactgcaagatcaaatgattcccactcagttgtcctagtctctgtctttgttttctgtggccataacagaacaccatagatttggtaatttataaagagcagaaacatatttcctcatcattctggagactgggaagttcaagatcaagggctggctcaacagaaggcctcttgctgcatcatgccatggcagaaggtggaaaggcagagagggcaagagaaagcaagcaagggggggccaagttgtccttttctaatgaaccccctcccacagtaacggcgttaatccattctagagggtggtgcccccatgacccaaacacctcccattaggccccacctcctaacactgccacattggggatcagatttccaacacattaactttggggacacattgaaaccatagcactcccctatagcaatgagtaatatccgcatagtgattttacttattaaataatattgacatggcttcctctttatggtttgctagtggtaaatcttcaaaactcttgggtagtttctgtggatataaattccaggtgaggttagttgttaaggaaagaatttccatgaaagaaaaacgtgtctgagttttgaataaggaaagacatacattgtgggtaactgaaatgccattttttcactcctccttcccccaggctctaaataccattgctgaattgaatccgtccagtttgcacgtgtgtctacagacatgtgtcttatggaatacaaacaatatgtgcttcttcttaaggttttgttactttgtcccttggtggtaagttttacaaaatgatttgaaatactcagcgctcaactccaaaagccaataaaacaggaggaagacattgggtatgatttggaaataagcaaaacagaacagacctgactttctttctctttcttcctttcttccttcctttctttctttctttctttctttctttctttctttctttctttctttctttctttcttctttctttccttctttcttttctttctttcttttctttctttttttttttttgaaatggagtcttgctctatcacctaggctggagtgcagtggcgccatctcagctcactgtaagctctacctcccgagttcaagcgattctcctgcctcagcctcccgagtacctgggactataggtgtgcatcaccatgcacagctaatttttgtatttttagtagatgcagaatttcaccatgttggccaggatggtctcgatctcttgacctcgtgatccacccacctcagcctcccaaagtgctgggattacaggcgtgagccaccgtgcctggcccagacctgactacttgctagtataattttattttaagtgcacgttattattctgctttctccaatatcagacagctggttccttcttgaagcaactcttaaagacagatggaccagccatgtcttcaaagtgttggcttcttctgtggctcccattttcccgtttatcctagtgccttgacttcttcacttgccaacctccgttctccctggcaccaaggagttatgtagcgttgacttgttcttttccatttgaaggtggaaggatgaacataaggtgccagactgggctattttatcatagacagatggatttgctccattcatgtaaagagttccttttgtagaatatctgaatcctggtatatcctttagatggatgtataatccctatccccacacttttctcccaaacttgtgagttataccattaagtctacaggactgggcagttacgacctggacattagtccagttttctgtattctactacaaaaacttgtttctgttgtttaaaacatgggattatttgtaagttatcactccagaaatgaacgtaactgaatttgctgaggatttaaactaattacctgacatcaaattggttcaaggaagtggggaaaataaagcaaggattgacaactactatttgcttcattctaattttaggccctttaactttaaaggtgaattattccttgttttattcttggagtatttattttatgaatacgtgaattacaataacaaaacactataccgttgtgaaagtgagtgagctacagctacacacaccaacatggataaatctcctataaatctcatcatgtcagcgagcaaagcaagttccagaagaatgcccacagtatgagaccaattatttggtttgaaaatatgcaaagcagcattccatatgtcttaaggacacatacatatgaagggaaaggataaatccatgatgggagtgataatcccctaaaaatagttacttgtgggggaagcagtggagcagaatgcaatctgggaagggtactgagggagttcttatgcgatagtggacagggatggatttatgagtcaagaagagcaactgcacggcgtctggaaggcgtgctggccctgggctctcaggtggaggctgtttgcatgatcagcagataggaaggtaccatggatgcaggagtggtctgaataccagagcaggcaagccaagtgagcaaggggagggagacgagaggtgccaggaaaaccctgtctcatgagaagatgatgatcctagaaggcttagaagagtgtccaccccaggccaggtgcggtggctcacacctgtaatcccagcactttgggaggccgaggggggtggatcatgaggtcaggagctcctggctaacacggtgaaaccccatctctactaaaaatacaaaaacaaaattagccgggcatggtggcgggcacctgtagtcccagctactcggtggctgaggtgggagaatggcatgaagccgggaggtggagcttgcagtgagccaagatcgtgccactgcagtccagcctgggcgacagagtgaggctctgtctccaaaaaaaaaaaaaaaaaaaaaaagagtgtccaccccagtgcccccatccacagggctgctgctgctgagcacccatgcccttgggtgacccactctcctgctcaggggcccagaggatgcttctttcttcttcctgggcactttcccctgagttttggtttaaaagatagaattcccgatgaagccagcttgctgcagtcctgtagccccacatctccatatgcgatcctttgagggaggctgagcatccctgcatctctgaatgggagacatgtttccaccttggctcctgggggcactggggccattttcctggtgttctgagcactctttctgcagaagaagacactctcagatggtagattttgtggatttcagtaagtagagtccttcaggagtctctaggcagaaagcacctgagttgacagcaagaactgagagttctgggtctgcctctagatggctgtttgcctattccagcctcactgtccccatatccagatggaatgacatgagcatatgggcaggacaagccacctttgtccataaggcggggtacacgccaccaagactaagactgaagcctaggcaagacttagagtatttgtggcttcagagaaacatcaaattgagaggaagatcgagtgataggaaaactgaagccagagaagtaagtattttgtatgtagagtatcattttccaatcatcgctggtgtgataaaacagcaaacgtcactgcttattgaaagcaactagacagtatgtttggtgattggattacaagttttccttttagataaggagagatttaatctgtttctggactctttaggagcacccttcccagttttacagttgagggactggagaccctgagaggtgaaggggcctggctgcactcacagtggaagtgatcccactggatctcagatgttgagtttctgacactcaatctagagctcttcttaccacacatgcttcagtctacacagttctccccctctttttttttcatcttctcatctactgcccttattctctctctctctctctctgtaaaacatgtaggggctgtcatagacgacactgtgtgagcggaagttgatgacttcaattgtgacaaatatcaggagctcctctcaaaaattaccttcacaaaagccttttagaaaagccatgttgctgtcacatgtagctataatttgggttgtgctcaaaagacttaaattggttaataccgaagggaggtgtggtttattctgtatttgttgttctagtacttcttgggtttgggggctgctgttatgagaaatggcttctcctagactccagaatgtgcttagagagtgtttttctctttgaattgctaaaaatgttatttcctctctcctggatttttcaaggtgtgcaataagttgtgtagttgctgctctgctgcacagagctttaatataaactgcgtattttcactctgtatgtgtgagtaatctgtgccttctatggctctgatcgtgggtaagcaaaaaacacagtgactgctgaaatatagggatggaaatttctttgtcagtaaagatcctatgaaatcatatactgagcatacgtaaaatatggaattgtctctgcagtattgatcgagcacaaatccactttcgtaaagcaaaaataaaggtcaaacagaaaaggcacatcactggtttttaaaattttttgaataataagtacttgaaattccttaaaaatgacactatatatgatttaacttagatagctagaatagtcaaatacatagaaacagaaagtagaatgcttattgccaggggctccagccctggtgagggaggaatggggagttaagtgtaataggtgctgggttttagagatgttgacaaagttctgaagatagatggtggtgatggttgcacagtagtgtgtgggtatacttgattccaataaactgtacacttaaaatggttaaagtggtaaattttatgtaatgtatatttaattgcaataaaaaggataaataaatgataccatatcctcgtgatttcagatacatctcttacttactgatcattcctcctgagaatgtgttctgtctccatgctgattatgtttcctgttctcttcctttgggtgctgtgttcagcatttttaatttttttaatagttaatgctatgctcacattttcctcccgtgacaaagagtgggaataagcgtggcacatgtgtctctcaccatctgtttgatagctgcacagaagccttaggaaactgagggatagacacgctcccactgagttactcaacactgctgcttccttgtcctctggctgaaggctaaaccctgccttctactgtttacaacaggagtgtccaatctttcggcttccctgggccacacttgaaggaggagaattgtcttgggccacacataaaatacactaacactaacaatagctgatgagctaaaaaagaaaattgcaaaaaaaaaatctcataatattttaagaaagtttacgaatttgtattgggccacattcaaagccatcctgggctgcatacagcctctgggttggacaagcttggtctaacatatagtgttaataggatatttgaggtggagtaagaccaatagatcaggaggtaattgccactgaaaacatagttaattactcacagatcctgtgtcatgccacgtgaggaagcaccagggtgggtcaggagacagacggagcagggaaataaggtcaagagactttattgtggtttctgcaggaaggaatgctgagagagagcaagcccattgaggactgggtagtttgaataattccagtgggctctgggatgtaggggctgcccctagttgtttggtacctggtctggggtgattagggcaggggatagtggtcctgagtgtaagatcccaataagaggagttgttgggtggtgtgggcgtcacctgctgttccattggcctttagccagggcctgagagctgggtcaagataacataatttaaaaaacgatattatacccaccagactatttcttcctggtagaaagcaccacagatccatatggacttggatggatctgtggacagattccatgtttgagaagtagccataacctgcggccttcccctttctacaatgcagactccatcctcagttcaacagaagtttcacaggtatctttacaggtgtttcctgagtcagccgatcaggtgaattgtttgaccccattgccaagaatatttctggctggaggttccgaatacctcaaagagaaagtccctgcttgaaagagtctcctgcccccccaccaccttagaacagttgctggcattgattgctctaccaagagaaaaatgctgatacttgacaaactattgacacacctgggaatggccacataatgttggataatgttaatgccacaggtggaggacgtgggtgtcaggaagaagaagcagtatatgattccacaacagtaatttcattcttcaagaagattgattctattgggaatgatttttcccattaagcatgaaacacagagaattcttggtggatccattcatttagcaagcagttttgtggaagacagcatgtatgactgccaagggtgtggggtgtggtgtccaagtagtgccttcatggctccctcacttataaactgtgtccttgagtaaactgctgaaccctgtggtgccttggtgtcctcaccaataaaatagaggtaaagatacaagctcactggtttcctgtgaggactaaagaacacctgtgaaaagattattaactatgttagagaggagggtgatgatactaattggaaacaaataaggtactaaaacaagtgagacgtgatcttcactctgatggaatccagtgggggaaatgaatataaaaacaggcaattataaaaaaaaaaatggtaagtctgctgatatggagtacactttctaggggcatcaggatagacaaacatagaagaaaaataatatttgatttgagccttaatggataaataaataaataaataacggggagaaagatgattcctagagtagggagtatctcatgcaaatgactgagaagcttgattaagttaatgtttaagaatgtggcaggccaggtatagtggctcatacctgtaatccaagcactttgggaggccgactcaggtggatcacctgtggtcaggagttcaagactagcctggccaaaatggcgaaaccctatctctactaaaaaatacaaaaattagccaggcatggtggctggtgcctgtagttccagctactcaggaggttgaggtaggagaattgcttaggctcaggtggttgaagctgcagttagctgtgttcatgtcactgcactcctgcctgggtgacacagcaagaccaccatctcaaaaacaaaaacaaaaaacaatgtggcatattaaaaattaaaatcacaataaaatcagagggtacattgtgagaagttaatagcaggagataaggttgaaaaaaaaacttgaacccaggtttaaaagaccttggatcatgtgtatatgtgcggttaataaaattcgatagtctagaaagctttaaatgcaatataaagaggactatcttagttgagcaggcacttattaaaattctcagcataaaataacagagtataggacagaaaattatcttggaaatttaataaaaggttatatattagtcagctcctgctttgataatgtagtataacaaacagcccccaaatctcagttgtttatatgaaagcatgtatttcttgctcatggacttgtgcgtcatcttgtggctttgccatgtgtttgtgggttgggtcagatctactttgagtaattctgggactgggctacctgcggggcatgctattctcatggtagactggaggaaggaagatagataggaagacaatcatacaagggcatataaagcctctgggtgggcgtggcatacgttaggaccactggtgttccattggcaaatgcaagtcacctggtcacatccagaggcatggggagatgacgcttactctgcctgtactgaagagaaaggagagaaggaggacttatgaacaatgaatacaatctaccactgatggtcattaatggcctcaaaaatatcacaaagacatgaaagccctgcagtggcttccaaggatcttcttattagaaatgatatgagggatagagcagtttaccacataccacaaacgtgtataccagcatgtgtatactagtttgggaattcgtagttttgagtatggaagtatgggaagtgaaaagaagggagaagtagaagtgttgggtgtggtattgcatacactggctggagacaggaaggaacaacgatcttctaatataaactttaaaatggtcccagagtaaagatataatagtgatcagagatttcactccatgaacatatgaatgtctaatttgtctcttgatatttaacttttaacatgaaatatttcagaaatatagaaaggtacagaaaaaaacatagtggacacccatgtatagtagatgctaacattttaccacatttgattcaagtgaacctatgagtttatttttagtgttgttctttttaattaagaaaatattacagatacacaaatgttgtatattctactattctactctggattgtctttttttccctcagtgtttttgtcatacaaaaaattttaaaacttttaaataagatgactttatcttttccttcttttttttctatttcttgtttaataagttctttcctactcccaggatcatgtgaatgttttctgtattttcttctaatttaaaaagttttgttctgtagctttactttttaaaaacattttttaaagtttccatctggaatttttgatgtgtttggtgtcagagatataattttgtctttttacatatcaatcagtatctaatagcatcatgacctctacagatttgtgtgtcatctgttgtgtgtgtgtgtgtgtgtgtgtgtgtgtgtgtgcatctttttataagtccccatactcttccattgatctgtttgtttctttctgaattaataccacactataattgctatagcattagaggacattctgatatgtggtatgacagctctccctctccccatcttatcacatgcacacacacacacccacacacacacacacggactgagcatcctttgtcttcaaagttgtcatgactactaatgggaatatttaatcaatttatatttaatataatgatgaataggtttgactttaaatctactatcttgctagtggttttctatttgtcccatctgttttttttttcttttttgctcttttctgccttcctttagaactgagtattttttagtattctattttatctcttttttgaattattgttatcccactttgttttattttcctcagtggttgctttagggttcattctaggcatctttaacttgtcatagtttcctttcaaacaatattattccactttatgtgtaagtatatctaatgaataatatatttaaaatttttataatataaagcctcataaatattttatatgtatactgtcactcacacactatatatcactacatatttgtatatttcccccatatatgtatctccctcatatatatgtgtgtgtgtatatatatatatatgagagagataaataattttacaacagcatacttacatttttccctcctgtcatttgtgttacagttgtcatacttttacttccacatatgttgtaaattcagatcaataaggttttaaaaattaaattattgttttctttcctgggataaactctattattctttaccactgtgctagatttttttttttactaattcttaaagcatttttgcatccatattaataaatggaattaactgtaattttgtttcttcatactatctttccccgttttggaatcaaggctgtaccagtctcataaaataactgggaagttttccatcttcttattctccctgggcatcatcctcacctacctgaactactgcagttgcctcagaaccggttttcgccctctcatccttgtcttacagtacacctttgccccaaattcatttcctacaatgcagtgattcttctaaaatacgcatcccttcatgctgctccctggtctagaacacgtcacagttcatggcttattgtcgtagctcagtaattccttgttttctggggtttctctagcatcatacaggctgaaatggtgtcatgtgattccagaggccaaaaggctggtgtggagtcatggcaactttcctaccactacattcccccttcctatgagtttcatcgtaccaatgatggctgttcatagccgactgcatcattttccatgaaattactggtgtggtgtgatctggggtcgcattcaatgggaaagatttagggaatggtcatgagagtggcctcctggatgcagtaacctgacataccctacattttccctgaacttggggtccggggcaggcttttgcaacaggggtatggtatttaaataatcagcataaaacagctgcccattttaaagctgtctcttcatagaggtcaggacagaactctaggtatggcttctactgacagctgctccttcaggagatacaaattatatgccgattctgacacttttgaaaaagaaacatatcaaatgcaacttttttttcccatttcagtttatgcttttcactgttctcccttcttctaaaaattgtggtgtttcatctttctgatgctcttctagaaagtgggctaaagcactaaaatataatcattccagtttcatagagccagacttgaggcttatagatgttgtataagtggctcagggacccaaaatatcttctgtggtgacccttgctttaaatctcagggctatgttttcttagactgtctgagcaccagtttcctcatagaatgtggcagattgaggaagattgtatctaaagcaccaacatagtgtctggcaccatgtcgttcagtaaatattatacctgtgaaatacatcaaatagaggcgccactgctgggaagtgaagtcctgcctataattgagtttaacaattccatagaagatttttttgaatactgatgtgcaaggtgactggcctcatgtcagattctgtgagtaaaacaaaggtaattgagcaatggttcccacccttctggcatcactgactgttacgggatctagaaacatacatgatcagacacgtgaacccacggggccaacaccacagcaggagtgaagaaggagctggaaggggaaggtggggattcagtttgcctggcagggcatggtaagacttcagaaaggaagtgacattggaggtacatcttgaaggatgagtgggatttcaacagacagaggctgtagggctgagcacttgaaacagagggaggacatattgcagccaaacctcggtgaactgacttgggtacgcttctgccagaataagaagaggtcttgaattaatagtcaaacctgatatagcttctttgtcactgtgtcttttccttgaaatgaatggagctttttgattttttatccttacttttctcctctctgggttacagtggcaggttgttttatcttcccctgatgaattgaccggtccagagagcatttcagttatcatttatggaacaaggccaaaatatttctttcacacatacagcgcagactaaatcgtctttttctttatcttttttttttcctttaacaacctccagcctatttgtggcatctgaaaaactttgcggcagcattttacagccatttattgtagagtctgttgctttgggctgctgtcagtgctctgacacaaagtttcccatctgattttgagctggtcaccgtgtgctgttgtagtaacagggcctcctggtgcattgaaacacctggtttacttcacacttgatcactggcatgttcaagaacagatagagctttgtctgtcatttgctctttttgggttagcttaagctagggatgttttattttaggtttttttcttaaaatcagagaaaatctagcttcaaaactcaagtgctaaaacaccaaaatagtgttatagaggcacattcctggggcaggggagaggtggccctcgattaaatatatacgagcaagtatttattgaatctcattttaaggacatttgcatttcatgagaagtgagaggtgtggttgctgccctcaagagacttataacagaactagggagaaagatacagccacattagacaaaacagcaagatgtaatcaagtgaaccaaagcagtatcacatgtacacaggagtgtgagcagagagttaaatctatgtatattcactttaggtcatttataaccttgacctccagcaaatgtttaacaatggttataataatatttcttacaattacacataataacccatccgtgcaaatgtctgtgtacttgggccctaaaaatataacatactgattctaggaagaatgcatattcttgtcactgttttcatgttcagaaggaactcaggggtgggccagttctggagtccatgcagctggacagactctggaaggtgaaggacccttgcccaggaagggctgaaatctgtgctgggcagagtgagtgaagggaaggatgttttgattgaccgaagattttctttaattgaacttgaatgggatgacaagaggagaaaaacctggacatttacttcttgaccatggaaagttttgaagtaaacagaacaccataaaacaaaatataatttgggaattgaggttgaaaatcaacaagtaaggttggaaagagttgttgaatgttctacattcacaaataactaggccgggtgtggtggctcatgcctgtaatcccagcactttgggaggctgaggcaggtggaacacttgaggccaggagctagagaccagcctggccaacatggtaaagtcccatctctactaaaaatacaaaaaattacctgggcgtggtggcgcatggctgtaatcccagctactcaggaggctgaggtatgagaatcgcttgaacccagcaggcagaggttgcagtgagccgagatgatgcaagtgcactccagcctgggtgacagagcaagactgtctaaagacaaaacaaaacaaaaaatgaaacaaaacaaaaaaaaccccacaaaaaacaaaaaaaaaagaaaccaaaccaaaagaaaaccaaatagttagatgagatggaaagagtggaggacagatcttaccaggaaatcctcagaacactgactactcagtgtggatttcccaaccagctagctacagtctgcttgtctctcctgagggttttcagactagtttccaaaaagtcaggaaaagggtagaattccaccttccgttccctatttggagctctgggacagtagctgtcacatgatagtatgcgtcagagtcacctggtgggcttgttggaaacacaggctgctgggtccctgagcttctgattcagtagtctcaggtaaggcctgagaatgtgcatttctaagacattcccaggagacacagatgctgctggtctggggaccacattctgagaaccactgcctttgggtgggtgtgggccatgacctccttccaggttctatacattggccccttgactcatcaaaagggtcttggtctatgctttgatctatgcctttccttcaatgtggctgtaagttttacctaattaaaatgctgcatctggtttggatgatctgattaatatggaggatgaaatttatagcaataagtactcagagctttgctcccttcccgatcaaagcctgaagtttgatttctttatacatatattttaataataatcatcattagtgctgaaattagagataaaatgtcccaatcatcccagtgtatttttagtttctaagcatgagcatttgattattgttttctggcgagtctgtcgtgtaatccagtaattgcaataaaagagaaaagtactttttgctaatatggtacaaatagttttgtccacagtgatcaaatacagagattttccattctatgttattttatacccctctctactcccctgcttcccaaaatagacacataatatatacaactagatttattggagcttctgatttatatgagactatataagtgatttcagtgtatctaggatagagattttgttcccagagtaaaagcttctgaagctgtgcaatgcaaataaaattattttatttattatagcattaacttaagatgcagtcttctgaatagtctagcctgtgtttgggatgtaaatttctcttgcaccctgctgcctttcacgtttgctttcagcagggactatagtttaatctttttcttcctccttgccccgcaacaggagatcgctattatcagctgacactgaagctcctaaaaaaatcttagctcagattctctttgtccatctgcaagctagcgcacattccccgttcatggaaaaataccactgcggtggagctttaagtcactgctgttctgcaagaaataaattttatcacaagaagcagtgggtgcagttagaaaaagtcatctagatctaagggaaggcttcaaataattctcctaattggcctacgtggttcactagtagaaaaacctttcgtttttgtccttcaaaaacaaaactgagagagttccctggagacattagtttgctaaatgacttgcccaaggtcacctggtaatatgaccaagtgaagaattatgggtttgtgaaccgttatattcggtataaggccatattcttttgttactttcttaggaagagaatcaatggcttgtttcagaaagctttgcaaggaatcacttactcttctgccatgggaaaaattgtgtatgccagatgcattttgttcatttttaaagagctcctcaatgctattgctgatctcctagggtaagagaaggacagggaggttagacaaggcaactggtagtcttctaatgcctacagtaattaatgataatattcagactagtttcattcatcaaagcgtatacattacagggtttgaaaaataggcgtattttcttagatgcaacaaaatctactctagctgctgcctcagggtgctcattaccacctttctagtctgccatgggtttggttgtggggcagaagtcagccacatacagaacctcaatggcaaggcaatatgggaagtgcagtcctttgctttaagtctctagtgtagagaaaacatgttttgggggtggaatggtagactggagtgggtttgaataaaccaattggcagtaactgctgcagatagttctcaaatgttattgcttccaatggggtgaactaagtcatgcagtgagccaattctcttgcaaatggctggcctgtcttcaaacggctatcagagaaacgtcaatttcagaatatggttagatacagtgtatggggataattagtagatgtcataatgctatgcaatggtattattcttatttagaaacgaaaattgagtaaatttaattttagaacattctaatttcaccaattttgcttgtccataatttccttaaaatttgctcttagatgacagcatggtgcatggcaaatgcaggctttgcaaacaattagaaccaagttcatatctcagggttgcttcttcttagctacctaattggggtatgtcactaaatctcattaattctcactggagaggatgctgatattgaagcgtactgggagcattcggcccatgaagctctgtgcacctttaatgaaatcaggcttgtatggcacactgcagacactgacaaattgtgtggtagttattctgcttctgacccaaatgcaatgatgccatcatcttctgatcccattttttcttgttcactggcacatttactttccaaactgtactttattattatatatttaatcatgcagtgtattgctttaatattgttcataggttatctcctgtttattttgtttctcagagtgactagaatctctctctgtcagaagagagggtgtgacttcttgctgcctttgccttgtatcttatcctgaattctgattctaaccttagtgcttgcatcagttgttatggacctggatcagggccactgtgtatggttgttcaggttgaacagtgaacaagagccccacgtttcatgggataccagtcactttgaatatttattatatttatcatatacataattattaaacatattatatttattatacatattaggtcttgtcctcataaaatcagtacattatggcaactttttaacaaaaagaagtgaagtgtcttaaagaggggcactgcctcttgactggcacagatgcaacgtatgggcaccacagaggctagcagtggccctggataagttgatgatcatagtgggtgatagcataggtttttaaagttgttcacttattcatatgacaattatttgtttttgtgcatattatgtaacaggcagtattctaggtagttggatatacaattattattataaaaataataatcactatatgggaggccgaggtgggcagatcatctgatgtcaggagttcaagatcagtctggccaacatgatgaaaccccatctctactaaaaatacaaaaattagccaggtgtggtggtgcatgcttgtagttccagctactcgggaggctgaggcaggagaatcacttgaacccagcagaatgaggttgcagtgagccaaattcacgccactgcactccagcttgggtgacagagtgagattctgtctcaaaaaaaaaacaaaactcattatcttagtgtcctggggctgccatgataaattactacaaagagaaatgtattttctcacagttttagagggcagaagtctgaaatcgaggtgttgttagagcggtcctagctccaggttgtaggctttgatttgtcagtccttgatatgtacacgttgagtatccctgtctaaatctctgcgatctgaaatgctccaaagtctgaaactttttgaacaccaacatgatgctcaaataaagtgctcattggagcattttaaatctgaaacactttggttgcaagcattttgaatgaaggatgctgagcctgtatacatatcatagcaatctctgtctccattgtgtgttccctccctgtgtatcactgtgtctttgtatctcttcttcttctccttctcctctctcttcctcctcctcctcttcctcctccaccttttctctctctcattttttttttttttgacagagtcatactctcttgcctaggctggagtgcagtggtacaatcatagctcactgtagcctcaaactcttgggctcaagtgatcctcccacctcagcctcctaaagtgctggggttacagacatgagccatgatgcctggcccatttttcttcttaggtggataccagtcatcagatttagagcctcccctaatccagtatgacctcctcttaatgaatgttatgtgtgaagacctcccttatttccagataaggtcaccctcacacgtactaggagttaggacttcaacaatttaacccattataatcaaagagcctataagactgtagatttacatggagtaaggcaggcaaataaatgagcaataaatatataatatgtgaaaaaatataccatgtgtgagtgattacaagtgctaggaagaaacatcaacctcaagccataggattgcctgtgtggggaggctctattctaggctgtgtggtcagagaaggcctttctgagaaggtgccattggagcagaggcctccgcaaaagcagcagacgaacagtgtggatttatggggagggatgttccaggcagagggagcctcaaggcctttaggccacagtgtgttgggcatctgtgaggagctgctaggaggctcaagtgaaacttggagagaggagggctgggaaagtgagaacagcaaagaaaagggcaacagatcatgtggggttgagtataataggaggttagaaacttggtgattaagatgggaaaccatttcagagtttttaacagaagagtcacgtgatctgactcgtgtttagaagattgttctgttgctgcagtcaagagactatagagagtcaggctgggcacagaagaaactgcaaaagcagttactgctttggagcaggaaaggggtggtgtggttcaggcagcatgggagccaggacactggccctgcagggagtgaatttcaaggttaagtagcctggaagctcagtcctctctcttcaatgatccatgcttctgtcctggttcttcatctatcttcatctatggcacctttgaggtaggtattgagttggaggctttgctcatcctgtgggtgcaggtttggcagcccagaaattatttttaggattaacagctacatgttgttccaggccagacttcctctaacattacatttccctcaaaaattcattggagctcttctctctcttccttttttctgtcccctcccttctcttccttttctttcttgaacaatttagcaatttagtcctaaatatattaggtcaggtagagcaaagtaagcactgctggagaggggagctgcaatgtcacttctgtggggtcccttctgaaagtttggtgtctcactagtgaagaagagaggtacaaataaggaaagggacaaaactagaaggaaccctgtgttatgagagtaaaactggagtattgctgtgaacctaaatacacagatagatacaggaatatcaaggcagtgtgtatatgtacacatgcatttatatgtctactcccagctttgcccactgagagagtctgggagcaatgacatcccaagaacaatgaacacccctagaatccaattcttggcttctaaatactcatttccactaagaggaaccagagttctttggagcaattgctgaatacaagcagggaaattgcagactgagctagagccctgttgatgctggaaaacaaggaaaagatcaaaaaatgggggacatgcaaaaggatcccaaagtcagccagattgggttcccactgccaaacagggcataaatcgagcataaaaataaataataataatattagtggatgataacccagtgaataagatagaaaaatcttgagtccacacatatgcaaataaacacactgaaggtttgatgaggaatggaatttttacatagttccaattacatcccctcagaatacttattaaatacaaagatgaaaagaataactttacagtggagaagcctgacagagagcaccttaatcaaattatcaacgttatcatcagcaatgggacaagtcgaagtccttagccaccacagtaagctacaagagcaccatgacatcagatctgggatttcccaacaaaaatgcaaacctgagtttgatcatgagtaaataccagggaaactcagatggaggtgcattccacaaaataactggcctatggtcttcagaagtgccaaggtcaagacagtcaaggaatggccaggctgtacgcagtggctcatgcctattatcctagcactttgggaggccatggtgggaggattgcttgagcctgagagttcgaaaccagcctgggcaagatagtgagacccccgtctccacaaatttttttttttaattagcctggcgtggtgatgcacacctgtagttcctgctgcttgggaggctgaggtgggaggattgcttgagcctgggatgatgaagttgcagtgagccatgattgtgtcactgcattccagcctgagcaacagagccagatcctgtcttaatttaaaaaataataaaggaatgactaaagaactgttcccaactcaaagcgactaagagacatgggaactgagtgcaatgtgtgattctgaggggcatgggggacccttttgttgttataaaaggcattatcaggacatttggcaacatttcaatgaagcctgaggattcgatggtagtagtctatcattattgatttcctgattttgatggttatattgtggttatttaggaaaataccctcgtttttaggaaatatccactaagatattcaagggtggaggaacagcgggtcaacaactctcaaatggtccaggaaatagaaagttctttgtactatatttgtaacttctctgttgctctgtgattgtttaaaatgaattcgctgaggtcatggctttttttttttttttttttttgagatggagtctcactctgttgcccaggctggagtgtaatggcacgatctcagctcaccgcaacctctgcctcccaggttcaagtgattctcctgcctcagcctcccaagcagctgggaccacagacatgcgttaccacgccgggctaattttgtatttttagtagagatggggtctctccatgttggtcaggctagtcttgaactcctgacctcaggtgatctgcctgccttgacctcccaaagtgctgggattacaggcatgagtcaccatgcccggtcaagggcatggattttgatccatgaatcagtgagagagacgtaagtacaatgcctgatatttttgcctgttcttgaggatagcatccctactattactgaattcactcacatgtgtgagtttggggatcttaaaatatcccagggggtgctttatgcacgagggatatggattaagtccagggtgaatataggtgtttcccagtgataaggcagctgtgtgtgaaagcaaggacaaaaacaaaactaaactaaactaaaaagaaaagtcaggccagtgtgctagatatttacagctgggtgattgtgatggcactgtccttcctaaagctttgtaacagattaagtagattctctaaagccgttcaggttagagggtgccttgcccttattgctccaccgtgctttttggcagacattgtgaccatgtttagtaattatatttggctccctgaaggtaaaacaggagctgcgtacgtattaggggagaaaaaaggaagcacaagaagaaaggaaaaaaaaaattaaggggcttatgttttatatcctcccagtcaatcccatgagtgaataactacattacaaattttgtctcgatgtggtttttaagcctaaagaatctttctttttctttctttgctttctttctttctctttcttttctttcttttctttctttctttctctctctctttctttttcttctctctctctctttctttccctccctcctccctcccttccttccttccctccctcccttccttccttccctccctcccttccttctcttccttccttccttccttccttcctctttctttctttctttctttctttctttctttctttctctttcttttattatactttaagttctagggtacatgtgcacaacgtgcaggtttgttacatatgtatacatgtgccatgttggtgtgctgcacccattaactcatcatttacattagatatatctcctaatgctatccctccccactccccccaccccacaacaggccccagtgtgtgatgttccccatcctgtgtccaagtgttctcattgttcaattcccacctacgagtgagaacatgcagtgtttggttttctgtccttgtgatagtttgctgagaatgatggtttccagcttcatccatttccctacaaaggacatgtgggctcctgaacttatccttttttatggctgcatagtattccatagtgtatatgtgccacatttgcttaatccagtctatcattgatggatatttgggttggttccaagtctgctattgtgaatagtgccacaataaacatacgtgtgcatgtgtctttatagtagcatgatttataatcctttgggtatatacccagtaatgggatggctgggtcaaatggtatttctagttctagatccttgaggaatcgctacactgtcttccacaatgcttgaactagtttacagtcccaccaacagtgtaaaagtgttcctatttctccacatcctctccagtacctgttgtttcctgactttttaatgatcgccattctaactggtatgagatggtatctcattgcggttttgatttgcatttctctgatggtcagtgatgatgaacattttttcatgtgtctgttggctgcataaatgtcttcttttgagaagtgtctgttcatatcctttgctcactttttgatggggttgtttgactttttcttgtaaatttgtttaagttctttgtagattctggatattagccttttgtcagatgggtagatttttaaacttttctcccattctgtacgttgcctgttcactctgatggtagtttcttttgctgtgtagaagctctttagtttaattagatcccatttgtcaactttggcttttgttgccgttgcttttggtgttttagtcatgaagtccttgcccatgcctgtgtcctgaatggtattgcctaggttttcttctagggtttttatggttttaggtctaacatttaagtctttaattcatcttgaattaatttttgtataaggtgtaaggaaaggatccagtttcagctttctacatatggctagccagtttttccagcaccatttattaaatagggaatcgtttccccatttcttgtttttgtcaggtttgtcaaagatcagatggttgtagatgtgtggtattatttctgagggctctgttctgttccattggtctatatctctgttttgatatcagtaccatgctgttactgtagccttgtagtatcatttgaagtcaagtagtgtgttgcctccagctttgttcttttggcttaggattgtcttggcaatgtgggctcctttttggttccatatgcactttaaagtagttttttccagttctgtgaagaaagtcattggtagcttgatgcggatggcattgaatctataaattaccttgggcagtatggccattttcgcgatattgattcttcctatccatgagcatggaatgttcttccatttgtttgtgtcctcttttattttgttgagcagtgatttgtagttctccttgaagaggtccttcacatcccttgtaagttgtattcctaggtattttattctctttgtagcaattgtgaatgggagttcactcatgatctggctctctgtttgtctgttattggtgtatgggaatgcttgtgatttttgcacattcattttgtatcctaagactttggttaagttgcttatcagcttaagcagattttgggctgagatgatggggttttctaaatataaaatcatgtgatctgtaaaaagggacaatttgacttcctcttttcctagttgaataccctatatttctttctcctgcctgattgccctggccagaaattccaacactatgctgaataggagtggtgagagagggcatccctgccttgtgccagttttcaaagggaatgcttccagtttttgcccattcagtatgatattggctgtgggtttgtcataaatagctctcattattttgagatacatcccatcaatatcaagtttattgagagtttttagcatgaagggctgttgaattttgtcgaaggccttttctgcatctattgagataatcacgtggtttttctctttggttctgtttatatgctggattatgtttattgatttgcacatgttgaaccagctttgcatcccagggatgaagcccacttgatcctagtggacaagctttttgatgtgctgctggattctgtttgccagtattttattgaggatatttttgtcgatgttcatcagggatattagtctaaaattctcttttttttgtcgtgtctctgccaggctttggtatcaggatgatgctggcctcataaaatgagttagggaggattccttctttttctattgattggaatagtttcagaaggaatggtaggtaccagctcctctttgtacgtctcgtagaatttggctgtgaatccgtctggtcctggactttttttgattggtaggctattaattattgcctcaatttcagagcctgttattggtctattcagggattcaacttcttcctggtttagtcttgggaggatgtatgtgtccaggaatgtatccatttcttctagattttctagtttatttgcatagaggtgtttatagtattctctgatggtagtctgtatttctgtgggatcggtggtgatatcccctttatcattttttattgcacctatttgattcttctctcttttcttctttattagtcttgctagcggtctatcaattttgttgatcttttcaaaaaaccagctcttggattcattgattttttgaagggttttttgtctctatctccttcagttcttctctgatcttagttatctcttgccttctgctagcttttgaatgtgtttgctcttgcttctctagttcttttaattgtgatgttacggtgtcaattttagagctttcctgctttctcttgtgggcatgtagtgctataaatttccctctacacactgctttaaatgtgtcccagagattctggtatgttgtgtctttgttgtcattggtttcaaagaacatctttatttctgccttcatttcgttatgtactcagtagtcattcaggggcaggttgttcagtttctatgtagttgagcggttttgagtgagtttcttaatcctgagctctagtttgattgcactgtggtctgagagacagtttgttatgatttctgttcttttacattttctgaggagtgctttacttccaactatgtggtcaattttggaataagtgcgatgtggtgctgagaagaatgtatattctgttgatttggggtggagagttctgtagatgtgtattaggtctgcttggtgtggagctgagtttaagtcctggatatccttgttaactttctgtctggttgatctgtctaatattgacagtggggtgttaaagtctcccattattattgtgtgggaatctaagtctttttgtaggtctctaaggacttgctttatgaatctgggtgctcttgtattgtgtgcatatatatttaggatagttagctcttcttgttgaattgatccctttaccattaagtaatggccttctttgtctcttttgatctttgttggtttaaagtctgttttatcagagactaggattgcaacccctgctttcttttgttttccatttgcttggtagattttcctccatccctttattttgagcctatgtgtgtctctgcatgtgagatgggtctcctgaatatagcacactgatgggtcttgattctttatccaatttgccagtctgtgtcttttaattggagcatttagcccatttacatttaaggttaatattgttatatgtcaatttgatcctgtcattacgatgtttgctggttattttgctcgttggttgatgcagtttcttcctagcctcgatggtctttacaatttggcatgtttttgcagtggctggtactggttgttcctttccatgtttagtgcttccttcaggagctcttttagggcaggcctggtggtgacaaaatctctcagcatttgcttgtctataaagaattttatttctcctttgcttatgtagcttagtttggctggatatgaaattctgggttgaaaattcttttctttaaggatgttgaatattggcccccactcttctggcttgtagagtttctgtcgaacgatccactgttagtctgagaggcttccctttgtgggtaacctgacctttctctctggctgctcttaacatattttccttcatttcagctttggtgaatctgacaattatgtgtcttggagttgctcttcttgaggattatctttgtggcgttctctgtatttcctgcatttgaatgttggcctgccttgctaggttggggatgttctcctggataatatcctgcagagtgttttccaacttggttcctttctccccattactttcaggtacaccaatcagacgtagacttggtcttttcacatagtgccatatttcttggaggtttgtttgtttctttttactccttttcctctaaacttctcttatcgcttcatttcattcattgatcttcaatcactgataccctttcttccacttgatcgaatcagctactgacacttgtgcatgtgtcacatagttctcgtaccatgtttttcatctccataaagtcatttaaggtcttttctatgctgtttattctagttagccattcgtctaatgttttttcaaggtttttagcttctttgcaatgggttcgaacatcctcctttagctcggagaagtttattattaccgatcgtttgaagccttcttctctcaacttgtcaaagtcattctccgtccagctttgttccattgctggcaaggagctgtgttcctttggaggagaagagacactctgatttttagaattttcagcttttctgctctggtttctccccatctttgtggttttatctacttttggtctttgatgatggtgatgtacagatggggttttggtgtggatgtcctttctgtttgtttgttttccttctaacagtcaggaccctcagctgcaggtctgttggagtttgctggaggtccactccagaccctgtttacctgggtatcaccagcagaggctgcagaacagcaaatattgcagaacagcaaatattgctgcctggttcttcctctggaagcttcgtctcagaggggcacctggccatatggggtgtcagtctgcccctactgggaggtgcctcccagttaggctacttggcagtcagggacccacttgaggaggcagtctgtctgttctcagatcttaaactgcatgctgggagaaccaccactctcttcaaagctgtcagacagggacatttaagtctgcagcttgctcttctttctttctttctttctttctttctttctttctttctttctttctttctttctttctttctttttctttccttgcttccttcctttcttcttctttttcttcttctcctcctcctccttctttccttccttccttccttccacccccgtttctgtctttcttcctttctttctgttcttcttttgataggatcttgctgtcacccaagcttgagtgcagtggttccatcttggcttactgcagcctccacctcccaggctcaagtgatcctccctcctcagccacccaagtagctgggaccacaggcacacaccactatgcccagctaattttttacagtattttttatagagatggggtttcactgtgttgcccaggctagtctcaaactcctgagctcaagagatccaccagcctcagcttcccaaaaaagcatcttgtttttactcgcatgctttgtccctctgccaggacagtagctgtaatcccatctttgccatctagcttgcccccagtggctggtggggcacaagttttatttcttgataaggctgtcatattatggctaatgcttataaatgcttcatgttggggtagagtggaaattgacactttcagccatgaagacctcaaattttgggactagctagcctgtattgcaggctttggtgaagccaagggcgtctcctggaagggctgtattcctttccttctgtacatttccttctttccctgattgtagcaggataagggtgaggcagccgaggtgcctgggctgcaccatttaagcaggcgtcactctcagggttgtggaaatgcgggacaggcacctgagggtgatagcctctttacaagtgtcttggggacctctcgtgccttgccctggttctgggcctgcagcctggccagcagtcatctgagtttacttctcattttcatgtcaagaaggaactgcagatgccaatgctctgactctttcctctgatttccccagtatcacagcttcctttgacaagtagtatttccgggttgcagtaggtgaccgtttcctcacatttttgccaacatgcaagaaaccagatttccagccagcaacattattgtccacatgccgagtgtccatctcctctcctcagccatttttccatcttggttctgttacttgtgacattctgtttccgtgtgagagatcctgcatcagttaggaatttcatacagctctaagtgacagaagcccccacccagtggcttcaacaatttgaggatttatttttctcttgcaacaaggaaggagttctggagggagacagcccagggctggcatggcgagtccctgagaccctgggtcctttgatctttccactccgcccatccctagcacagtttgccgccttctgtttacaatacggctgccccacctgtgacattacatctgtgttccaggcagagtgaattcacgaggaaaaggtgcataggagatgaatgtatttctctagtaagtagctttctcagaagctcaaccagtagctcacacttacatcccattggatactgttgtgtcccctggaaaccctgtctgcaagcggagctgaaatctagttgtttttgttttatttttatttatttaattttatctaagtacacggggtaggataaaagcttggctatgatggagagaatatctattgggtggttaactggtcatccttgtcacagctctgctcggcttcttttgcaaaccggtcacaccatgtgggaaggaaaatagccattgaggtagcttttggtggcctccaacttttatcctttgccttattgtccccaccacaggaagaaatatttttcttttagttcctgtctgtcagtctcaggggagactctgactggctcagcttgggtggcacatccgtccccgtgattatacagggacacgagcaaatgcttgtcatctccaacttatcatgtggagggaaagggatggcttcccccagggtgggacagtaatggagaaaaacagcttgcactgtaagtccacgacatttctgtcctacattttgcaagatgtgatcaatatgtattggcaaagacaaaatgagaggctacttttggtggagagcaaatgatagtcaagacaggaatgtgagaattgtgtatactgtcctgtaccagtcaggagcctagcttggctgcagaagagggctaataaagaatgaaataggtgaggcaacaaggagttggtagttgaaaagcatttatgttctttctagtgaggttgttttgtttagattcttctgcctaaagaggaaatgtgttacgctgaccaactatgcgcctccagccatctcttctacttgtttttgacgttatagttgttagcattgggttacttttgacagaaaaccccaaataatatttgtttaaaatatacctgagtttttttttctctcatatgaaagcacagataggcagtccaggattggcttggtgcctcatggtttcaggggattgtgcagcttctatctttctacttcctgtgtggcttcaacttcatggcttatggaaacatcacactctaggtggcaggatgaaagcagggacaaagcataagggacatctgaatgttgtcccttaaggaaggtccccagaagctgcccaatgacactcccactcatgggtctttggccagggccacggctagctgcagaggaggccaacagatgtattctgggaagctcggctcaaaacactatcttgtgggccaggcgcagtggctcacgcctataatcccagcactttgggaggctgaggtgggcggatcacctgaggtttgagaccagcctggccaacatggtgaaaccccgtctctactaaaagtacaaaaaaatagccaggcgtggtggcaggcacctgtaatcgcagctacttgggaggctgaggcaggagaatcgcttgaacctgggaggtggatgttgcagtgagctgagatcacactgttgcactccagcctggacaacaagagtgaaactccatcttagaaaacaaaaacaaaaataaaaacaaaaccccactattatgtggatgcagaagagaagggatattggagggtgtcagcaggctctggccaggctcagtcctctgctcagccttcacagccagagatcatggggataacaaggtcgtggatctcagtggacctgactgacatgaatctgtatttacaggagcccaagggtatttcttgcagggggtggattatacagctgaaagcagctgcttttacaggattacgaagagtagctcttttccacgaaacaatttagaatatacacagtgaaggaagtctcactaacttcctttaagaaagttgaggtgagaaagagtagacagtttgtaaatggaagttacctaactgacttctgcaacttggggggctttgtagcatcaacgggtcagaatttcttagaggcattcttactttttaggtctcaaatctctgtcatttttcccttacggtatttgcacagtgcagcctgccttctgtgacctacagaagcacattgcatttaacctgaggcttatttgatattacactttttttctttccttcaaatatccacaatctaaattgtgttcagaaagttccgaagagctgtaatcccagcactttgggaggccgaggcgggcggatcacgaggtcaggagatcgagaccatcccggctaaagcggtgaaaccccgtctctactaaaaatacaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagttccgaagagttgccagggctctatttaatccattgctcttcttagcaatgcaaattctgtgcacaatgagtttattctccttgagaagataaattcagtttggctccagtggctaaactttgttggacaagtttattcctgtgtgacacctacctggccaagcactgtcatttggatgggtctttgggcaggtaagtttctgtgcacctagaaaccttccctgctgggatcttgtcccttgagctcctcctctccagttataaactctgttggcatctttataggatttactttttatgtggattccattgtctccaaaatgccctttcttagtaactagttgggccatctacaccctctttcggggtacgacatagaaatggaaatggaaaatttgtaaggaattatcataatgttaaaatacagataccttgtcattaaaccattaaaaacaaaattttaaaaaccttaagtgttggaaatattaggattccaatgctccttccacttcctgaaggactcatttctctaacatacttgctgaacaatcctcctaccttttccctgcggcattactaaataattcagattgtttgaaaggcattctcttctatcgagatgcaatcaaatttgaggagtgtatttcattctcgccgaatgcattatatcttactttccataaagagaatccaggtatgtgctattgccttatgccttgaataatatgaagcgaagcgatcactcttatatttggggagtgttttagagtcttcagatgctttatgtagtatcaatggctccaaatataataatgtacaattaagaatcacataggcaggcatttttataatgaggaaaagtgaagttaggagagctatgttcactttccaaggctacatagaacgagtgagcgccaggactgacagttccttcctgctctggatcttgtgggctgtctcctccagcacactgcatgctagaggaagccagcgatggggcaggagtggggcgagcatggcagctgaccccaagatgggcagagagcctgcccctcactgttcttccccgccttaaaggacataatctaacctctggacatggactataatctagcctcttctttattacttagggtaaatagtacgtctactgattattaattaaataacattcttcacctgtacatgttatcacactttagttcttagactgctttcatattcaacgtggagatctggaaaggcaacttgactatcttcattttatgattgaagaagctgaggttgagggaggctaaatggcttgtagttacactacaaacactaaaacagcaaaaattagcattggaactagaacatctgatgcatgttcatgactttgtcctcacagtcatatcctcagggtctgtggagtggtgtgtggctgtggccccttagttagaaggccgcagggactgtggtgttttaggttgtgccggctcttcgtcattttcccttttctctcctgtcccttccttccaggctatgagctatatttgtgccagcaagcagtgtttctctctgtttcagctttttcctactttaatttgtttgttttcatctgttaggatcttagagatgagagaaccaagatgatttggaatttcatgtgagattacagaggatagactcagagctgaatggtagcctatcaataacgttcatacatacactctctgacctctttgttggtctccaagaagcctttcagatttagttcctggttgtgggttgtgtttgaggtaggaggaccttgttgatggttgcattccaattaaatgagatggcagccctcacggtgcctgtgtgcatacaacatgtctgtgttagatgtgcatttgcaagtaactggttatagaacattattttggaatacaacacttgtgaaatctgaagatggttttaaactttgtatttcacctgcaattatcttgtagtactctcagttaggagaaaaatatctcttttgctctgaggattcctcagtatttttagtgactctttgcatgcttgcaagggctgtgagaacaagcccagcaggaaggaagagacatggggggaaggaaggaacgtgagggaagtgagaagaaaacaaaggcaaagtttcatacctggaaggcttcgtgcaccagcgcccacctccggaaaccacagttgcaaatattcttttgtgacctaattttggttctaggtttcctttcctctgtatgtgtttgctacattccattccctatgcaatagagtttttctgtaaagaagtttccaagtataaccttccatgaagctcctcaattttaagaatttataattttccagtcctagtgcttaactcatccatcatttgttttccctcatattttacctgtttggttgcactcaaagtcttcgttgatggatgaaacctgatggtttttaagaagcagaaaataccagttttgtcctcactgattgatttttcttgacagatcacgagtataatttataccagctcagtggcactaatcttgttttgttgttgttcttaaaacagctttgacaataagctgctactctgactttgattcttaagtcagcattaatgaaacaccattcatttgtgttatcagctgtaatagtcaaaaacaggtttaagactttaccatgcttgctttcaagttttgggtggatttctttttcctccaatgcttaaaaggtttagtaagtgaatgtcaggtcaaatgggcgtagctgagtttctcccaggcacgctggctttcctgtggatgtttttgtcacagcagtctaagtgtatgtctttctggcccggtcagggaactttgctgtggggatttggtttaaattcatgtttaatctcctaattttatttttgtggctatagtgcctcaccgagtatactgaggctgagactggacagaaagaccttttttctgataagctcttaatctgtatcaggctcagccaaaatgagttctgttagggctgctatttttagctatgtgtaatagctattgtggtctcacaatacacttgtttatacacagaatatggttttatgcacagaattttgtgtattaaaataataggcaaaatgattacaaataatttcaggtgtgccttgatacaaatcagatctgtatacttgtgttttcctgttgacatctgtcatttgcagtcagtggcttaaattaaaattttttggtcttagggaaaatcatgtgagggtttccctgttgcctctctcgggcagagcttctcagccttgacactattgacgttttagaccagacacctctttgctgtagggggtgtcccgcgcatcgtaagaggtttagcagcacccagggctctacgtactagatgctagtgcctcccctcccccactctcagttgtgacaatcaaaaatgtctccagaccttgccagatgtcccttggggatatagggctgccagagttaacaaatgaaaacacagcgtgcctagttaaatttgaatttcagataaaccatacaaattgtttttattgtggtaaaatgcacagaatataagacttaccattttagccatttttaagtggctaaaatttgtaagtggtcagtgtcattaaggacattcacattgttgtgcaaacatcatcaccattcatctccagaactttcttatctttgctagctgaaactctgtccccattaaacactaagtccccatcctcccctctcccagcccctggcaacctccgttctcctttctggctctatgcatttgactcctctgggtatctcatgtaagtagaatcatacagtatttgcccttttgtgtctgtcttatttcacttagtgtaacgtccttaaggtttgtctgtgttgcagcgcatgtcagaacttccttccttcttaaggctgaataacattccactgtgtgaatgaaccacatctccttcatccgttcatccatagatggacatttgggttgcttcccgcatttggctattgtgaacgatgctgctatgaccactggtgcataggaataattttttagtgtaaatatgtcccatgtaattttagtacatacttttatactaaaaaattattcattgtttatctgatgttcaagttaactgggcaagttgtgttttattttattgggtaatgctacctggttgagaaccactgccctaggactgaactgctattttttttttttttttttgagatggagtcttactctgtcacccaggctggagtgcagtggcgtgatctcggctcactgcagcctccacctcctgggttcaagcgattcccctgcctcagcctcccaagtagctgggactacaggcatgcgccaccaagcctggctaatttttttttttttttgtattttagtagagacggggtttcaccatgtgggccagggtagtctcaatctcctgacctcgtgatctgcccgcctcggcctcccaaagtgctgggattataggcgtgagccactgcacccagccagctggactgctttctttgcttgggcactggctcagggctccaaggaccgtggtcataccttcccatgcaacttacatatgacttccaagacttccagcacagtgaagagcacatggaaaaatgtgggcaccataacatctacataccctaaatgtgtcagtcagcttcaatttgttctcagtttgggaagggtgatagagatactgacccttccttttgacctgcctcttttccattttattctggtaaattcacgcttattacagcacttacagagcaaatcatattatgattataattttatgatatcatacttttatattatgaatatatttataatatgtgaaattatgattggattcttcaaaaagtcaacttaaagaaacaagttgggatcctcactggctacttgtgtcctatttcaaattatttctatttgccctttctgctcctctccccagctttattgaggtatgctggacaaataaaaattttaagtatttacagtataaaatgtgatgatttgatgtatgcatatgttgtgtaatgattaccacaatccagctaactaacatgtctatcacctcactagttaccttttttttttttttttttttggagtgtgatgagaacccttgagatctactctttgggcagttttcaagtatatgacacattgttattacatagagtcaccatgctctgcaatagatctccagaatttattcatcttgcataactgaaactttttaccctttgatcaccatctgcctttttgctttttctatcactcagagaaagccagttagtggataatttctacatgattgaggttaatagaatgcggccacctaaaactgtccctgaggcttgggaatttgggtgaatcctgattctgccatgcactttgggcaagtcacataccttcagtctcagtttcctcatccgtgactaaagaatagcatgaatgccttctccatggaatcaccatgagaggtaaaggaaatattgcacttacagctcctgctatgaaatatctagcatctgacagacatgcaccttgtcttagatgtcgagctgcagagcagttttcatggcagaaagagagcaatagttgctaacacgtatgaactgcttactgtgttccaggtactagtctccagtttttacttgtattgttgcatttaatcctcacactgagcccacgaagcttgtcctaacattattccctttcacagatgaagaatgtgaggcacagataaggtacattcatccaagggggtatgtctggcaagcagcagagcagggcttggcattgggacatcctgattccagtgggaatagttgtcctaaccacttggctagatggctgcctgtggggtggtgcttctggatggaacacagggtgcacagtgatgcatttgggaatcactgaggcaggagagtgaccccacccagccctccaggtcagccaggataaccctggagggctggagggggacacgtcctggtgagtgcaccctccctctgggttccaggtgagatacccttccagctggccttttgagcccagctcccccaggaaggaaggatgctctccagcaggcgctcctcagagcaccttctgtgttttcacctcacttagaaaattcaacctctaaacatcattgagtggcactgagaactaaagccacaaactcccaacttgagaaaatgcaatatttatacatttaaaacagccaaaatggttttaacatacctatactgattcaaaaaagaagtctgagccaggcgtggtggctcacgcctgcaatcccagcactgtgggaggccgaggcgggcagatcatgaggtcaggacattaagaccatcctggctaacatggtgaaaccccgtctctactaaaaacacacacacaaaaaaaaagttagctgggtgtggtggcatgcgtctgtaatcccagctactctggaggctgaggcaggagaatcgtttgaactggggaggcagaggttgcagtgagtcaagatcacgccactgcactccagcctacgcaacagagcaagactctgtctcaaaaacaaaacaaaaaaaacaaaaaaaaaaaaaaaaagaaaaagaaatccgttttcgctgagccctcctggcaggtagtaaaatcttggacttgagctccctggggccctgtccagttgccctcagtgccctcccttccagcttacccatttaccaggtgttcgaggctgctgccagtttaaattttgtttcaaaaactggccttctctttctttttattctgcaacattttgccttggggcctagaaaggaatccttagtcactgattgccgtaggcggatattacctcacccagtatgggcttccacgctaaagacctctcacaaacacttgcacactttcagactcaccctgcacaaggcacgctgacgctgtttcctagggcttattcccaagaacacgtctctgctgagacttggtttttgttaggatgtgtgtgattccatgtgttccatcatgcagaggagatgctgaaagttagcgctgtggctttcaagatcctcctgtggcgcctttgtatatggcatagaatggtgccaactggagtagcctgagaaccagaaacaagaattctgcttctgaacagcttcgtttttgggccagagaattgtttccaccagaggaggcgtgatgggagcttaggggctatgtgctcggtttctgaagttgtacaacggagcattcatttgcattcatttgacaagtcctgctgtgttcctttacttgttctcttctgtattatgggcttaagggtcgcttatttcaacatctctatattttccctgaaagctcagtaatgattgaatcacagaatttaaagagcttgtcgtataaatacatctaaagtgaaaaagatgaactttttccccagtgaatacaggcaaccatcaatcaaaggaatgcatcctggaaaagaaaggcacagggtaaagcctgcctcctttgcgggtcccatctgttcttgggaggacagtccccatgtattgctcctgggccctttgtggccgagcacgaacagctgtacatacaaaggaggctgtgtgtttgttcatgatgttggaaccggaagtggaaggggctttcttgtcaaagaaggcacatatgagtgccatagttacgggacaaaaatatttctcctggaaaatctattgaagcctttgtgcgatgttcagcagagtgtgttgggggtgggtgtgaatgtatctgtgtgggtgaaatgaggataatgtggtcatgtgaacaattcaaggcaagaaaagatccggtgatactgagaatcctgattctcctttagagataggagttctctggctattctgaagagtgaagttactgcccatgatgttgcaacatatggacatttgcaacaattttttttttttttttgagatggagtctcactctgtcgcccaggctggagtgcagtggcatgatctctgctcactgcaacctccacctcccgggttcacgccattctcctgcctcagcctcctgagtagctgggattacaggcgcctgccaccatgcctggctaattttttgtatttttagtagagacggggtttcaccatgttagccaggctggtctcgatctcctgacctcgtgatctgcctgccttggcctcccaaagtgctgggattacaggcgtgagtcactgcgcccggcctttttttttttttttttaaatgattcttttgttccagttattgacctagcaccagcatttgtcttatggataaggtgagggcaaaattgcactgggtgtggcaaggtgattctgcacttagaggttcgtgtttatggtgctactgagggactgaagaattcatctggaaacttttggctgctcccctatcctcttcttgctaaatcagaatggcatacagttaaaaatacgggccccaacccgaacacaggatttcaaggcttgctcactgcttgcatgatcttagaaagtcacatctgactccaaaccttcgtttcttcatctgaaaaacggtgacgatgatgacagaactaccacctgcatggtgatgctgtgcactcaggaaggttttagaaccactagagtggactggggctggaatggcttctgtcacagaattcagagttcccttgtactgcagagagtcaagtgcagctgaatggctgctaccagggatattacccagatgttcacaggtcatgaaagtgtgggacaagatgacctcagagcttcccctccaccggtgacaacacatgtaacatgcctcctattaagcctgtaatggggtaaattgtatccccaccaatgataagtccaaatcctaacccctgatacctgtgaatgtgaccattcttggattataagatctttgcagatttatggatcttgagataagatcatccttgatttaggatgggccctgaaatccaatgattagtattttttatgagaaaggagtgggagatatgagacacagacacacagaggggaatgacatatgaagatggaggcggagacagtagtgaggcatctcaagccaaggcatgctacgggttgctgacaaccaccagaagctgggagagaggcacggaaaagattctccctcagagcctcagaaggaacccactggactaacaccttgactttggatttctggctgctgggacaatgacggagtaagtttctgtagttttaagccacccagttttcgatactttgtcatagcagcattaggcaactaattccatatctcacccataataaacactcagtgctagcaattggctgccactgtggtgcttatcagcatggaactatgtgttcctgaagagaattagttattccatttctatgaatattttcaacccaagattgttgctctcagttaacgtactgaaaatgaacttggtgaaaaagtaaaagctcttctacatatcccatttgtggatagacttaagagaacagaaagcttattatggaataagcaaattaatacctttgggatcaatagagtgtctacagttcaaaaccctatcaaaagtgggtttacgtaaaaaaaactagtgtgttatccatgtgtaatattttgtataatatacaaaattctggaaaggaagactcacaatgccagatcaagtattgcaacgtcagttatggcaggaacaaaggctcttcccagaagcctgtcttcattgtgcattctttcaccagaacaacttgctgtacttaaggcacaggacatttggatctagagatgtagctgttgtgactcaccatttctataaacttggtgactggtcccaggctgtcatatctgtacctgatccactacagggatgaattgacattttcagtggctactttgagtccagatattaatagatcagcctgaaagggaggatgaggcagtaatagcacttttacaagcaatagaagacaagctcagggaacaaaagagaagggaagctccttgaatttaaaggcaagggcagagatttattcctccactaaatctaaggactaaaagcttaggtggagagagggctcaaatgtgaattcacttctcatgctccctttgtgacctcctttaaggaaggccagatttgaggaatgagattttcccaaggggaggaagcattgtcttcatcacttcatgtatttttctcagaaggctattggcctcctggaatttttacttagaattccagatagtccaatgatgctttctaggtaccgtggctttcactgtggtgagagttttggctgcagtgcttttctgtaacccactcacaaagcctttggggatggtgatagtatagggattgtccttccaactagttgctctccaactagaaaggcgaatccctttttctttgagtcacagaggatggagaggctcagcattctcattccctgtttgggtttccacccctgtggccatgcaatttccatttatagccatgtattggcttacaagcctaacaccaatcctgacccaaagcatgaggcactctcacacatttctaggttaagaacactaaaaagcaggatcatcaggttattttttgttatttgtagatttctgcatagcctgatgcttcaacttcccaagacctcatttcttcccagagtagctggagtagctggacctttatcatgttctggtatcaaattctgccttggtaatgtgtacaatgcttcaagaattgcggactccatattactctcctgtgtcatgtagttctctctttgtgaaagccatccttccctgaaacccctcatccacctgcctaccttgccaacattccctgctcctgggttgcccttcattgtgttctatttatgggtaaccatgctttgccaggaaccatgccaagtacttggaatacgaaggaagtcattgatggagaggacacacaagtaagtaaagggccctgataaaatgcgacgagagctaggcacgtggatttttatgcaacaaaggagataggcaaggagcccacgaactagtttccaaatgctggacccccttgatcaggaccttttcggagcaggctcaagtgtctcccaacacctatacctggctggaccccttgccattgtctcaccacaagttgatgctatagttccagagggctgccccgccaggccactctgtcttttgcaattccagggtgggatgtgcattgtctacttggacctaggaactcccttcagcagttctcctgtggacctgtatccaagccaccctacaaagtgagcatgcactctgatttaggaaacttttcttgagagatttattctatagtctccctaacatcccattctggtgtttattccattaatttagagcaaacacccattcagtgaagggccctgaaaggcatagaaaaggacaaagtatcagacttgatttctgctctcagctattaaaactggagaggcaaggcacatagaaagatagggatgacatgatatttaaacaaatgttctacacagtgtttctcaatataatgttcttgtcctgttggggggcttttcagtaagcagtgtcagtgaaagggcagtgacagcaggagatgatttttggttattttctgcataggcatcctcagtatggaaggctgtgcccacctacgtttgaaatgtgcaagcttgattcttctctcttttcttctttattagtctagctagcggtctatctattttgttaatcttttcaaaaaaccagctcctggactcattgatttttttgaagggtttttcgtgtctcttatctccttcagttctgctctgatcttatttacttctcgtcctctgctaacttttgaatttatttgctcttgcttctctagtcctttttattttgatgttagggtgtcgatttgagatctttcccactttgtcctgtgggcatttagtgctataaatttccttctaaacactgcttcagctgtgtcccagggattctacaatgttgtgactttgttctcattggtttcaaagaacttatttattcctgccttaattttgttatttacccagtaatcatacaggaccaggttgttcagtttccatgtagttgtgcggttttgagtgagtttcttaatcctgagttctaatttgattgcactgtggtctgagagacagtttgttatgatttccgttcttttgcatttgctgaggagtgttttacttccaattatgtggtcaattttagaataagtgcgatgtggtgctgagaagaatgtatattctgtggatttggggtggagagttctgtagatgtctattgcgtctgcttggtccagagctgagttgaagtcctgaatatccttgttaattttctgtcttgttgatctgtctaatattgacggtgggatgttaaaatctcccactattgttgtgtgggagcctaagtctctttgtaggtctctaagaacttgctttatgaatctgggtgctcctgtattgggtgcagatatatttaggatagttagctcttcatggaggcaacctcaagtagcattattgttcttttcatccttcctctcctactcacctcccccactcctgacaaaatatggaaatcctgtccctgagtagtcttgttcacaatacacaatctcacagccaaaggaatgtatttttaaccctgagacgccgaaaacggcttgaatcattcatgctgtcgtctattagtctgccgctgtgctgttatttttcccaggcttaatgagccctcatggcactgcgctgcctcagagcacggccgcagcttcaagcacagacaagcctgctctttaaatatgcaagtcatcagcctttcttggaaaatgctatggggaaggtgctctggacaagcaaacagatgatttttgcagactgttctgtagttaatttgggtcatgaagcccactgtggctcaaggagtttaggggacagaaaaggggcttttgaaggattaacaaccagataggaagaaagaaacaaatgaagggtaatcctggttttcttttgagactgacaagaaaaagttgtttgaaaggaggacactccaccattgttgttgttgaaggagagctgtacttctgatgtcccccaggctttgtagtagttaaggggtgagggattgcaggagctgctcaaacctggctgctaatatgacactaggagcctgggtgacacaggggccatggtgccagctgcaggtagcgtgggattgaccctgttagccctggacatcaagcctggagtgagagatggcccgaaaacccctgggacctgatacaagcaagggctttgggatcaaccaggctctcactaacaggcatcactcaaaaagaaaagcatttatttaatagagagtttcagaaaatgttccccttattatttttctttgatttttgaattggaaggcgcttagagatcctgtcctttaacccttgcgttgtgcagatgagagatgtgaggtcagggaagtttagtgggctcagggacgcacacggagttcacagggtagcccgatgcagtgggagggtcgatgggcttctgcctcagagttcttttcaccctaacatttcctgtgcatttgtttacgtgtgccagggatcgctctaagtgctttgtacacattaaacttatctaatctttaccctaactgtgagaggtggctgccatcatttttatttaatttcactttgcattaaatgatgttggcacagtgatgttaagtctgttgcccacagtctcctgcctggaagtgacagtcaggattcaagccaggcagtgggagcctctggagcagccctccaaacctctaccccatatggctcacatagcctctaaaaagggttttgtgactgatctgagatcctaaccattatctatgacttcatattcctgagcagggggcagctggggaagcatttcaagatactcaaggacaaagcacccatcaacatagatgggtgcaaactcaatgctatctagttcgctgcagctgtttggctaaaggaaaacagaatacctgcagagctgatggcttggagactagatgtacaagattacaagccagatgcaagtctagtttctggggtccatctgtgagcagaggtgtgggtggaggcccagaagccaggctaccatttgggattgactcttagctccttacatgcacttaagcagccattcatgaccttttctgcagctcaactgatacactcaaggctgggcatgtccttctgttctagtcattctgcttttggtccacttctatatgtttgttaccaaactagacattgtcttcaagacccactctggccaagtcctggggtcatgtttagtcctggaaggacctccaggagatggaggtagttcttagttgaccagaggggagcaggaccacctgtgctttaaggtcatcctgatttcctggtggtcgttaatacgaaagaagctacaccaggcttgacttctctgagtcagtggtgttcagagcccttgactcaccctggacctgggcttggcaggaatttctctaaccttaggtggatgtatgggtgagtctgcacagcaacttactgttctggtgcatttgtgttggcatgcccatgtaccgggagatgccctagggacttacttatgacatactgacctagagagggtttgcgtataaaattttaacttgactcactggttcctggcagggtcaataaatatttgtggactcactgagtgaatgagtgagtgaatgaatgaaccagtctgctaagaagtgtgagcacagaatatgtgtgctgttctgacacatgatgaccctatcatcctttgaggacctaccatatagctcagttttgacactgcttgtgatttttttttttttttgtctttgagacagggtctcactctatcacccaggctggagtggagtggcatagtcataactcactgcagccttaaactctttgactcaagtggtcctcctgcctcagcttcctgagtacttgggaccagaggcgtgtgctaccatgccagataattaaaaaaaattttttttttatagacaaggtctcactgtgttgcccagggtggtcttgaactcctgacctcaagcaatcctcctgtcttggcctctgaaagtgctggttttacaagtgtgagccaccaacccctggtcccacctgtgatatttttcaccagctcatggccgtggggagcccgactatttgcatacgtgttttttgctcagtactgacacctggtggcagtgtcccaaattgcaagcacagtctctagcattaactcagtgtcaggactttggtgtggcggaccataagaatgggagcctctggagttatgcagagagaagtagccctaccagggaagatgtaatcttgcaaaataacctacctaatgacaatgagtctcttgtcttttcttagggctgcataatcagcaccacctgatttagtggtaagaggaaaggtgctagtgggaaatgccattatttaaaaatacctggagactactgatctagtttaagaccaatatttgtcccacatttgatattagaaccaatagaatgatagaagtaatagctatggtactattaatagctcctattgaggacctgtgaacacactgctggaccctgtatatttagtatttctaatcctcatgataacctaacacatagggattattatttccattttacaaattaggaaatggagctttggtttagtaacatgcctgagttcatggtaggggctggatttgaatctcaatttgcttgacctcaaaggctatgctctttcactctgcttcaagggtactgtgttactccaggggtgccattcacattctagtcagtgtacatggcatttctggggttgtgtgacttgtagccatcctctttccatcattcccactgcctctccaggagccaatcatttatgtctcttctaagctcagtgggtgactgaggctgtgaagacatttaaaattgaataatgtatcctgtagtagatgcattgactatttctctagagttggcatcctaaaattcaaaatttttggtctggcagcctgtgaaaaaaatcgtattttgcctctaattctcaaccctggagagcgccaattagttgtgaagttactttcaaactgaagcccaatttatactcctaataaaaacatccaatgtaatcatatgtgaaatggaggctaatggccctataccacccgagcatcaccatagtgatggtgttgaggataaaaatgatgacaatgacaacagcagcgatgataatagttaaccattgtcgagtacccattatttccttgactccttatagacactctgtgagggaagtaatagtattgtcccaattttcagaggaggaaatgaggtgtagagatgctagttatcttacccaagctcagttgactgtgctggtaagttgtgaagttaacctaggttagcctgagttcacaggctatgctagattaacttcagctagccttgcttttaaccacctacactgacagcctttcaattgtaagaggagctttgggtttttgctttgaaagtagaaacaagtatctagtgataataatatgcctaataattatcctgcacaaaataaataatccagccacttatcaccacctctaaggcaccttctcatcctgtcgttttaaggttttgttcttttggttctgtccccagccaggttttcttttccctccacatgcctggtgtggtgtgagtaaagcatctgccattttgattatggcacacttgctacctcttcttaaaacattcgttctcatccctagtattgtgacattctatcatatctctgatttttaaaaggacattggtgaatttccagaaaaaaaattttccaacctccttttaacctggcatcttttaaaattaaatatgtctctccaaacatattggtggggaagagttggtgtcatgagttaagtaggggtataattacaacccgaaagtttgggggcaaaatggagcagttccctcattggtcagagttctgtcattggcccagcctcctgtcctccacaaatctgagtcagggtgagacaccaagagcctcccttgagaccggcactacttggaaacatgactggctatttctgctgcaggattcctggtccgggctccagcaaaattattgttgtgaacataggccttgaagaggaggctgaagccgagaagccaatattcactcaccttttcaaccttcgacaaggctgaaatttctcccatgatatcactggaaggaagggcagagggagtcaacaatgaagaaagtgggaagagggagggagaatccaggcaggaaaaggggggtgaccgtgcagcaatagctgtgagggcttcccagcagcgttagacacaccctttgcttcagggtcgccatctctgtctgcatctccttcctctccttttgacccagcgtccacttctactttggttagttaaatattgaaataaactcctttacaatgtgtggaagtctcagctcctcagcattgtatcttatgggaatagttactcttcagcctccgtgtgtatccagggcgtggaggccatgctgtggggactgtgtgttaatgtccttgtagctcaagaacagctgctcttaaatggtccgtgctgcggtttagtggacacaacatagcacagataagtgaagaaacaagtcatttttaagtgacgcaaatcacagtagaaatatgcaacttatggaagtgaaatccttttagtattaatttttcttaaatagcaatcctttgtagttgtaagatatgtaacgtatatattgttacctagttggatgaaaaacagctaaatcaatgattgttaggtttcttaggtgaatgatctgtttaataaaattattggaaatgcatattctttattttgatcaggtggacaaattgttccatttcatagttacaccctgacttccatttctgaagagataacccaaaggttactggtggtgatggagggcatcccagtcctcccctcatttgaggggcagagcttaattctggattgtgcttcctccactggagttgatttagagagcggtttggtgaaaaccgaagaaagggtttatctcagagcctcctgctcttgtttgaacaggctgcagggattaacttgtggttgggactgagccagagagataaatgacatagcccttgtgtgctcacattcagagggagctcttgccaaatgggacaacgaaggattgtgttaaagagatttctgaacatcttaatacagcaggatgatacagtctgctctctggactttctggggagcactgagccaagcctcagaggactgtggcatgtcgtgagtgtttaatatgcaagtgacatctaacaggggaaaacaagacatttggaaacaccattgggtggggtgggtcccccgcatttttcagcacggattttttccaacaatctcatatatacaaaggaagtaaattcacaaaagattgggtgttgggggcgtggggcgtggtgaggaaggaggaaagcactaaattttattagagtgcttctcaaaattgagagactgaaatttccaaagcaggaaagattacactgaaagttgggaatgtcttacaaatgtacatattgtcctctacgcgtgatataaaattgttcagcaatagatatttcaggaaacgtaatcagtgtaaaccctttgatgaggaaagccatgcaaacatttttaaacaattgcatccttatgtaatcctggtgttaaggggtgggcttaaaaagccaattcggtgagtagagggactcgtaccttatacagggtttggcgtctaaagctaacacctaaggcataaattaagcacatttacaattgcccttgaaaattccttaagttgcccataaagtacacaaggttttgtgtgtttgggtcttttcagtaatataaatgtggacgtgcacaatggacaacacttaatagaacacacatgcaaaatagaattttccagaatttttattgcacaaaacattcacatagagtgcacctggttgaacgtatggaagttacatgcgcatgtggtatgactgcagttgtggatagacctttttactgcgtcctcctctctagcacctaagtggttcctgtattcttcccaacgtaattaaactgcaggaggaaactggccattccaggtttagacagctgcccctttgaaagagaggaaagtgtgtccatgctggggagaggcagctgcaggaaacgtcctgagcttgtgaaagtctgaccccaggaaccaccctgagctgacctcccaacattctggttcctactcctcaggctcagaccctggttggttcacggccctggggtcatctacacctctttggccttgaccttggacattcggcccagccaccttccactccacttttttttctcatagattcaccgttttcatcctgcccatattctcccagcatccagccaatacctagttttcccagcatctagccccagttcctagttctgctgcccctgctctaggctggtcagttatatagcgttgcttccctgcaggtgaggtggcatgtgacagggtagggtaggtctgacacccctgcactctctctacccacaccgtgaaaaatagtgagacaacagcattgcattcttcattttgaaagaggtttgaatgtttttatttgtggaaggtagatgtcatgaagagttgcataattaaactagtacagaggaaaaactggcagagaagtgagttgcagggctaggtttacatacaggatgacaaacctgtctctaaagatcccgggaactgttgtcacatggtgacagcttatgatggtggctgaggacactgctctttacctttgtgtctcttgtctcgtctctgaatctcaatacctgtaattaagaaggagcccataggagttttatccatcttattttcagatatttaagcagaataaatatattttcacaatcctttgaaactctcttccttcttaaaccttaatgagattccaaggtagcaacaaaggcctttctgatattacctgtacaatcaaaaactgagcttgaacttcctataatttcttctttttggtcaaaggagtcaccctccaactgacatatttataacatgtccctgtgataacgagaaactactcacttatctctgagtctcatgacagaaagagtatcagaaaaaaagatactacaatccttcaaacacacagcagtgtgagacaaaaattacactctaatctgcagttgaacaggttctgtcttccattaaacctgtatccccattttattatatagttgagccagttatatatgactcactgggaaagtgcattttatgatcttgttagaagaaatggtttctctgggatccttttaagccaataattttatacctagctcctcctaaatatctaggacattaacttattagccattccggtgtcaagcctaatgctttttaaatacttaaaacaaataccaggaaactgtgggggttggagaatagattttccataggcatttagtgctttcagagatcagggggatcgatctcaggggatttagtaggaaaagacttgattctctgcttcctctgcacacagagctttcattttatgcaacaggagggacagcatgcatgtgggataaagccaggctgattatttcaaaaccaggctcacatctatttgactgacaaggtcctggcccccggccagggttacagcaccggaacatggtctcttctctgcggctctgctggctgggcctgtgtggaggcgggtggatggggggatgtccaggctgcagctgacagggcacttggagatctcagaaggcagtggaggcttggggactgaaggggacccggcttcgatggggtggggaagcacagcagcttggtaggaaatgacctgaaagagggattcctaaacatgcatgtatgtttgcgtgtgtgcatgaaagcagctgtagatcacaactaatcttttttttttttaattgcaaatcccactcaattcttcaagctttcttggcagcatctgatccagttgatggctttggaaacacttcattcttcattggcttctatagacatctcctcccgggggttcttggcttccctgaccactccatctctgttctctttactggtccttccttctcatccgtcattttaaggttttgttcttttggttctgtccccagctgggttttcttttccctccacatgcctgatgtggtaggcagaataatgaccctcccaaggatgtccatgcccttatccccagaacccggtgaagatggatgttacaaggctaaagggattttgcagaagtgaggaaggttatggatcccaaggtggggagagcatcctggtttatccagatgggcccaatctaatcacatgagcccgtacaagtggaagactttctcaggctgggcacaggaggagccatgaggcagagggagtgacagtgaggtttgaagtgtgagaagtgctggatgacatgccactgcaggctttggaggtgaaggggggcccatgaggcagggcaagtgggcagcctctgaagctgacagcacacaagaagaggaggacctcagcctagggccacaggaaactggattctgccaacaacctgaccaagttcagaaatgtcttgaatcccagagcctccagaagagaacatagccctgcgttcaccatggtttcaacctgtgagactgagcagagagccagccgagtccttctgtgttggacctctgacctacagaaccatgaaaccaatcattcgtgttgttttaatctgctaaatgtgtggcaatgcagtaccacagcgataaaaccaatccacccaccaccaatggtcttatgattctaatagcttcaattaatcctataaactgacagccggtccctattccccattctgctgaatcccaaagcctcacgactttcttctgttaggcaactctgcttggctgtgttaaaaacacatctaaccctacatgttagaaactctgccagctgacaaaaccagaaaccttgagtcagtctggattctttcctctctgttttattcattgtgtaatctcaactccatcaggtcttggttgaaatgtcagcatctcaaatgggtcgcctccgaccacccaatttaagatgacagcccccctcctacacgtaatcgtcctttatgcttatcagcatcagtgtattgtatgtttacttaccactttgcttattattagctgtcttccctcttggaatgtcagcacatatgtgttttattgtattaattctatttaataagtagtaatagagtggtttccaagtgtcaggaactgctctaagcatttttacaaatatccacttatttaatgctgttttttcaccgtcatagctctagctgttagaatagtgcctggcatgtagtagttgctcaataagtagttgttgagcgaataaatgaataaatgaatgactccagcctaacacgaagtcctgtcaattctatttcctaaatacctttcctaacaacccacctttctccatctgtaatgaactaagaaagtggccgtatcattctcctttgtagggcccttgaatggcttccctttgtttgtgggagaaaatccacactcctgcagggattcacacacgtttcttgtcatgccctcagttttctgcctccatctttatttctcaaaactcccctctcatcctctcttgccttccttacatgctaatcttcaatcagcccggacattcagtttccctaatatgtcccatcctccctcttcttccaagcccctgagtatgagctccttaccattggcattccttcctactacctgccctgttctctgcttattctatttttttttttgagatggagtcttgctctgtcacctaggctggagtgcagtggcgcgatctcagctcaccgcaacctccgcctcccaggttcaagcaattctcctgcctcagcctcccaagtagctggaatcacaggcacgtgccactgtgcctggctaatttttgtatttttagtagagatggggtttcaccatgttggccaggctggtctcaaactcatgacctcaggtgatccacccacttcagccttccaatgtgctgggattacaggtatgggccaccatgcctgggtttctccgcttattcttaatattttaactcagctgtttccctcctccatgacaggacacctccctcacctccacctccactgagaaagtgcctttcctggtgctcactgctattctatcttgtcctctgtccttcccctctctctgtgtgtggtaaagactgctttccctgtgcaattctctcaccagtttgcacggttcttgaggccatgagctggagagtacgatccacttgggcatcaagtgcaccagctggcacctagcagggactcagcacatacctgccgagtgagtgaattggtttcccatggcttggtgagccccggccaggcactctcccgagccaagggggacacttgttctgccagtgttgatttgcaggcgcaattatatgtgtaaatgcattttcactgttctgccttaggacccaatttttgaaaattagattttaaatgtcgtattctcctcacttacatcttatgcttcccgacattcagcacataatttaaaatgaaaggcatagaaaattggactcatttagtttactccacttgaaatccatgtgagtctatttttaaattctcctagaccctgtgctcttttagggtgtatttgagaggaaggaagggggtgggggagaaaggaaagaagacactcattgtaagctgttagagatgctgcgtgttattgcactttgttttaatacatgcagttttcacattagcattaccccaaatacaatttctaaagccaaagactgaaattgagactctgccttcaacatttgctgctccatgacgttcttgattgcaatgagaggctggctgtggccagcttgcgggtgcatcacagcagggagctttaacattctttcctctgctttccagctgacatgttcctccggctctgccacacccatcagatggcaggtggggagcagattaagacatgggcattcgcagggtgcacagaacgctggcttacaaacacctcctctcataggcatgcaggtgaacagatgggtgggtgggaggttccccttcacccacagtcctgaatctgagttcttgggttaggatttggtatggcagccttcacattgcacagatatccctacattgggctgctctgcatgcctgcaatgagagtttttgggcttcttgcaggcaggaggtgctgagtattcacaccaaagcttggacatataagacaccagtgacccctattctgctaattcataacactcagccggctcccacattcccactgcctgtgcccatccccgagaggctttcctaccttcctttttctgctttataaagcaacagtgagattccaggagcaaggccagcaaagcgaggtaggagagctcatagataatccaacaaacgtgtatggagagcccaccatggggtgctctccccatgaaacttcaattttttttttttttttagatggagtcttgctctgtcaccaggctggagtgcagtggcgcaatctcagctcactgcaacctctgcctcctgggttcaagcgattctcctgcctcagcctcccgagtagctgggactacaggtgcacgccaccatgcccagctaatttttgtatttttagtagagatggggtttcaccatgttggccaggatggtctcgatctcttgacctcgtgatctgcctgcctcagcctcccaaagtgctgggattacaggcgtgagccaccgcgcctggtctgaaactcgaattctaatgggaaagacaaaaataaaaaacaaaaaatatataattgttaaaaggactgcagaggcaccagtaaaggatcagagagcaaattatcagggtggcagccagccaagaactgtaggggaaagtgccctcaaaggcgggaacatttaagacaaggcttaaaggataagcaagctgcccccacagggagggagcagagcgtgccagacagaggatggggaaagagctcctgcagtggagatgagaaaaccagacgtgtgatctgggggccgggggacgaggtaaccaggggatgagggaaagagggaaaaaacaagcaaggctgaccatgccccacctgaaggttttgggaaggatttggattttattcaagatccagggaaagccagtgcaggtatcaagcaggtttttctgggatctacttccaggaagaaggacaagtataaaaaggtgcaggggaggtgtaggctcctcccctaagagggaacctgctgggtggccctgtagaagacagcagtcatagtttccatcagagctgtgcattcaaccttctctatttcccagctgtgctgcatggaaacagaaaatggcatggccaggccaggggcagtggctcccgcctgtaatcccagcactttgggaggccaaggcgggcagatttacttgaggtcaagagtttgagaccaccgtggctaatatggtgaaaccccgtctctactaaaaatacaaaaattagcctggcgtggtgtcacatgcctgtagtcccagctactcagaaggcccatgcaggagaattgcttggacctgggaggcagaggttgcagcgagccgagattgcaccactgcactccagcctgggcaacagagtgagactgtctcaaaaataaaataaagtaaaataaataaaaaagaaaaaaaagaaaacgccatggccagaggcgccacattttagcttcaggaaactgtgttgaatactctgagttgtaccagcagggacactcccagccgcccataggtccttgtgctgagcaccgggcattgcctccttcctgcttctaccaggaaaattgctgtctgggagccttataacacagactgctggggtttgtgggagatcaaggattatgttccctgtggactagtttgaaaaggttgaaattcagccccttcataatgtcatgctcgtagctaagaaggcttgcctttttctcttcctttgtccattttagaattaactgtggatatcggtaaaagcagcctcaccactaatacatgtggggctggggccgtgatacagcccaaggcccctatactatatatctgcatattttcagagataaatcagtctagtaaatggctaaatatagcatgttctattgtcctaccttgatgctttaaaatgtattattcaggcatgatgaggccaacagatcaggagacagctgccattgaaaagagtttgttactcacagttcccaagggctgggacatgccatgctatgccaggccacatggcgatgcaccagcattggtgaggaggtagagagagtgagggggaagatgtgggcaagagtattgcggtttctgtgagaaggaatgggaaaggcaagacaaccaggcttgggattagctagtttgaataacttccgtggactctggagtatagggggtgtccctagttatctgatgccaggggcaaaggatagtagcccagcatgtgagaccctagtacaggaggtggttgggggtgtgggttctggatttcttggttatcctagcaagggtgtgctcacaggttagttgtttactctttctaggaatgaccctgggaggagcagtccctctagagtcagcaaggccccaagatgtcaaagcatcataaaatactgaaaatgaaaaagaacatgattgttgacgaagaacatgacttgacaatatgactttttttttttttttttgagacagggtctcgctgtgtcacagaagctggaatgcagtgatgcaatcttggctcactgcaacctccacgtcctgggttcaagctattctcctacctcagcttcctgagtagctgggactatggacatgtgccactacagctggataatttttgtatttttagtagagatggggtttcagcatgttgaccaggctggtgttgaactcctgacctcaggtaatccacctgcttcggcctcccaaagtcctgggattataggcatgaaccaccacacccagccacaaatatgacttcttaatgattaatgattaggagaccaggtatgagtttagaatgcttgaattccttggactctatatcagaaagcagaggtgccagagcactggtccactgaacccagcctccagctctatttttctgcacatctctgttttccctcaccatgactgtcttgcagatttgtgcacagacactccagcatgtgtgtctgagttttgtctacctgctctgtggtgggggcttggatgcactgcccagatccttcttctggaaggaagggtcaggtttctgcagctactcccagctgtcagcctttcaggtttgtgggggctaaagaaaatggccttgtccaaagttgcatctggatctggtatccaatcaatgcagaggcataaaagccttgtcccttgtgctaactcggaagaagggctccttggcttcagagctccctgtgggttggctggggcatttgtcagatatgctttgcagctccgtgcaatcctgcctcttctctgcactttcacaggtggtaagcagaagagactccctaataagcatccagggtgttaaactctacctcagggtcagcttcctggggaagcccacccaccacagtccctttccactcactttccttccacatacccttaacgcagcaagccccctgcaccctcaggcctaggaaagcacagactggccatactgtgcacactcagaagcctaagctggcaaagaggcttgcttgagtttaagaagcggaagttacaatcctaatctctgataaaatagactttaaaccaacaaagatcaaaagagacaaagaagggcattacataatggtaaagggatcaatgcagcaagaagagctaactctcctaaatatatctgcacccaatacaggagcacccagattcaaaaagcaagttcttagagacctacaaagcggcttagactcccacacaataatagtgggagattttaacaccccactgtcaatattagaaagatcaacgagacagaaaattaacaaggatattcaggacttgaactcagctctggactaagcggacctaatagacatctacagagctctccaccccatcacaaacttaatccatcacataaataccaaatacattcttctcagcacctcatcacacttattctaaaattgaccacataattggaagttaaacactcctcagcaaatgcaaaagaatggaaatcataacaaatagtctctcagaccacagtgcaatcaaattagaactcaagattaaggaactcactcaaaacctcacaactacatggaaactgaacagcctgctcctgaatgactcctgggtacataatgaaatgaaggcagaaataaagatgttctttgaaaccaatgagaacaaagacacaacaaagcagaatctctgggacacatttaaaacagtgtgtagagggaaatttatagcactaaatgtccacaggagaaagcaggagagatctaaaattgacaccctagcatcaaaattaaaagaactagagaagcaagaggaaacaaattcaaaatctagccgaagacaagaaataactaagatgagagcagaactgaaggagatagagacaagaaaaacctttcaaaaaatcaatgaatccaggagctggttttttgaaaagatcaacaagacagatagaccactagccagactaataaagaagaatagagagaagaatcaaagagacgcaataaaaaatgataaaggggatatcaccacctatcccacagaaatacaaactaccatcagagaatactataaacacctctatgcaaatgaactagaaaatctggaagaaatggataaattcttggacacgtataccctcccgtctaaaccaggaaggagtggaatccctgaataaactaataacaagttatgaaattgaggcagcaattaatagcctaccaaccaaaaaaagtccaggaccagatggattcacagccgaattctaccagaggtacaaagaggagctggtaccattccttctgaaatgattccaaacaagagaaaaagagggaatcctccctaactcattttatgaggccagcatcatcctgataccaaaacctggcagagacaccacaaaaaaagaaaatttcaggccaatatttctgatgaacatagatgtgaaaatcctcaataaaatactggcaaaccgaatccagcagcacatcaaaaagcttatccaccacaatcaagtcagcttcatccctgggttgcaaggctgtttcaacatatgcaaatcaataaacataatccatcacataatcagaaccaatgacaaaaaacacattattatctcaataggtgcagaaaaggccttcgacaaaattcaacaccccttcatgctaaaaactctcaataaactaggtatcgatggaatgtatctcaaaataataagagctttttatgacaaacccacagccaatattatactgaatgggcaaaaactgaaagcattccctttgaaaaccaacacaagacaaggatgccctctctcaccactcctattcaacatagtattggaagttctggccagggcaatcaggcaagagaaagaaataaaatgtattcaagtaggaagagaggaagtcaaattgtctctgtttgcagatgacatgattgtatattaaaaaaactccgtagtctgagcccaaaatcttcttaagctgaaaagcaacttcagcaaagttgctgttatcaatgtgcaaaaatcacaagcattcccatacaccaataacagacaaacagagacccaaatcctgaatgaactccctttcataattgctacaaagagaataaaatacctaggaatacaacttacaagggttgtgaaggacctcttcaaggaaaactacaaaccactgctcaaggaaataagagaggaccaaacaaatggaaaaacattccatgctcatggataggaagaagcaatatcatcaaagtcaccatactgcccaaagtaatttatagattcaatgctatccccatcaagctaccactgactttcttcacagaattggaaaaaactattttaaagttcatacagaaccaaagaaagagcccacatagccaagacaatcctgggcaagaagaatgaagctggaagcatcacgctacttgacttcaaactatactacaagcttacagtaaccaaaacagcatggtactggtaccaaaacagatatatagaccaatggagcagaacaggggcctcagaaataacaccacccatctacaaccatctgatctttgacaaacctgacacaaacaagcaatggggaaaagattccctatttaacaaatggtgttgggaaaactaaccagccatattcagaaaactgaaactggaccccttccttacaccttgtacagaaatcaactcaagatggatcagagacttaaacgtaagacctaggaccataaaaatcctagaagaaaacttgggcaataccattcaggacataggcgtgggcaaagacttcatgtctaaaacaccaaaagcaatggcaacaaaagccaaaattgacaaatgggatctaattaaactaaagagcttctgcacagcaaaagaaattatcatcagcatgaacaggcaacctacagaatgggggaaaatttttgcaatctatccatctgacaaagggctaatattcagaatctacaaagaacttaaacaaatttaccagtaaaaaacaaatagccccatcaaaaagtgggcaaaggatatgaacagacacttctcaaaagaagacatttatgtaacaaacagacgtataaaaaaatgctcatcatcactggtcactagaaaaatgcaaatcaaaaccacaatgagataccatctcatgccagttagaattgcgatcattaaaaagtcaggaaacaacagatgctggagagggagtggggaaatagggatgcttttacactgttggtgggagtgtaaattaattcaaccattgtggaagacagtgtagcgattcctcaaggatctagaactagaaataccatttgacccagcaatcccatatacccaaaggatcattgtactataatcattctatgataaagacacatgcacacttatgtttattgtggcactattcacaatagcaaagacttggaaccaacccaaatgtccattaataatagactggataaagaaaatgtggcacatatacaccatggaatactatgcagccataaaaaaggataagttcatgtcctttgcagggagatggatgaagctcgaaaccaccattctccgcaaactatcacaagaacagaaaaccaaacaccacatgttctcactcataagtgggagctgaataatgggaacacatggacatagggaggggaacatcacacaccggggcctgtcgggtggtggggggctcgggaagggatagcttttggagaaatatctgatgtaggtgaccggttgttgggtgcagcaaaacaccgtggcacgtgtatatctatgtaacaaaactgcatgttctgcacatgtaccctagaacttaaagtataattaaaaaaaaaagaagtgctcccagggacatttgggcaggaaattcccgtgttctgggtaccaagaacacaaaccagaattgaaggggcaaatcttttggccatgtgactgcctcaccatgcagaggggcattctggaggaatctggaagtgagggttctctatcatgatgcccagggcaggggcccctcttgggcaggtccaagggctattctagattgaagcagatattcaatcatttgtatttttcctgtgttaatttttttttttttttttttttttttgagacagagtctcaactctgttgcccaggctggagtgcagtggtgcgatctcggctcactgcaacctccgcctcctgggttcaagcgattctcctgcctcagccttctgagtagctggcattacaggtgcgtgccaccacgcccagctaatttttgtatttttagtagagacggggtttcaccatgttagccatgatggtctcgatcttctgacctcgtgttccacctgcctcggcctcacaaagtgctgggattacaggcgtgagccaccgtgcccggccttcctgtgttaattttttacacatacttgttcatcacccatgtatctatcacctgcatattaaaggagaggagacctctgtgtgtgtcttactagccggggcacgttgtcttagcatctttggcctctaatgagactatgtttataagcaaaaggtgcccagtcaggcatagtgaggccacttgggggtgagggccggtgcctggatgtggacagcatgtgtgtgttttgaggtgggagtaaggcctggagtgatgaatggaactttatagccaacaaaaggctttcctcaaatgggaagttgttctgacctcactttgtgcctctgcttggccaatttggcctttttcctgccaaatccatttggcataaggagcaggcagtatttgggctggctgcttgggaactttgtaagacagttgaggagggcacctccagcctggaaaacactgcgtagtccggatctggctgccttacgggggcgccatccttggccactgagcacaaactacgtcttcctgctagtgtcccagcagctctcccaacagcaacagctcagaccacccatcagacccacaagctcgtgtgtcttttaacagttgcatatgaaaagcctctgctttagagggaaaagtaaattctttccttttgcgaaattccctcagtgaaattcataaattatgtttcatcacaactgggcaacaatattgtgtatttgtaaaaacagagcctttggcataaaacccaagtgggtctgaattttttatttactccttgaaataacttctcccagccccagtctccttatcctcaaaagggatttagagagttattgtgagaattaaacaaaataatgatgcacatggagcatcctgccagcactcagtgtgagctcacttttcctagcttaagaagatcaagtgtggattggggcttgttttaaacacaagttgtttaagaagatagtattccacttttaaaacaaagtcccaaattttcttccttcttctgtctataaaaaagaatgaaaaaaaattctgtgtgtgtgtgtgtgtgtgtgtgtgtgtgtgtgtgtgtgtgtgatgcccatatttcagggaaataacaggagaaagaatcaaagaatgagactgcatattctcagttgcatactactaggtaagacagtaaataggcattctaagcaatttaaaaaatactgtaaattaatctccaggtcacaactctttcagttatatgcgccagaaagcaagaaagcaaacccaaatatgcctgctgctgtcagcagggattgctgagaaaagttagcctgtctttccatttagaaaaagcatttgacaaaggcacgtgagtgggaggctgtgaagtgaacctgcttggaactgatagtgttagctttttactgacctgctttccataccgcaagcatttggtttttcttttgtcattgacttgtgcggatttattagactgtgtgcttcaagggtgtcaggagattgcatgtaggagcaggtctgaactgggaaagtgagaattaccatattagatgatacccaattaactagtgacaggcacagcaggtaaaatcggtacctgggctttatctactataagcactcgccacatagcaaacatttttaaacctggtggagcttccttactcatttctcctttccttcatcctgcccactctcccttcctgtctaagcaaggagctgtgtctacctatgtaagtatcaagacagacaggtctttgagatgtgctccagggttcaagggcaatggggcagaactctctgagggtggtgactcactgggaagcaacagccacacaccaccccacaggacaaaacagtggaagtggaggcatcaacatagttcagaataattgattttacttttttcatggacaactgagtcacaggatgatgtcccagttctgaaaacactttctcactctctgttctttgggtacctttgccagcatgaagttacttactataactcagcattctcactcgcgttactcaaaggtgaaaagctggaagaatgagttaatcttacttccacattcaaatgtggctattagggcagtgatggaagctcagagcctgtgcttttggacaggctgatttcctgtagctactctgtcttcctttggtgtgggatcatgtagtccatctagtgatcataatgtaagcttggagggaaatgatttggaaataattgggaaggtaaaatgatatgacatgaaatgcctgctattctaaaacacaaatcttattttatgtgcaactgctgttttggattatccatgcctcctcctgcatcagctagcatggaaaatcctttaagatctctaactcagtcacttcctcagggagtcatgtttaaaccccctcaagctgggccaaatctccctccatgacgctctgagaatgactgctgcttttatcattgaatctaacttgttgcttttattagtcatctattgatgtgactctttctgttaccaagcctgattttcttaagcccacgggcagcgtgatattcacctctgtggccccagtgcctaacatggaatctggcatgtgttaggcatttaaggaacattagaggcagggtgtggtggctcacacctgtaatctcagtactttgggaagtggaagtgagaggactgcttgaggccaggagttcgagatcagcctgggcaacaaagtgaaccctcatctctacaaaaaaattaaaaaaaaaattagctgggcacagtggctcacacctgactcagctattcaagtctcagctgttcaagagattgaggtgggaagatcacttgagcccaggagttcaaggctgtagtgagctataatcacgccactgcactttagcctgggtgacagagcaagaccttgtctcaatgtctcaaaaaaaaaaaaaaaaaaaaaaagaaaagaaaagaaagaaaaagaaaaaacattagatgaatgtatgaatgacagtcaggtataactccaaagagaaaccctttccctgttaccacttattaaatcagtaggactcatatctgttaattttccttctctctgtaaacatcttatcaacatcagagaaaaagagacagagaattaacaacaacatactgaacgatgccctgacaatgagaaatgaatcccttgctagtttggtaatgatgcatttatttggctctggatctagagaatttatattgagtagtcaaaagcctgggaaggactgaactctgttgaactcagaaatcctctcttgagagttctagctaaactagaactaccacagataggtgatagcagaatgctatatttgaaatgctgcaaataaataaatttatacatgcaaatcaaaatcttttagtaaaatcacacaattaacctctcactggggagaaagagccaatgtagatatatgctttagaaagttgttaatcattttctcattgcaacctactttgaaatcaccttggcctattgtctctcatatatatatgtttatatatatatatatatgtatatatatatatataaacttattttacacaatgtagatttattttatgctgatatactagtaatgttcttccctacattttacaaacaatgagattttcatttattgatggctggtctttgcaatggtcagtactctttgtaactctgactttttacagcacagcctttggcctcccctgaatttagtgtctttgaacacctgcttcattttgttggtgctgagatttcacatctcatgtgcactaactgctgtcatgttatatgaagttgaagtcatgtgttttgtaacaatgagctctggaactatcccttactggcagtgtgactttgaaccttactgctgctccatttaaccaactgtaaaatggtgataatggtagagctgcttcactgatactattatttagttcatgtttagaataaggtgtttaaaacaggtcttgcaaaagaaagtgctcagtaaaatggtagctaaattgatatcacgcgtgtccccacagtgggtctccaatgtgacagtcaatatcatttgcgtatgagcagacaaaactctctaggttttaggggttcatggttgatatttccattttgcccttcagtgtgaaatttcactcacgtaggacttcatggaaagaatctaccatctttcaaggacttacacaatcttatgccatcctacctgccaagacattccagctgcaagtccattttcctgtattgctgactttcctgggtcttttcaggattatgttacctcttcatcctcatgcatgatttaattatccgaacaaaggttctttcattcactcgaagacagcataataccttagatatttgaaaatttctcagagttctaaaatttctcctttgtctttcacatcttccttctgaaagattttactaagtgggagttaattttatctaaattgattcttgaatattgatctttgaaatctgatgacttattttcataaatgtaggccaggtctcacttggtacttaatgttaatttagaaaattccaataacgtggctaatgtttgacaaactttgccattaatgctaaactggggaggtccctttggcttccattttcaaaggtgagatcgtatcgtactgatcccgtctgaggatgccttccttattaattgagggtggtggggctggagtttcttcaaatcactggtccattcaatctgatagcaagtctgcctgggtgttactcatttcccatgctattttcatgtcaaatactgctgtccccttatgcaagggatacaattcattgaaacctcgttggacttcctcccacttaacattctcctaccttccgtgttgacattcttctaccttccaacttccgtgtttacactgaaaaagctgttgctgggtagcttggttattttttttcccatcagactcatagggatatttttggattattggttatgatgaatatttatggaaaatgttgctgtgcactccagtgagaaatcagtgttaaagaggctggtcccacagctatctctgtgtccctggaagccgtgtcctttttctatttaattagtgccaagtatatggtcttgcatgaaggaggacccagattgaactcctgtagcatgatgtgtgtttcatgcactctactgttttcactgatttatggcatttaattatcaatctgttaatccaagtttttgtttaattggattcatcaaactaattgtatgaattccactctgttatcatggcctgaacctgaatatcagattcccttaataaacagaaacagtgaatgtgttcctgcttcttcctgatcaggaagggggtctgcagtcctctggtcttgtttgtttcgtagcatttcattttgtattcagcatttctttgagcgccctctttgcttcttggaaccttgccttactaccattgccattctcataggtccctgctctactggacctaaaatggtagggaagaaaggaagaggaggggagtaagaagagaggaaaaggtgagctctattctccgtcagtgtgtctgtggctgtattgattcggaagtttaaaatctaaactccctgtctacagtcttggcctgtcttgaaggttgtgagtcaacttagtgaatacatgcaaggtacttttaggctgtctggctgggagataagttgggtccaaagaaagtaatagttcaacatagcattctccttagatggcagcctccaggcaagaagaaaagcccatggctttgcctggaagttcttgtgcaggtccagcgtgtcaccaactggtgcttcagacactgagatgaggcaaatacttagcattcagtttcttaacaaagtgattaacttgatagacatctagattctttttaaacataagaatatggctttcttttcttcaggtggtgtgtccatttttgtccatcggatagaaggtgctatcacaatataaatggcgcgttgcgtacgatcagcaagggcttcttaagttactcccacttccttagtgatactgtccagtctcattgcttcaaacgccaatcccaaatgtctctgttccagaactttcccaaactccagactcagatatccaacctcacacttgacatctccactgaatttctaaaaacttctgaaatttaacaaatccaaagccaaattcttgtctccccaaacccatttcacttctcattcttcccatctcagttgatggcaatttctgttttttttctggtggcttagggtaaaaatctgtagtcattcttgacttttttttttttttttttggaaacagagttttgctttttgttgcccaggctggagtgcagtggcacgatctcggctcactgcaacctccgcctcccacgttcaagggattcttctgtctcagcctcccaactaggtgggattacaggcacccaccaccacgcccagccaatttttctatttttagtagagacggggtttcaccatgttggccaggctggtcttgaactccagacctcaggtgatccgcccacctcagcctcccaaagtgctgggattacaggtgtgagctaccgcacccagccaacttttctttttcttacacctggcatttgacccaccaggaaagctattgtctctacctttaaaatatatctaaaatctgcccacttatcactaactcctgctaatgcactagtttaagtccctattgggacatagaatatgatactacaaagtacagcaccttggaaactgagaaaacagcagaagcagaaagggtactctgaccatctgctgtctttctgtgtgagctgatcttaaaggactctcttgcttaccttccctgaaaggtgagcataagacccttatgtgacagttgccctgccccccaatgtggagggaaggaatgctacacagaggccaaggagattctgaacaaacagccatgctgagctccagtttatcaccattagatcatgtttttgtccaatcacgtttctacacagctgtccatttttcatatgcttcattgaacctaagcacaaaaatagacagttttctctgggtcttggggtcttcatctctgaaggctcctatatcacataaaactttggtcacataaatttgtcatgcctttctcttgttaacctgtcttttgttataggggtgtcagccatgaccctggtgatgggtgagaaaaaatattctacttttcctcctccacatctccatcatcttttcctggacgattgcactaacctcctccatgtctttctgcttccaccccatcctcccttatggtgtattctcaacatagttgctgtaggtcaatctcatttttttcttctacagtgtttttccattccactcagaacactcaaaatcctgatagtggctttctagttactacagctgtgcaacaaaacatccccaaacttaatgacttaacatcaccattaattatgtgcaaaattctgtgagtcaggaattcagacagggtatagtgggggggacttgtctccatcctgcgatgtctgggtccctcagactcagaggcactaaccacctgaaagctcattcactcaggtatctggaggttggtgctggatgtattctaagaccatcacccaggttttcagcttaaacacctacacagggcctctccatgtggcttgggcttcctcacaaaatggtggctgggttcccaggacagagagccacgcagaaactggactctagcctcagaagagttatagaatcccttccatcatactcagtgggttggagcagtcacagcctgtccacattcaagaagagggaaatagtctttacctcttgatagggagtggcaaggttctggaagagtatgtggtaccagaaatattgctgtggccattttgagactatagtctaccacagtggcccgcttgattggacctgggttgtttctctgccttcatcttttctccctatggaacatttggctccggccacacttgctagagcatgcagatgtgcttctgccctggggccttcagactgcctactccattcacaagatgcctgttgatgccctcttccctccctccgcaaacttttatggagtgtcatttccccagtgatgccttccctgaccactctacagccccttttcacttgctgtctttttttttccccttaaatccttattgtcattaccaccttctaatgttttatggaatttttatgtttattctttagcatcccttgctgccagaatggaagcactacagaagcaggaatctttacctcttctgtccactgagctatctcacatgcctagaacagtgtgtggcacataaatatgtatgggatgtgaaacagagagggcgtttctggtttgggcatttggaatttgcaataattgctccagctagcacaactaagtttgtgtgttagaccagcataagtcaataaaaaaagataccaacttaaacagttgttttcattgtgtaaatgtctctttttatcttttatggactaatgaaccagaatgtttaattgttttaatttccatctaaatatttagtttctttatgaggaatggcagggtactttttccagttccacagtccctcaccttacacatacacgttgactgaaatagaagtctaagaatccccagacactccagtagcatgaatctgggcagcctggcttctgtgtttccacattctccaactttagagtacatgagcccttcagcataaataacccttcagaataaaggttgtaataaaaacaatgataaaacccacaataacaataataatactagtaatagacatggcagcaccattgataattccagccaccatttgctagaaaccccttggctgcaggtgttcttccaggcacttggtgtgcacgtctgttagttattatcttgagaggaaggcaccttcattcctcggatgagcaaaaggggagaacttgttcaaagtatatcaaatctcttttatccgtaaagtgcctctttgatctgctgaaccatagcaatcattcattccttcaacatttggtaattaggaagcgctgagtttatctcaaagagtagctgatctcatcactcattggatgttgagcagttgatttctagttactggcagaatcccatgtttatgtttatttctcaatgaaaggttccacaatcctcctctacccctagtgtggctcttctggttcatctgtaggatgggaatcattacactgtcaggttctctttccctgtattggacaaccgagccaatggctatcagttgggaaaggtaagagatagagcacatgtcatccagtgatagactatcagtgagctgctttttaaagactacagcaaggctggctcagcgctattgctccagcctctgactttctcctgcagagacactcagagccccggaatcctccccaactcatgacttcaggcagccactccagtggatttgagtgttttccaaacatagaatgttacgattactagtggcttgacctcaatcctttggctttgagcttttagttgaatggtttttattcaattgtgactgcagttgcattaactttggatttcctttttttcccccagaaacaagtgtgaaggaaaatactatgaagtacatggaaacacttaagaataaactgtgcaggtaaggataataatttctgtatttcagactccgtagcacatctagattctttattataacagaatttagttaaatcgatgaaaaaggctggccagtttctctaataaattaacaaagaaagacacaaaaaagccttttgaaccccatcagtgaaagagcaggtgccagccctcatcttgtcttttaaaaagtaagtagattaagatgtttaaaagtgtcttggagagatcacaggagagttttcatgttccataagagaagaatcttctttactatattaaattcagaattcattccttagtctgtttttcccttttttaaactttagtgtttgaggggggtcttaaggattttaaggcggtttatacatggtttggaataatatagaaatgcacgtcttaggttctgttttgaatcctgaatcaaaaccagcatgaaaatttctggttgctttttttaaaacccaattaggaattcatctttgagaaatgtcagggatgctgcagcatgacaagatgtttctggcttttgtggatgtgtgcttaggaaaataaatcccagtcatcagaatctgttcctaattaaggcaacaagtactagagtggaatatgcgctttcttccctggaagtcatttagttttatggagaccattttgctattattttggaatttgttaagtaactctttagataggctatgccttaagcctttgtctgctaggacgctgtcttgagctaaaatgctgcttttccattaagagatgttgagagggcctgccttgcagagccctactcttcagggtaagcaaggcactacaggatttattctcatccttggaaagccgtcctataacctcctgattgatctttccctgcttcccatgctcctagacttgggaagaatctatgacacaggtggttagcagaggtgagcagaatgaggagagcttgcacctgggtcagatgctccgctctgagtctggccttcctcctctcgcatgtgttcggggcagatttctggcacatccttcttgatctcaactgcagctgccattgttttagccatcagcacagcacacaccgtaagttacattaggttatcaggcagccagtggtagccataagcacgtgggtattggtaaagagacacccatttaaattgcagctctcccacataaaaactgcctaaccttaggtaagtgctcactttctgttcagtttgttttgttttgtttttttagctatataactggaggaaaggtacctacctccccagctggtgtgtgaatttaaataccatatgtaaagcattcatgtgattggtagtaggcacgcattagtttcctttaccttcttcttatttatttatttatttatttattttgagatgaagtttcgctcattgcccatgctgtagtgcaatggcgctatcttagctcactgcaacctctgcctcccaggtactagcgattctcctgtctcagcttcccaagtagcttggattacaggcagtgccaccatgcccggctcatttttttatatttagtggagatggagtttcaccatgttagtcaggctggtcacaaactcctgacctccggtgatccacggccttggcctcccaaagtgctgggattacgggtgtgcaccatcgtgcccggccacctccttctttatatcattagaactgattggacacttatgagtggaaaaacacaaactgcttttcctctgttctcacacaatgcaataatcaacacagaaggcttctgtgatgaaatacatgagggtttctccccaccaaaaagtaagcaatcagttctgctgcagataccagctgggtgtcctctaactcatttccgacaccagctacctggagacagcatcagatgccacaggttgagggctcagtcccacaagactgccccacttacaatgccaatggcaagcccaggttgttttgcctgggcttctgaccaaccaactagaaattgggattcccatgatcccctccttgggtttgattaatttgttagactggttcatgaaattcagaaaaacacttatatttactggtttattataaaggaggttacataggatacagaagaagagatgcatagggtgaggtatgggaaaggggcaccaagctttcatgccctccttgggcacaccatcttcaaggaacctccacatattcagctatctggaagctctctgtaccctctcctcttgggccttttgtggggacatcactggataggtgtgactgaagtatggacaaccatgtagcaatgtgattggacagaaactgtgacctaccacaaatagactgagtgggaaaaccccacagggcctgtgtgttcagattccccagcttctctgtgcagcgtttcttccttcaggtgtgggacaggactccttctgaaatgagggtctatgacctacagtcagataaggtaggtcagagaatttctttccttctttctttttcataagttcaacttttattttagattcagggggtatatgtataggtttgttatatggatgtatcgtgcgatgctgaggtttggggtatgattgatcctgtcactcaagtagtaagcacagtacccctggaattagttttcaacccttgcttcccttcctcctctgtcagtctccagtatctattgttcccatctttatatccatgagtacccagtgtttagctcccacttgcaagtgagaacatgcagtgtttggtttttcgttcctacattaatttgcttagaataatggcctccagctacatccatgtttctgcaaaggacatgattttattctttatatgactgcatagtactctgtggtataaatgtaccatgttttctttatccatttcaccattgatgggcatctaggttggttccatgactttgctattgtgaatagtgctgtgatgaacatacgagagcatgtgtctttttggtagaatggtttattctcttttggatatatacccagtaatgggattgctgggttgaatggcagttctgttttaagttctttgggaaatctgccaactgcttctacagtgactgaactaatttacattaccaccaacaatgtataagtgttcccttttcttcacaacctctccagcatctgttgttttttggctttttaataatagccattctgactaatgtgagatggtatctcattatggttttgatttacatttctctgatgattaatgatgttaaactttttttgtatttctgttggctgcttgtatgtcttcttttgagaagtacctgttcatatcttttgcccactttttaatagagttatttgttttttctttgtcaaattgtttaagttccttatggattctggatattagacctttgttagatgcatagtttgggaatattttctcccattctgtaggttgtctgtttactctgttgataatttctttttctgtgcagaaatggtttagtttgattaggtcccacttgtcaatttgtgtttttgttgcaactgcttttgaggatgtgggcatatattctttcccaaggctgatggaaccataaaagagcctgaatatccaaaacaatcctgagcaaaaagaacaaagctggaggcaacacgttacccaacttcgggctaaactgtaaggctacagtaacaaaaacatcaaggtgccggtataaaagctgagaatttctttatggtcagctccaagacagaaaggcagggggagattagggtatatttttagtttttatgaactgcctaggggagaaataacagtggatgtgggagttatgagccaggaattgtagatgaaaacctatatacataatttcaacagtcatgcttggaactcatcctctctccctccatgtcagctcctcctcctgttcatccagcccaatgcacggcccaccacccacctggctgcctgggtgggcgggcaccatgggctcatgctggctcaccagcctcctttctcactcagttcccagtcttgtcagtcttgcctctttagcatctcacaagcctgcctacctttatcacactgacattgtgggcccctcttctgatcataatagcaacttttcctgctttgctgttccactgttgccctcttaccaccttctccaggtggttttgagtaagcatcttaaaataccaatctggtcattgcacaaggctgcccgatgtcctaagcataaagcctaaatgccttaccatggttcatggcattcttccatgtggcctctgcatgtacttgattatcacccatcactaccccatcatcaccctattgtagctgatacttgttcccttatgcttcccaatgccattgcattttttttttctggaaagaaactaatttagaaggggacatggttaaggagtatcatccagagaaatattcgattgaatcatgtgaaattgctgatatttcaccatttttgacctagaaaaatgacaatttcatatagttaacccaatatttagggatttgaagtcatcttcagaagggtcagatgctgtggctggtctccttgcccttgacacacaggcatagtttgctcccccacccctctgcatgtgccctggtgggcctctcccagcccacccctcaccctcaccaggccttcccattcagccttcaaggtttagatttctcctctgtgcaaccttccctgactaaccaagactgagtaatgtgcttgcaatgatttattctcactttccaagtgctccttgacaggtattataatgtagcaggacaagccgcagacaaaactcctcagacgctgagttaaagaaggaaaagctttattcggctaggagcttcggcaagactcacgtctccaacaactgagctccccgagtgagcaattcctgtcccttttaagggctcacaactttaagggggtctgcgtgagagggtcatgatccatgtgagcaagcagagggtacgtgactgggggctgcatgcactggtaattagaatggaacagaacaggacagggattttcacagtgcttttctatacaatgtctgaaatctatagataacataaccgattaggtcaggggtcgatctttaactgccaggcccagggtgtggcaccgggctgtctgcttgtggatttcatttctgccttttagtttttacttcttctttctttggtggcagaaattgggcataagacaacatgagaggtggtctcctcccttaataagattaagtctgccttgttcaggactgtattctcagtgatttgccagtgctggatggtacaggggttcccaataaacatgtattgaatgaatgattgaataaatatgtgaattaatgcaaataatttgtaaacatcctaggctcatcttttgtcatctccagcctctttctctgcctctccagccatgctgacgttgcaaagccaccttgcccctggcctcttgactcacataccttagctacctaggatcctgccacagtctcaaatgaccgtgatagtagctggcccttcctgtagcctggagggctcttttcatgctatttcaagctattatgaggcctgggtcagatttgtgtgaactggtatggtgtaaacaatggaacagggaggagaaaaagcagctaggagtctgcaacccctctggcagtaggcaattctattcccacttcagaacaggaggccagagtggatgctgcaaaagcctggtgaccatcaggctctctgtgacagagcccagtagttatggttgttttcagacactctgtgggctccactgataatctgtcaccttcacagttcctttccaagaggatcaacattttacaataggaaaacagttttaacacctgacacagtggtgcatcttagtgactgcttgattaacatctcaagttatccattaaagaagatgaaaatctttacctgttcccactgttcagcgtttcttggtcttacaggattttagagaggaagcagctgagaacagaatggattgctccttttccattagaatgctggagagcatatacttaaagatcagagctaagaaacctaaatctggctagtcaccattttggggacaaattcaaatgatagcactatctttgttactctttcaaagtatacagagacctgaagacccagatattgaggcaaactcaggtggactcaagatctattctctatcaagtatatcaagtgagttagaaagtgaggaagtatctgatgctggcagtggttcaaaagcacatcttgcataactcaaagcaaaaagtggacaaatattacatgaggacttttagtgtatgtttaaataagggtttgccttgtaatcatctgagttataagttagatgcatgtattcctgttcctccttctacaaaggagagattccatttgtggattttttttccaatttccacctgttttaggaatatccctccttctccttatccatagccaaatatccaggagggtgactgcggtcagtacctggtcattccatagaggctttcctctgcattcccatcactactacctgcaacttggcccattaaataatctcctaacagcctctcttccctcctggctcacaacagtttagtctgctcttctcccacagccagaatgactttattaccatcctgttaggctcctttcgcatccagcataaattccacagtccttgttatgtcctcctcctctctgccccttgggctcttcatgaggtggttccaggctactggtccaacctcatctctgtaatcctcatctgcaccaggtgactgatgctccattctagcccatttccctacattaactgtgctccacagcagcacctttgcagagccctccccgacctagcccctgtgctcacactcatccttatgactcagcacaattgtccttctctataaagcctttctggccttctgctatttcctgcatggtacccatagtggtagccatgtacacgaatgtgttgcattcactcagtctgtctaattctattagactgtgagctccttgtagatggagcctttacttttcttatattccaagtggtattctaaggtttccatgccttactttccttgtattctaagtggttgtcgtgctgtttggcatgtagtcaacagacaaattgtatttaatgcaagaatgaatggataaatcgcaattttatcttgttcctccttggaaatttatttgcaacttgattatcttgacactatattctcaactattacattcagaaagtcaaggcaacctgagaagatacagtgcccaaatccatttgtcttgccatcaaatcttagtggtatataatagaatagaaaaaaacgactcttaaagagcttgacccacttactctcactccttcagggttattgtttccagaggtgagtagttaagtgtgattttctcctagcttgttttctcttatggccaaaccttgctttagtttttattttctcaattattacatattatctgttatcttttttaaagggtcaaatgaaatattcagaaggctttactttatagatgggttcctgttgaaatggatcttatatctctaaccattgtacaggaggaattcattattgcctgatggcaaactcatgtctctggaccaagtgggccaagccctccccctgaggatgggtgtagtggttccatttaactgatggaatctcttgtatgcatgactaatgtgaacatttctcttctttctagaatctcttcattctaactctactttttttcctgaagttcaacataaaacctttaccacgaactcttgagcacttggtagattataagtgatgcttgcgtccttgtcctctagtgaacctttaccacaaactctcgagcacttagtggattatagctgatgtttgtgtccttgtcctctagtgtgttcctcaagtgtttgcttccagtgtgcatcacacttttatcatcagaaaagacaaacaaaaaatcttttaactctgttttgaacatagaagaaagtagttggatacctccttggaggcccttcttagctttagaaggaactgtcaagaactcaatggtcttatctgaaatttgctttgaaatttagagattgatgtatttttacaaagatgatccagttctctttttaaaaactaatgtttactttttaattattaaaatttcaataggacagcctgatgtggaatgatagccaggtgaactcaccctgctaatgaatgtccagaggtggccagcagggtgagcagcacctgaaagaccaaggtctgttccctcacccaaggctcccagagcctgtgtgtcatggccaaaagagactgtaaactgccaactgctctcaatctaatgaagacgggaaccggggtcaaaaattggagcaattgtttccaaaacaggtgcacacaaaacagtttactggagtgtgggaagaacatattataatttctattttatgcttcaatttcatccatttatattttatcttcaaaaatgttttatatgtatgtagtaatacatgtataccacttgtgaaacaaatattggagtttcataattttcttactgatgagtgcacacagtttaaattagagagtgttgaaaaaatattcatttacttatgttctaatattaaaccatagcagtctccataaaatattcactgtcggatttatacacttttgaactttgaagctatttgactattttgaccaattttacaagagaaacaatgatttacattaccttatcagtttgaaatgcaaactgtaagaaaatataaagcgcttaattctacaaagttaagtgaaatcattaatttgataatcattgatttttgcatttaacttttaccttatctcatcagaaaaatcttaagtatgcttaaaataataatgcataagctaaacatacgcagagaaaaactgcataaaatataacaaaatggcgtgaattaaaaagagtaaaaaaggaaggaaaacaaaggtaggaaaaacattagtaacactttgatggggattagactcaacaccatagtagttcactattctagacactcaattaagtattaactgatatgtatataaaactaagtaacactttacaatgtaaaatgtaaatgatataatttataattaacttttctgcattggcctattggtcattataatactttccattctataagaacccatgtaatgaattttaactcagaaataactttcccaggaaatgttcacttgtgatggaatttagtttccagagtactcagatcaattcaaaaaatctgcatgcagttcttcggagagagaaagcagagttccatcttctagaattccagctccctgtgttaggaaagcctttccttcaaaacaagaaaagaagccgccaaccccgaattggaactggcctcttcacatctggaccacaacatgggaggcggaggcaactcttcccttctcggtaccctgagcagacgtaccagtcacagtaattaatataaaaggtgtccttcctcttgaggcatcacttttaaagcaaaaacaagggaggctgaggcaggagaatggcgtgaacccgggaggcggagcttgcagtgagccgagatcccgccactgcactccagcctgggcgacagagcgagactccgtctcaaaaaaaaaaaaaaaaaagcaaaaacaaaaacaaaaagccctctcacacacacacaaaaacctgtttctgtttccctatgtaatgaagacccctgaggttggcagcagtgttgtccaccgccaactccctgtggtcgatctggaagcttcatctagggaggggctcatgaaggggcctcatgagtaacccctctcctgaggattgttattttcaagtaccagctctggaatcagatagtctagattcaagggtggccatttctgagctgtgggcctttaccaggttaatgcagctcttaaagacttgattttctgtcataacaatgggataacagtagaataagataaaaactatttcttatatataataagggattaatcaatgatcactagtatgtactagtaggaattatggcaccatggaaattatgaaaccaagaaactctacattaaaaaacaagttttattttataaaaacagaagagaataccttatcttcctggtgaaattgtggggagcagagagatgtttgcttgtagctaataccctccattaaggatctgccaaacctcctgattatccaaacactcagcggtttttttttttttttttttttttttgctgtctgccctttggccagctgttagcacctgctgcagagggtgggaagaaaaagaaatgaggtaattgagttcttgctaatggctgtgacagaagatttagagccttcagtggttcctacagtcaagtggcagggatcctagagcacactgctgctctcagaatggatctggcttgttctggagtttttgagattgacagagctcaaagttcccaggctccagagctcaggtgctggggaggatttcccatcacttctgagatttggggagctccaaggcccctcctcttgaccctcagtggagctcaaaagaaaatcgtcttgacctcagagacagcattttggggtgaagatactccaatatacttgtttctttctttcttttttttttttttttattatactttaagttctagggtacgtgtgcacaacttgcaggtttgttacatatgtataccagtgccatgttggtgtgctgcacccattaactcgtcatttacattaggtatatctcctaatgctatccctcccctctccccccaccccatgacaggccccggtgtgtgatgttccccttcctgtgtccaagtgttctcattgttcaattcccacccatgagtgagaacataccatgtttggtttttcgtctttgcgatagtttgctgagaatgatggtttccagcttcatccatgtgcctacaaaggacatgagctcatccttttttatggctgcatagtattccatagtgtatatgtgccacattttcttaatccagtctaccattgatggacgtttgggttggtcccaagtctttgctattgtgaatagtgctgcaataaacatacgtgtgcatgtgtctttatagcagcaagatttataatcctttgggtatatacccagtaatgagatggctgggtcaaatggtatttctagttctagatccctgaggaattgccacactgtcttccacaatggttgaactagtttacagtcccaccaacagtgtaaaagtgttcctatttctccataccttctccagcacctgttgtttcctgactttttaatgatcgccattctaactggtatgagatggtatctcattgtggttttgatttgcatttctctgatggccactgatcatgatgacttgtttctttctttctggtgttttccttggagaaagcaaaaatattgccctagagaatggcatggacagaaaagaagaagaaggaagattagaagtgaagccctgtgggcttgtctggtgagggccctcttcccaggacttagctgcatgggaagaatctgggtagcactacaaggatggaatccatggggtcttagttgcctgtcatcattttctttgccattgataattcaacacttaatcaaatgcggtggtgtttttgaaagatagcctgaagaaaaagatgaccatgactttcactaatagaatagaaaatagacaggagattgattatcacttaaaagaaaagggttcattaaacaggttccactgtggtttgcgcaattcaacccaaagtttctctgctgtaaagcaatgataagatcactctgcccactgagatcaattgagaaatcaaccaatatttaagaaggtctgagacttggcaaggtgcccagtgactgagaaaagagggttcctctttctttaagttggcagaaagacattcagctgtgatttttacgtggcctgagctaaggaagagactgagctaaggaaggcagtgtcttgtgtaggttatatccatggtgctctatgagcctgtgcacccattatccccagatatgtcaatgtgcttcacagtgtgcacatttcatggcacctgttacagttttaaaaagacagtttaattaattaatggtgaatgttcaatcttagatggtttttttaaactcaagataaaccattatagcttgagtgtttttgatgcatttggctaggagttaggaaatcttaaagaaaaattaattgctgtatcaatggaaaccccagtaggtagataacaaatttgtcattaattaaatgagaagactttttaatgattcgaggaagcgtcgtcaagattgtatgatagtttaatttgctaacatggtatgaacctgttagcttcagacacatgattaataaaagtaaaacccctcatggaatttctcagatgctcagttctagcatgcagtcatttttgagacttgctcaatgtccttatctcactttactgacagttctgcagcagccgtggcaaatgtaggttagacaaaatattacatgcaacattttctatgattcattttgctcctttttccctcttccccttcctctccagccaccctgagtcatacaacagctgtgagaacattagttacaagggagcgagctgcagacactttaggtgctgggctgtatcccattatatctggatgctgacaccaggatgggttctaaatcccttatcacaactgcctcaggcggaaaacatttttttttccttctgttgctgctgatgtaaagatgaagtttctcgagctgagagaattttatgtgatcgtattgtatgctaagcctcagaagataattctgtagctcccattcatcacaaaagcagggactttcagttgtgcttctttaagaaaaaaattccccagtagaaatcatacaatgatttagcggactaagaaaaagaagagaatcaccaacaggatgacttgtgacaattacacgaagtcatttgactgagttatttcctttattattctgtaaatgggaaaataacgaacatgctggttatcagctgtggttttgcaatggaggcgttccaccagtgcagagcggtaattacgctgcccggtctcactttgcaaatgaactgaagcctgtctcttttaattgactgtctgtctctagaattttcttgatttattgctgctcagtagaatttacttttgttttgttgatggcatttgtcaactctagtagttaccaaatggaaattgttctagagggttgctttggcataagtgtgctcatttgtgtggcttattggagcatgaaggagagatgtgcttctgtaagatgtcttgcccttctgcctgccagaggggcaggggctcacctggagtatgtttcatctggttccttagatctgtaagtgactatgaagcctttcaactggaagagtttagtcaagtgtaactgtatgatttcggaatgaatatggccccatctttgtttcccaggtggtgagtgtttagggcattatatagcagctgtgatgatgagagcttggcttctcatctccagctatgttagtctacctaggaagaaggattcttctctaagaagaattcagtgggacaatatccagagatacaaatctcaagagacagactcctgaaaacaaattgactgctcatttggcttcagattccatgcataaatctccagctctgactgttaatcacagccactagacctcacgacataggattttagaggcagataaagaaaatggcagttgatgtcttagcctgttgctatgccagtctatgatgaactagcactacctgaactcaagagtaagaaacaaatgaaactggttataaggtttaggaaaaagcaaataagctgttactgagagtggtgaccatatggtacctatagggtacacgggccctctgtgaaacccgtaatattgggctgcgtctcctctttcctctacaacctgaccccatcgcctcatttgatggattccagtcaattgtaattttgagaattgtaagactagtatactagtatgccaatgtcttgttcttttttttttttttttgagatggagtctcactctgttatccaggctggagtgcagtggtgtaatctcagctcactgcaacctctgcctcctgggttcaagcaattctcctgcctcagactcctgagtagctgggactacaggcgtgcgccaccacgcctggctaatctttgtatttttaagtagagatggggtttcaccatattggccaggctggtctcgaactcctgacctcgtgatcagcctgccttggcctcccaaagtgctgggattataggcgtgagccaccgcacccggccgccaatgtcttgttctttaaaggaagaataaatacacatttagaagatggctacaacctcatgcaaaggtctcgaagcagcaagttgagggacagggcttactggtccaagagtaacttcaggcagggaagccttttcccatgtccttcaaattgaccacatcacttggatcatgaatgctgttgatctggtttcaaaacataagaacaagcatcttcgacaatgcggttgataaacatcatcaacaacaacccaccgaagcatcagttgttttgtcttgtccgtggcagtcctgcattcagatctgtattcactgtgtgatcacatgcatttttcctaggcctataataggtttccctccgcatgcccaaacagtggagctagcatttttttaaatttacaaacaaagattgtaaaattctaattgggagtgggacatcctttttaaataaatagtcgtattaatagtaatagcaaggagaccatctagatagtactctattttcagggctcaaaagtgaaaagctagaaaagccagctgtttaagcattggcaggcaagttatgatacggagtaccctcctcacacccactccaaactaatgtgtcatctttctctgaagagctgtggctgtttttgtggttctgagttgacggggatttttttttttcttaaagaggtacatgtttatgtttgcaacatggtatttcttgcagccatactcctcaagtcaccatctccaaagctcacacactaaacagggtcaagtgagtcaaagcagcaggagagaaccatgattggggtgtctgggactagaatggggagggcagcatgtgcgggtgcggggctggccttcccgtggtctcaagagtgggaggtgtgagtctctccctggatgtttagctcagcatcacctcagagtttgagcttgactgaaaacaacaacaataacaaatatgccgaaatatgatatcatttaaaataaacccaacaacctttaaaaattaacattattccttaatcggaccattttactggtctttttttcttaagtcaggaaaataaatgcaagcctatgtgcaggtcctcaaaaaatgtgaaaataagcctagtaaaaatctggcaagagatgtggtttcatcagccacctcataagcagatcttttcacatagattttaagagagaaagttggtttatctgcactttagtggatgcttccgtttgcttaacttccgtaataagaatccctagaaaaacctggagataattagcagaagggcggaagcatgaatttaaattcttatacccacacttaattttgtcaactttatgatttgctaaccagtgctttttctgccagtttctttaagtctagcttagtattataataaaaggaatcaataataccaatctatatagtaattttcttcaagaaattcaaaatcctatggaggaatttaagaaatattttaggccgggtgtggtggctcacgcctgtaatcccagcactttgggaggctgaggctggcagatcacgaggtcaagagatcaagaccatcctggctaacatggtgaaaccccgtctccactaaaaatacaaaaaattagctgggcgtggtggcacatgcctgtagtcccagctactcgggaggctgagacaggaggattgcttgaacctgggaggcaaggttgcagtgagctgagatcgcaccactgcactccaggcctagcaacagagagagactcaatttcaaaagacaacaaaacaacaataacaacaacaacaacaacaaaaaacaaagaaatgttttaatatgagaaaacattttgcaaaagaagacatacacatggacaacaggtatatgaaaaagggctcaacttactaatcatcagagaaatgcacattaaaagcacaatgagatatcattgtaccccagtcagaatggctattatctaaaagacaaaaaataacagattttgatgaagatgtattgtagagaaaagaagacccttatacactgccggtggaaatttaaattagtacaacctctgtggaaaacagtatggggatttctcaaagaactaaaaatagaacctccatttgatccagcaatcccactactggaaatctacccaaaggaaaagaaatcaatgtatcaaaagcctgcacttgtatgtttatcacagcactatttccaacagcaaagatatggaatcagtgggtgattggataaagagaatttggcatatatacacaatgaaatacataaaatgcataaaatacaaatgcataaaaagaatgaaagaatgagatcttgtcatttgcagcaacatggatagaattggaagtcattatccgaagtgaaacaagccagacacagaacatcaaatatcgtgtgttctcactcctaagtgggtgttaaaaaatgtgttcacatggacgtagagagaggaatgatagacgatggagatttggaaaggtgagagagtgagagggggtggatgatgaaaaattacttatgggtacaatgtacataatttgggtgatgggtaccctagagccctgacttaaccactaggcaatctatgcatgtaacaaaattgcccttgtaccgcatacatttattcaaatagaaaatgaaatattttagcctatgctcattagtttacttatgaagcatctacatggctcactgcactttcttcctaagttctctgacttctgaggcaggaggtgaggccaggcagcgggcaactgtgcttccctttctcaccaggacaggtgccaggagcaagggacctaactattttggtgcaaagtgttcattaatgggtctgtgaatcccatctccagctccagcatgactccagggcctaacattaacttgagaacagtatacaggaaaagggatgtttttgaaaatgctgattatttcatagcctctgggtgtcagccgtgaatctcactttaagccccgctagggatcctgttgccaccactgagcagaaaatgcagtgcttctgtgaaggaatggggcacagaacagtcaccgctaatgtgttcctgaaaaagccggggtgacctttcttgtggctgcttcagaggatgatgtcactttgggacagaaaaaggaagatctctttccagttcacataggataataagagttctgattcttagttgcatgttgaagaacaaacaaggagcatagacactcatcctggggaaaaagactatggaatctttggaagctgagaggccagccacttactttcctgggatagagcttttataacccccgtattgggcttaactccatacctttgacgctaaagttgttcactctctggggaaaccatcaaaacaatcaaacagaaacaagagcttttaaaaatggaatatttaatacttatggcacaaataccttttagaggattgcaatgatcatggtagagagactgattcagacatttttcaaatgtttgttggaaatgtctgaaaatgacaggcagtgatagtatcaataactaaccttcatcaagatatctgtgcatcggataatctgctatatactttaaagagattatgtgctgtatgcctcccaacaacccaatgaggggtgagcgctattattaacaagaatatgtaaggcaactgggactcagagagattcagcaccttgccaaaggtccaacaggagttcctttagcaagacttaaaaaaatgattactgtggaaatttccaaacatatacaaaactagagaaattataatgagccccatgtatgcaccttataaattcaacaaatttcaatacgtggccaaactagtttcagctatcctcccacctgctttcctaccttattagttttcttttgctgctgtaacaaattgtcacaaacttcatgacttgaaacaacacaaagctattctcttctagttgtggaaaccagaaatccataatcaagtccactggataaagtcaaggtgtccacagggctggttctctctgaaggctccaggggagaatccatttgcttgcctttttcatctcctagtggccacctgcactccttggcttgtggccccttcctccatcttcaaagtgcctcactccagtctctgcttcttcattgcatcactgtctcctttgacactgattctcactcttctgcttccctcttataagaaccttgtgattacatcagatccaccagataatccaggatcatctccatctcaagatctttaatttactcacatctgcaaaatactctttggcatgtaagataaaattcataggttcccgggattagaacatggacatatctggggagccatgaatctaccacccgcaccctagcaccaacaggaatattttgaaacaaatctcagacattttatttaatccataaatatgtcagtgcatgcttcccagaagataaagacttaaaaaataactgcaataccattatcatacctaaaaacattaataagaattctttaatatcatcagctatttagtcagtgtttcagttttacctaattgtctcataattttattttaacaaatggtttattcaaattgagaaatgtttcttaggtctcttttaatctgtcagttccctttccttttcctttacttccttctttgtaatgttgagagaactagattgtttgtcctacggaatttggcaaatgtgttcctgtggtcattcacatgtggttttttttttcctgtattttccataaactggtagttaggtcttgagacttggtcatatttatggccgagaatttgattttatggccaagaatgcttcatcaatagtatgactttctattgtaccacacggggaagccaatgtctgttgtctccctcctgtgatgttaaggttggttgctgagttgaggtgttgagcactccatccttcttgtatcaaattccccatcagctttttacctacattggtgattatggcttagattcattacttcatgagggggggttacgacatagtcataatctaattctgtcattcagttttcatttttagccagaattcttatataaaaaaataaactttcctctatttgattatcttgaggtacaatttatgaaagaaagacaggagaaatgtctaattctttctcctaatgcatccatttgcagaatagtaactggttttctagcatcctacaaggatgaaaaagtgtttgtgtatgaatgtatgtgcattagtaggaagtcacggtttcgtatattcgtgatatttcagttctttgcagaagttattctttttcaaattgccccatctttagccaatgagagccccttcagattggctacagactcttttgacattaacctagaaacttcattgttttctgatgtaacaaaatgttttagactcatcttgtatatttactgtcccaaatatcaaatcagtgtttactccaaaaaagcccgtgtttcttttagtaggaaacggtatttagagaccatactctaaatcctgtagatcaggggtctccaacccccgggccatggaccagtaccagtccgcggcctgttgagaaccgggctgcacagcaggaggtgaacagcaggtgagtaagcgaagctttttctgtatttgcagccaatccccattgctcatattactgcctgagctccgcctcctgtcagatcagtggtggcattatattctcctaggagcctgaaccctattgtaactgcacatgccggtgatccaggttgtttgctccttatgagaatctaatgcctgacgatctgtcactgtctcccatcacccccagatgggaccatctagttgcaggaaaacaagttcagggctcccactgattctacattatggtgagttgtataattgttttattaaatattataatataatagaaataaaatgcacaataaatgtaatgcgtttgaatcaccccgaaaccatccctaacccccttgatctgtggaaaaataatcttttatgaaaccagtccccagtgccaaaaaggttggggaccactgctgtagatgctcagagctacttggccttatcattagtcgaatctagaaaattgtgtaccaaaagaactgatatcaccggtttatactgttattttcaactcaaagttaatattacatggttttacttaatttatgttatattatatttgtatttattttctcttatgctgaaaattttggttccaaatatcctcagtataatgacatatatatatatataaaagcatatgtatgtacatatttctctctatatatgaaataatatatcctctctatatgtaatagtatactgatatatatataaaatatactaatgcaaatacacatgtaatagtatattaggagtataatatatagatacatatagttttataagaataatagtgatgttattaatactataaaaacaacttaagatttaactacagtttcttttgttcttaagataaattctactagagatgtacagttaaatcgcagagttttaaaaccactgtaattaattccccttagtgtaattaaaccaccaactcgatgcatagttagctcaatgcaccaataagcttatgggcttattagttttattttgctttctacttagtgattgctatttttaagcatatgtaacactaaccttatggttcaaagtcaagtgtataaaacaagatgcattcagagaagtatgactcttattctgtctccaacctgacttttattctctcttctaccttccatctatagagaaccattttaattcaatttttatccttctactgctttttaataatttagccatagatattcataatccccggttaggcaaaaggtgtgggactaaacacactgttctgcatctggcgccacaacttttgaaagtaaaactccctaggcttgggaaatagaccattatttactttcttactgtagacctatcagtcgttctatcagaaaagggtcagtcctgcaaaaatgggaaaccagaatcctctttagattttagatttttcaggggtgtgtttgtgactcacactgtgatgatattaatgttttactcattataattccagtataccaccccaaaatcccccaaaacaaacaacagtcataattaattgtatgcactgattttggacatactgctttattttcagccagatggtttgccaaaaaaatatttttctatgttactatgtgataattataaacatggttttaatagtaattgatgttccagtaagtgcacatactataacttgcttaccatatttcattgaagggcatttggttggtttctaactttttgttatatgatagtttaaaacactaatttctctttgctcaagagccctgaagctttgaactgatggggactgacaccatttagctaaaagatatcttgttcttactttcctggggtcctttttttgaggggtggaagtgtgaggaaacatggagatcttctcaacccaaagaaagccttttactcaacaatttcaagagaagaaaaatatgcaaagtacaaaagatgaagatagaagggaaaatcgccttttatattaggttaaatttttgagatagggtcttgctctgtcacccaggtgggagtgcagtggcacgatcacagctcactgcagcctcaacctcctgggctcgattaattatcttaccttagcctccaagtctaggtccacaagcacacaccaccatgtctggctaattttaaaattttttgtagagatggggtcttgcaatgttgttgagactggccttgaactcctgagctaaagtgatccttctgcctaggcctcccaaagtgttgggattacaggtatgagccactgtgcctggcctgaggctgtttaaaagaacaaaaatctttataaaaagtttcattgctgtttcttttctaaaataagttgtctataccagtggcatgcaaaatgtatcatatcagatttaatatgtgaataatgagggaaactgtgactttggacagaagactgtcgtagactgctctagtagaacagaatcttagctaatcaccatgcagatcccctgggttttagagttcatactgatcctcaactgggggctaacaatggtttctcatttatcattttcccctgcttgttcagcattctacttgaagccacagagaatgatggagcttacatatttcctttgataagatgaagaaatgaaaacatacattaatgaaaaataattccagaggttttttggactataggagttaagaggagctgaccagtgagcctgtggttgtccatgaaggttctgtggggtagagtttgaactgtccctatccagaatagtaggagggacagagatgcttatgagtgaaggccgcagaacaaggatggcatgacttgttcatggggctggggagaaccagtctgaccagacagaaagggttattgtggtttgacggtcggtgaaggttgttaggtggcctttggccacataagagagtgttagaaggtagacagattattttaagtgtgatgaaacaagtagcagttggtatgtagagaagtggggagaggtttgatgaaaagcagtgtgttagaaagacggttggcaacactattaagagtagattaaaaaggaaaaggaatgtgaaattagagagaccagaaaggaacctattatgataataaagtcatgattccatggaaagctgaccagaatgatgatactattagagaagagagaggagaagtaaggccaattttttctttaattaatgagtcttagtgactgaatgtgggaaataacagagtagtgattccaggattttaagcgtcggtgattgtgagaatgggcaatgcaaagtattgattaaatcagcagcattagggttgggaactagattagaatgggagggggatgatatagtgaattcctccctccctccctctctgccttcctccttacctttctccttccctctttcttttcttccttcccttcctctcttccttccttctcccctttatttcttcttatctttacatcattatttacttttacatttagcaactattctattccctggagctctggtaccaataaacaaaagaaacaccatcttcgctctcttgaagcttacatttcattaagcagagtggcagataaaagaacaagataactcagatagtcatggtgctacaaagaaaataaaataggcttatgtgctagctggtgattgaggctgcagggactggacagtactactttagactggagcttctggaaagcgacttaggggaaacactcaggtgtcagccatgtgaagatctggtgacatttcaggtcattgcaggcagaaaaaaacaaatacgcaaagataagaacagccttggagcgtgtgaagaacaaaatgaaagctgagggcatgggagggtacatcgtaagagcaaggaggtgaggccaaagtgtgtttcagtcaaggacagatcaggacacagaaaccacctagtaatttaaacagggatggtctaatacaaataattattaattttaacagagaactggagtcatgagggattcaccagtaggaagtaaagacaagtctaaaaaatgtaagagcagcagatatatgaagcagctaccacccataggactgagatacagggtttcctgcccccaagataagaccagacctggttagagacagcatgaccatggcaaactggatagccaagaagtcagtgtcatgctgcagcagtgtaacctgctggaagtgccttctggaagaactttctgaaagttcttcatcaccctccatgatgccaaggaaagctgttcatagggagttgtttcaccagtggcaatctgctacgaaaagggcttctgggaaatgctggcatccagatgctggggaagctgcccagacagtagaagctgaattctggggaagctgtatgcttgcaggagtcagggggtgcagaagctgagtgctggagaagccactgtatcacaggagctgggtgcagaggaaacaacgcgtgcttcagaggctgggtgctagaggcctgtgcatgttgtaggagcagggtctagagaagccatctgcgtttcaggagctggctgagaacacactgatatgggcccgggggtggggtgggggtgggggtggggggaggtagaggagtggcagggagggaggtagtgggtggggcagtaggggagagggggttggggggttggggggaagggttgggggttggggggagggggtggaggtggggtgggaccctttcctcctgcaaggcctttctagctccctctactgacaaaacttaatactgtgtcagctagcaaagaaaatacctaaagggatcagctaaatttttgctgagcagtcaatgtacatttggagctgagaggcaataaactggcatagagaagtagcaatggctctgatctctgagggcctcgcagtcgtgttgatgattgtattcatttagatgctggttgtggttagtgcttgacattttaactaattttttcttccaattccaatgaaatagataattttattattcccactttacagacaagaaaactgaggctgagggaggttaaatcgcttgtccacaatcacatgctagtgcggcatggggccaggattcaaacatgagcagtcagtctaactccaaatctgcccccagactccataaagtcattactgatctttgaacagacagataaatgtatcaggaaagataaatacttaaaataactttgcagtcagtccttctgtaattaaatcagccacctctattttacagattttatgaatttagaaattttagttacttttaaagtaaagtacaagtttaccaggaagtacaaattaaaataaaacgtggagaatacaacacctttcaaaggaaagtagagaaattggatgattgaggtaattagaaaataatattttgagtatagtttgatggatttcaggcttcttcagcttgacaaaaacagaaaagagggggaaagttcaaaaatattattatggatttgaagagatgtcactcagaagatcttgataaaatgttcctcatccctagtggatggggggcgtgggtggcagggtacaaaacgaaacatggaaccagtgatgggcttttaggaaattctatatggagcttttaccatgcaccagacctcaggctggggaccaggggtacaaggatgagtaaggcatctggccttcccttaaggagcttgttgtctcatggctgggacatgataaggacattactacagacatacatgaagagctaaaggaataatatatggaggaagaactagttctgcccaagggggaagtcaagggaaggtaccaagaaagtatagcatttgagttggatgaagaactggccaagacagctgaggaaagggagatgtagattaggggccgacacaagtaaggggttggcaaggacatgaactgaacggggtttgaggaaaaagcttagcacggggtcaagaacgtagattttggggttagagtacctaattctggcctcctcaatattttctagtttcatgatcttggtcaaattatttaatctctctaaatttcaatttctctgtctatacaagaaaataaagtaggccggccatggtggctcacgcttgtaatcccagcactttgggaggccaaggtgggtgggtcacctgaggtcagaagttcgagaccagcctggccaacatggtgaaaccccatctctactaaaaatacaaaaaaaatattagccaggcatggtggtgcatgcctgtaatcccagctacttgggaggctgaggtaggagaattgcttgaacctggaaggcggaggttgtagtgagctgagattgtgccattgcactccaacctgggcaacaagagtgaaactccatccccccacccaccaaaaaaaaaaaaaaaaaaagaaagaaaataaagtagtacccccttcagtgtgttattatgcagactgaatggtatgaaaagcatgttttcaccattactggcacatgctcagttaacgttttcctgccattcgtagcagcaggatgaggagtattgaaaaggctaaagattagagttctgggaagaataataaggattagatgtcagaaagtgtgtcatgacatatttgtgtgtatgcgtgtgggtacacagaattttgaaatagttttcaattgaagcctttgtttgtaaccagtagcacagggagatgttcagttttgcacataataatgaatatctgttatgtctgttagccatttgtaactactattgttgtttctgtcatctccagtaaagtgtttctgtattttcacaaaaatgagcaagacctaccacaaaaaattatcaggtaagggtgactttatgggtcccctgctgtgtatttgacaccaaaatgactcatcacatgagttcctaagtgctatgtttggtttcagtgtagaataggagattgtgtttcccaggtagaaaaggagactttgaaatctttctcataaaatgcgtgaaaatctggtgccatcagatcatgagtcttgtcatcaggatgggactcactcttggatccatcaaccagctagctaggtaactctgagcaaataccagatgctcttcagcctgtgtcctgatctgtaaagttgagatcataatagtaatacttcacagtgaaattgtacactagaatgaaagaatgcataaaaagtgcctcgtaccctgccacgcacagagagggtgatacacattggtcccctcatccagcatcttctaattcacccctccctgtccccagcttctcctgtctggggatctcaagttgggaatggtcatctttggatgaagctgccatgtttatgtggacttagaggcagatattctattgggaattcaatggatgcataaggcagtgtaggggaactgatttttagggagcaatatgaagtcagagaaattgcactcttatctctacttacgttcctcatggtcccttttattcttttatgacaaatgttacttcaagctacagtagtgttttcaccaggggctgaaggaattgatggagttgttttctttagaatgagccgtaacatccctttgttcacagagattgtaaatcctgcatctttcagattagatcatgtatgttcaatatcagtaggaaacaaacagagaagtaaatatttgctacaaaatgtctttctgctgccttgaaaatgagtttcctaaatctgacatgtcagttaccctgcttcatctgtttcacatttagagtcaaaggaaaacaatcccccacagcaaggagcctgtcacttcacttggtgtatccagtgaagataatgtgaccacagtgcagtgggattgaatactgataaggatgtggcgggccatgcttaaagtttggtgtctcattcaaatgactggctgagagatgaaaagaaaacaaaaattaatccccctcctggaaccttatactgattcacttagtggttggttgctgctctaaggtctgtctccttttccccccattaataatcataatcaaatagccattattggtttttggcaacagggtaattactttctcgtccttattttctgggacagtcggtctgttcatgagaaagggcggttgtgcaatcgttctccctacgtcaactctgagaagtcggttgtgccctgcagatattgatgtcagcctgtttgctctctggtggagtgaaagaagaaaataattttattgtgctatttttagacttcaatttagattgcagcctttatgatactttgtgtactggggatagaactgttgatgcagaattcagctgtgagatgctctaggttctacctgcccctgaaagatttttttcgcttagcctgaatgccttagaactattcagtcacattgccttcatcgtcagctgaaagctgagccatgacaatagggttaagatgcactttgtattgacagtgtttgccgatggaacttgctgccagcagtctccaagtctgcaatttgcctgtaaaggcctaatctgatcttttatatgcataaataatcagcaccatacaaattctctatgaacaaaatgagtttattgaccattcttgcttttctaaatagttttccagaggtgatagatgaaagccagacaagaaaaaaatatttctttgctggatttccttctgaacaaacaagaaggacccaggtacctgggactccaggtatctttttctcagctgggatggaaggccatggactaaagcagtcttcctagttctttggtattagcaatgagctggtcttaaacttcaaagggatctaagaaagtgccagtaatacctgtctgagcttgttttgtgacgtgtatgttaccacatgtattaaaattcagatcaatttgcatctaaattatatgagtgcatgtgacttggcaatccagaagctgtcaattttagtttataagaacctcaacttgggcctggtatggtggcttacacctgtaatcccagcactttaggaggctggagcaggtggatttgaggtcaggagttcaagagcagcctgaccaatatggtgaaaccccgtccctactaaaaataccaaaattagccgggtgtggtgacgtgtgcctgtagtcccagctactcaggaggctgaggcaagagaatcactggaacctgggaggcagaggttacagcgagccgagatcgcgccactgcactccagcctgggcgacagagtgagaccctgtctcaaataaaaaagaaccgcaacttggtccttgctactccaagtgtggactgcagaccgacaacattgacatcacatgggtgtatttaaaaatgcagaatctcaggcacttccccaacctacaaatcagcacctgccttttaataatattccccaagtgattcataggcacgttaattattttttaagtcacaaatctttttaaaaatctactatgatctgaatgtttatgtctccctcaaattcatatatttggacctaatccccagtgcaatgatgttaagaagtggcacctttggtggtgattaggtcacgagggtggagccctcacgagtgctgattagcgcctgtataaaagagggcccagggggctcccatattcctttcaccgtgttaggatacagcaagaaggcaccacctgcaagaaattgggaacttaccagacatcaaatttgctgtccccttgatcttggactccccacccttcagaactgtgagaaataaatttcttttgtttataagccacccagtttatggcatttttattatagcaactggaacagactaagacagaatcccataaaatctgtggaacctcttcccataaaaatgtacctacacacacaatttgtatataatttcaatggtgcaagttccgtggacttcaatgacacttccattcattggaagcagagagcatgcctgagggagcccccaagtgccatgtgccccgaacaatgctgacccatactgctccttgattgtcacattgaccaggtcttcaccttcatgcccagaccttgtctatgtaagcagcaccagcctctggggtgtcccatgtcagcctcagcagtccctttcatccatgtggctctcattaaccagtccttgctatcattttccttgcctggctactctggtcttttgctttctccttccccagtttagggactggtgggtacaaacattttagaatgaccatgaagtaatatcagttagctgaaacatatctatcaagattctttcctacccaggtcaggctcataaacagatgagatggagaaaataggtcttcctgctgtttcagctgacggtccacccatgctgcaggtcctgctggaagctcacttctgtgttctggtctgtgctttgatttcttctaatctttggtgatggcataaggataacgcaatgcaggctaaagaaaaccctttaagaaatctgttcacttactggcggatttgcttatcataggcatgccctgaccttgaagagtccttgctctggtagggaagcgcatgtacatggatgattaaaataaatgcttcatgtcaaaatacaggtacagaatgctattttgctacgaaggaaagaataactagcttttccaagaggagtgagggagagcatcaaagagagctggcttttaagggataaagcagacattgcctgagataagagctatagaattgcttattgtgagaaactacagagttgggaagatcgagatgagacaggcatatgagcagaagtgagagacctggcaggaataagagctagcacttagaccctgcttgctgtagggcgtgcacaggtctaagtgctttatatcaagtacctgtgcagttctctccacagtccaacaatccttccattatggatgaggaaacacatgcgcaccgagttcagtatcttacctaacgctgtgcgactgcaagcggtggagctgggctttgaacctatgcagtctggcttctacactacacttccaggcagagggcatctccctgtgcttctgggataaaacttgcagcactgccttgtctaggactcaagaggcactgttttctcctcccctactggttctgcagtctttccaactctttccacttcatcaatgagccatgtccatcctcacatcactatgtgtctgtgtaatacttagggccactgagttatggggaaaaagagaaatggatatttcttagtattgtctggtggttctgttatctcacagttcatggaaaccagatcactacaggcacaaggcattaccatcagtctcagagaaggcctgacaccctgttatagatcagagagtcctggccaccactaaaggtcttggaaagacacggggaaggcaagcagaagcacaggtggcctgaagacatctccttccggccaagagtccccctgctcatcccccaccccacccaggcaccaccctccacagctaaaggtgtttatgctgtaggaaccctgtggtggtaggagatcgggggtgatagggctgcttggataggaaacatatgtgattgttggcactgctcttcatactgttgtcaaattcctcactgcttctgtgtacttggggtgacagtctgacagcctgtgaggtcagacaaagcccagattacttccctctcgcctttccgtctcgcacttgtgggctgccattcttaaaggagtcacgtgtgggctttctttgccagaagtaggcatggcttacatcttttgggtttgggcactggaaatgactctgcttcccctgcagacacaccctgatgaggctgcaggccactagctctgctcctttttcaacatcagaaacagaggctgaccattgctgggacatttcccttctcctgctcctaactttgtcatagacgtctcctgaactgcagttactgtgtttggaggtaacatcatccccttctttggtttgtgggtagggaataccagatacgagggagagcatccctaaggccttcacctgacaccagtcctgcctgtatgtcctgcagttctcatggtaagccatcagcctcgccaggcggcacctgtgtgccaagcagcatggcttattcattgtcttctctagaacacagaatagtttggggacatttctatgttttctttctccaacagccagatatatgtgtccacttagctgcacataattattgtctctctaactctttgacctacacatttgtcagataaaatattttgggtgagagcttgttagcagatctatttccattccactcttggcatttattagcgagccctcttcgggaagccgtatgttctgagaagtaggaagaataacgcattttacctatagtgcaatgtctggccagcgcctattctttctgggttgagctgctggaatgtattcaggggataagctgagaggcgatttacgaggagtgctctctccttgtcttgctcctgcttccctttaaaattccttggctgcccttagtgtggcatgtgtttccatttatcctatagttctcaagactcaatggagctcttgtacttctgaagggcacttactaggaagcccttctccctgacgttgagcttgcactgatcaaaacggggggccccacaaaccatcacagggatatctatgcaaagggggaatgtttagcaccaaagttaaggactgtgcatgctttggcagaattacaaaaggaaaaataagtggacaaagtatgttactttttttttattattatagggtgtgtgtggtttatttgaacatcaacaaaaacacaacagaaaggggtaaaatgtaaaggaaaagcccctttgctgtcctccaaccctgaggaagctgttagcagttttaagtgcatccttccagaaatatctccctcatgtatggacatatatgtcctttagttagttttagaaaattcaaatggaatcataacagaattttgttctgtgccttgccgtttttgcttaatttttcttggaggtctttcaactttaagaggtaaaaatggctgtatgatatgtaacaataagtgtggctgattccaattttctccatttggttgtttccagttatttctcatgctgcaatgatcatccttttttatatgtctcttttaccttgtctgaatattcctgtagagtaaatgcctagaagaggaatagctagtgaaaaggacatgtgcattttaaattttgaccaatattgctgaattactttcctaaaaaaggcagctgacgtatccctcacctttaaaacagcaaactatacaactctcagacctttgtctccgaatctgtgcatctttatattggatgcaaatcacgtgttgattggctggttttttttcttcctctgccttttttgcttattttcttttgggatatttgcttttttacttcttgactttcaaaactctttgctggttaataaatctaactcatagaccatgcaacgtgttagaaatatttttttctaatatgtcatttgtattttgactttcatttatggcacgtttgccacataagagtttaaattgatatgtgtctaaatttttcactgtttttcacttttggatttcaggtttgtgtttgcttagaaagtttttccccacttcgagtcagtcaaataatgtaaaaattttcatttagctattgggcagcttagaagccaatactagactggccaaatagagtggcatgttgagacttaccctgagattttagtttttaatgcagcgaatccattgggatcacttataaaaaaggattttaccctattaatctttactagaatggatatttttaaacttaatttttttgtgcttctcattgtaggagtcctttgaatgtagcttccctgagtgttcattcagttcattagttattgagttcttatagtggatgacatcttgctagtctataggcttcatagggttttaaaaaatgaatacgaaatattcccaaacctgattaattacatacagtagaagagggcgtctgtagacaaaacccagagatcaaggcagaatgtaacaactctcttgagagtactacaaaatgccatgtggttcagagaaaggacatcacatatggttgtgaggtcagggaagaattttatattaaagtgacatgagccttgagatgggccttgatgaaatggttggatttcaatgggtgtggattttagagaaagggcataagaagtatgcatctgtaattagaaacctgtgcatttgttctgggaagagtgagaggtccactttgcaggtgtgtggagaactcacaggggtgcaatgaatgagtccagagtagggctgagggcatcttgggaaaggcctctgagaattttactctccatttgaaaaggaataagaggcattcacgtttttggagcaatactagatgggatagattggaagtatgaaatatttgaaggcagaaaggcccatcactaattgtagttttcctggagtaaagaaataaaatgcttaatgtggagtagtactggaaatggggaaaagcagacctgaacaatattctcagtttataatctgtaagagggtactggggctgaggaaaataacaagtttaaaaatgaccaagatttctagccttcatttggttcactctcttaacatgcattgagttcttgctttatgtcagcactgctctgggcgcttggactagaggagttgaggagttggcacgagacaggatccctgctctcaaggggccacagaaaacaaacaggccaggatgatggcaggtataaggaaaccatgaaaaaaaatggagaaattaagaagaagggcttgtttgatggggagccctgataactttgattctgtgtcttaaaacttcaattcatgcttcatataattatcaatttaattattgctggtggtgttctctttctctcttcaccctggtatactacggagtgatacaggaaaataaattgttattcgaattttaaataggctgcaaagttggaaagcactttaaaatctgaggctggttggcttatccacaacaggaaagggaagtatgttacactaatgatgagaatagatctttgatttctgattatatcttagtttcttcacctgtgaaatagagacctgtcctaaaacagtccttgtactttgctcacagtttggtgagtcataaatttgggaaggtcttgcctgggcatttctctgcacgggcctgcaccagggctgaacgtgcacaatggctcactggtgtggctggcaatggcaacagctgtcagctgggatcccagagggggccactgaccaggcatgtagtccctccagcatgacagtcttgggctagatagactccttgcatgacagctggcttgtctcagagcaagtgtcccagaagaaccaggtggaagctacagggcctttccctaccttgccttggaagttagatggcattactccctctctgttctattgattactccaaggaaggcaccaaggtcagcccagattcaagagaggaggatatagataccagctctttattataggaatgtcaaaagagtaaaggttatgtttttaaaacactacaatgtagcaataccatcttacctcatgaggttgtcttgaagactaaatgaagtaatatatgtacaacccttagaacagcacctgaccaaaaattattaacaatggtgatgatggtggtgctgggagtggggatggggatgaggatgatgaggatgatgatgagtagctgcactgcctttctgcaaaatgtcccttgttgtctggcaggttgagttttggaaagaatggttttacctaatttatatttcctataactatgaaggggattgtcatcggttaattgccttaatctcatcaccttctaactaacaatccagggaggggttgctatccattgtgttctaagggagacctgaatataaactaaattctattaggaagggcaagacaagaaagagagggtagtttcaaccaacaatgacctctacatgttcctcgttaaatactctttcttatattacatttcttcctttcatattatgaaatggcattggagaagaagactaaaatttccaaaagttcagtggaaaatagtattactttttctttcttagaaaatagaagacaaaggaataaaatttaaacatgtctaataacaacattttttttttctgaattggaggttaagttgcccagggaaaaacatgcctacagacacatgaggactattctaccttcatcagtttgcagtggaaaatttagtactattggccattcacatatcagatattttacaccatcatataaaaagacctggttattttctttttttctttttttatttattttattttattattattatactttaagttttaggatacatgtgcacaatgtgcaggttagttacatatgtatacatgtgccatgctggtgtgctgcacccattaactcgtcatttagcattaggtatatctcctaatgctatccctcccccctatccccaccccacaacagtccccagagtgtgatgttccccttcctgtgtccatgtgttctcattgttcaattcccacctatgagtgagaacatgcggtgtttggttttttgtccttgcaatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagtacctgtttttccctgactttttaatgattgccattctaactggtgtgagatggtatctcatcgtggttttgatttgcatttctctgatggccagtgatgatgagcgttttttcatgtgtcttttggctgcataaatgtcttcttttgagaagtgtctgttcatatccttcgtccactttttgatggggttgtttgtttttttcttgtaaatttgtttgtgttcattgtagattctggatattagccctttgtcagatgagtaggttgcgaaaattttctcccattttgtaggttgcctgttcactctgatggtagcttcttttgctgtgcagaagctctttagtttaattagatcccatttgtcaattttgtcttttgttgccattgcttttggtgttttggacatgaagtccttgcccatgcctgtgtcctgaatggtaatgcctaggttctcttctagggtttttttggttttaaggacctggttattttcaaagcttccaagaaatggagtaaaatactaatgccctttaagtgaacatattaataaatcaggaaagagagtttggttataagagctgaaactctaggcatctgtgtcagaactcagtatttactctcctaaaatggatagaaacctacaaactcactgcctaccctctcccagagcaccattccccatagaaaaccccatagaaaaacactaacatgcctgggtctcaggaggattcaagccacactcagatgatctcctagaccccattttacttccaactggcaggaatcacaggaatggtgaatatcaattctgttctcaagaacttacccccaaacactgaaattgtatctgctagctgcctcattactggttgtgaaaacatcaccaaagatcttgcacagttcaagtagctgtgagtccttctcttcaataattattactaatgatctaattgttttccctgggcagaaatagcaaagcttctgaagacttcaaaatcaaccactactctctttagcacaaacagatcaataagcaggtatcttaaaaatccaaagcttgatgaaattattatgtattatgaaattacactgtaattttaccactacatattttcctcagcactcagcatagcatcccctcaaactggcttccaaactttgacgtgtgcattctaagagaagtttggggactaccctcactcagggtgcacatactctgtcccatcaaatagcaaatagacacaaagttacagtattccagtcattatactgcagaaaattatttacagaagcagcaaacctttcttaggaaagttataagctaggctgctggctctttcctttgaatccagcctcgctcacaccgtagaagccagagcaatgttgatggatctgtcaagttcataataaaaaataacagagaactcctcaggtaactgaaggtgatttggcccacgtgtggggagaaaacagatgacagcgtggagggggcttttcagacatgaccttttcttcctccttcacattgctgaggaaggccaatcctacctaggtgcttcaagaaacaaacccctgctggcagtgaggctcggggttttgaggctagacaagcagtagcagaggagcactgcctgggagggggtcaagcagatggccaggatttcagcatctccatcctccctgttccccaaggggtaggtaattacaattgagggagactatatttctgggagcacagatgattcccccagaggctcttttccctgcaccctcctaccacctgaacccactgggacctgcacaagtgagggccttggcagtatccacttctccaaagacccaagaccagcctaagtagtaaatatgcctaaggaaataagaactcatttggaaaataaacaagactgctttggaggacaactgttaaaaaagaacggtaataaatggaatggctaaaacctgatgaagcatggttattgaagtagacatacaaggtgttcaacacacatatcaaatattccccaaagataaggaaggatgttggaaacatgacataaaacatgaagccctaaaaaggagtcaaatggaaaatcaaagaatgcaaagtttaattattttaagtttcagtaaatgcattgaatgccaagtggattcagctgaaaagccaattggcgagccagaagatctcagaaattctcagaggacatcagcaatagtcagagagagggaaaacttaaaagataaatgaagcaatatgaagaatagcaatatgaagatcaacattcatataaaaagaatcccagaaggaaggaaaacaatcaatagaaaaatggaaggaaacatatgagagaaagattgagaaccgcccagaaaaaggaaaaggtataaaacttccgaccaatgggcttagtagagtgcaaaacaggatagaaaaaaaggtgatgggcatacctcaataggttgtaataacatttatgtaaaacaatgatagagagaacattctaagagcaggtcaattattaaaggatgagaactagatcgacctcagacttctcaatagaacacataatacaagaggctatcaagtaatattttcaaaatgtggaaccaagaatattaaataaaaccattatttaaatgggactatgagacctggaaatacttaaaagatttatcatgcacaagcttcttgggaatattcttagaggaagtatttcaagaagatgaaaagtctaggaggacagtatgagtggtgtcacagagtatgcaaataaagcttagcaaattttttactgttgatgacatacagaacttacaaatagaacaaacaacaaaaatatattttaataaaaatctggaactaaaatatagcctcaaaatatatatatcaatttattgcttcagcggtgggatggggtagaatgagagtgaggtgaaaatacattaaagcacttttcttcttgtttgcgaggaagatgtagaaattgaaaagctcagcaaatttatatggaaaaacataaatatgatcttacagatacaaaggaaactaccagaagacaaaaatataatgtataatttttagaccaatagaagaagatttgatccacccaatggaaagtaggaaaagagaaaaaaaataaaatgtttaaaaagtaagggaggattcctggtctgggaaaaaaggcatggaccatttctctctgcttcttcccactaaatgcaattctaaatcctgaaaataatgcaagagctaatcaaatgagaactctgaaagaccgtgagaggacagaaatctgccttgggactgcaggactagagagaaaacatagcttcagggcttcctacatacctacttcatgaaaaaagatgacctagacctggatttcctgacctccaaccaagcaaccaaaggcagctcagctaggtttattcctgccctggatttggagccctgctaacaataagcagccaggggagagctctccttccctcctggcctccaactcccttcccctcccagagacacctggttagccaggagcccctggcaagagggaccctgccacaacagatgcccagcctgggaagtgttctcctctcccctccctgccccaccaggggcaaggggaattctgccacagtaggtacccagccagggaagtcttcttgtcctccagagtctgagactttacacccgcaccaagagacattcagttacctgacctggggggaggccccttctgccttctgccccttcagctagcaccatcagggaccagtggaagttctcctagagccagatgaatcaagcagaaaaacaacaacaacaacaacaacaacaacaacaacaacaaaacaaccaactccaaaacaaaactcgaaggcaaacaaatgaaaggaaccacactgcaatggcttcaaaaataaaaattccattggaaccacatatagaaaagtaggacgggacctgcatgataaagctaaacagaattccctcataaaataaaaaaattaaatggaactcaacgttttttaacataatgacccacatgcccaagatataattaggaaccattcatcataacaaaaaccaaggatatcacagcttggatgaggaaagagaatcaaccgataccagcggggagatgaatcagatgttggaattatgtgacaagaattgtgtatggtcatcatgaaaatgcttcattaaactattacaacaaatgaaaaaattagaaaaggtcagcaaagatatagaaatttttttaaaaaccaaatgtaaattatagaactaaaaatacaaaaacagaaataaaaatctcactgcataggctcaattgtagagtgaaggtgatggagaatagattcagtgaaattgagaacagattaatagaatttacccaatctgaacaagaaacaatggactgaaaaaaatgaacagagcctctgggctctgtgggacatagcaaaagatccaccatttatatcactggattctaaaaggagaaaaggagagtgaggctaaagaatatttgaagaaacaatggctaaaagctccccaaatttggtgaaagccataatcctacagattcaagaagctacacaaatccccaggagaataaataaaaataaatccacactaagacacataagaattgaatttctgaaaactaaagacaaggaaaaatccttgagaacacccagagagatttactacctatagggaaacaaaatttcaataacagtgaatttatcatctgaaactatggaagccagaaagaagtggcacaattatcaaatgataatagaaaagaactgtcaacctacaatcctacatccagcaaaattatcctttaagaatgaaaaggaaataaatatattcccagatgaagaaaactaccgtgtatttgttgttagcagattaaagattagctagatgaaattctctgggaggtacagaaaggaatatagaataaaaagagtagaaacacagtagaatatcctttacctcatgtgttttatgtattgtattatggtgattgagacaaaaattttaatgtcatctgatacttaagacaatagtattttattttattttatttttgagacagagtctcactctgtcacccaggctggagtgcagtggcgtgatcttggttcaccgcaacctccaattcccaggttcaagtgattcccctgtctcagcctcctgagtagctggaactacaagcatgtgccactgtgtccagctaatttttgcatttttagtagagatggggtttcaccatattggtcaggctggtctccaactcctgacctcaggtgatccacctgcctcaccctcccaaagtgctgggattacacacgtgagccaccacaccaggcaataatattttaaagtgcagaaggtagagattgaaatggaagggaggtttatttgcatacttaaagtagtaaaatattggtgccagttgatggtgatgccaccagcatattgtaatacacagagcaattattatgcaaaatatacaaagagatataatccaacatattataaataaattgagatgaaaccctaaaaataggtccataaaaatatgctcaaatgatttttggcgaaggtataaaagtaattcagtgaaggaacaatagaatttttaacaaatggagctggagctattgaacattcatagggaaaaagatgaactcaaactaagtctcatacttcatgcaaaaattaacttaaaatggatcaaggacctaattgtaaaatataaaactataaaacttttaggaaaaaaaaaggagtcagtctttgagacctaaggcaaggcaaagatttccaagactcgacactagaagcacaatcaagtaaaaggaaacattgataaactgaacctctttgaagtaaaaccttttgctctgtaaagattcacgtgaagaagatgaaaagacaaactagtgactgggagacatgtttgtaaccatatatatctgacaaagtattagtatgtacaatgtacaaagtctcaaaacccaacactaaaaaatattgagtagaaaagaagcaaaagacataaaatacacctcactgaagaggctatatggatggcaaagaagcacgtgaaaagatagtcaacatcattagaaatgagggtaatggaaattgaagctgcaatgagataacattacacacctctcagaatggcaaaaacaaaaaaaaattataacaccaaatattggtgaggatgcagagaaacaagatcactcatgcatttttgataagaatgcaaatggttggccactctgaaaaacagtttggcagtttcttataaaactaaacatgtaactatgatacaacccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactctttcttacaattgtatgtgaatttaataaaaagaaaaagaaaaatagaaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttatgttggagtcattttaaaaatatgcaaataaactgaaaacatagaatggtaaaaagataagctgggtaaatttgaattaaaagagtgttggaataacaattttagtatcagacaatttaggctttaaggctaaaatatcatcaacaatgaaaattgtcacatacagaaaagaagcagttagaaaatttaatgattggaacccctaggtatctaacatcataatctgagactcataaaacaaccaataaaactatgggaggaaatagaagaatcaagaattatagttggaaatttaaaacactcatttcagaaactcatagatgaagcaaacaacaagaaaaacaaatatataaagattttaataacataatatgccttcactttccattcagtgaacacaatgctcattctttttggacatatatggaaaatttacaaaaatcaatgaagtactaggtgataggagaaccctcagataattttatagagttaattctcaaccagtatgcaataaaattagatattaatctaacaaaaagggaggtgaaaaaaatttattctatttagaaacgaaaaaacatatcactatacagcccttgaattaacaagggaaccattaggaaagataatgaaaaggctgtctgtcaaatctgctggacaacaatgctgtaaattctaaaaatatatataatgcaattacagaaaaatatttcaaattgatagattttgtgataggcccacaagtgtttgttaaattattttccatatttttctgtatatttaaaatatttaataattaaaaatttaaataaacatatattggacatggttaaaatattactcagacaaaaattaagggctttaaatatgcttattataacattaaaatttcaaaagaggaaaatatgaaaaagaaaacaaatgagttaagtgtttacagaagctaataaaaagtaagataataaatccaaagaaatggggaaaatggaaatataagataagaacaaatcaatgaaatagtgaacaaagatcaatatgaagattaacaaaggaaaaattagttctttgaaaggagtaataagatagcaaacctttgataagactgaataagataaatcagaaaaagaataagtaaaacacatactgaaaaggagatctacgaacaagtaattttttaaatactttttaaaaatatgaacaaacatgtaacaatacatttgaaattcattaaaaaaggattaatttatataaaggatataaaatattaaaatggcagaagaataaatggaaaacttgaatagaatgtaaaagttaaagatactgaagtggtaataaaatgtctccttcaacaaaacccttgggaaaatgatagggaacccgagaaagaagcaaataggcaatgaatatgaaaagataattcacagaatagtggagaaatacaacttcaaacgagatcccaccttttacctattagattggctaaaattaggaaaatgaaaaataccaaagtgcccccaactgaggactgttgtttctagtatggaccagaccccattcctgcactcctgctccagtgcatcgctcagaaaatctattccctccctccctcgctccatctctccctccctccctccctgcctccctccctccctcccttccttccttccttccttctttccttccttccttcttcccttccttccatccttcttcctttccttccttccttccttccttcttcccttccttccatccttcttctcttctttccttccttccttccctctctccctccctcactccctccctccatccttccttccttccttccctctctccctccctccctccctcctcccttcctcctttcctccttttcttattatattttctttctctttttgttattttatattggcatagacataaaatacatacatcatgaatgtactgcttgatgatttttcactcatggaatcctcaccatcaagaaataaaatacttcttgtacacaagaagtcccattatgcctctcacattatgagccaccatgcctagcctattttacttttatttttgaagaaaattcaaataattgcatagttctagattgccagttaatttctttcagcattttaaagatgttttattgtctcctagctttcaccacttctgtcatccatatttttgttcctttgaagttaatgtgcctttcttttctctcactgcttttaagagttttgttctgtctttgattttagaagtttcattatgatgggcctaggtatgtgttttctttgatcttttcctattttgagttgtagtgtttcctaaatgtgtggtttgatgttctttgtcaatacatgatattcttagctgataatctcttctaatattacttctgcctaattccttctttatccttcccatctcatcatttatggacatgggctttgagagaatgttaattaatatgtccaagaaaatagggaacatgatggagaattttgacagagaactggaatatataaaagaaaatcaaattaaaagtaactgaaacttagaacacaatagtggattgaacagcagattcgagacagtagaaggaagggttattaaatggaagataggtctgtagaaaatatctagcatgaagctgtctggatgggagaaaatatatattttcattgaaaattcctgatttttggttttccaaaaaaaagtcaaaattttgtcaacattgaatttacattcctcatagtttcagtgtgcctgagctgatgagttgttgatgtgctccatatacagggatatgtactcccaactagccacagtcactcctttctattatcttctaccactgaggctgaatattagttgtcatggtttatatcatcccttccctgctccacacatttacattgcgtgctgggcatgctatatatttgagttcatgatccgtgttgaagatgccataaagacccaaaaatgtgaaagagacttggaaccgggtaacaggcagaggttggaactgtttggagggctcagaagaagacaggaagatgtgggaaagtttgtaacttcctggagacttgttgaatggctttgaccaaaatgctgatagtgatatggataatgaagtccaggctgaggtggtatcagatggagatgaggaacttgttgggaactggagcaaaggggactcttgttatgttttagcaaagagatgggcagcattttgccccagccctagagatctcgggaactttgaacttgagagaggtgatttagggtatctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacagtagaaaagaaaattccattttctgaggagaaattcaagctggctgcagaaatttgcataagtaacaagcaaccaaatgttaatccccaagacaatggagaaaatgtctctagggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaagccccaagccttggaggcttacatgtggtgttggacctgtgagtgcacagaagtcaagaattgaggtttgggaacctctgcctagatttcagaggatgtatggaaacgcctggatttccaggcagaagtttgctgcaggggtggagcactcatggagaacctctgctagagcagtgtggaagggaaatgtggggtcagagcccccacactgagtccccactggggcactgcctagtggagctgtgagaagagggccaccaaccttcagaccccagaatggtagatccactgatagcttgcaccatgcacctggaaaagctgcagacactcaatgctagcccgtgaaagcagccaggagggggactgtaccctgcaaagccataggggtggagctgtccaagaccataggaacccatctcttgcatcagcatgacctggttctgagacatggagtcaaaggagatcatttcagatctttaagatttgactgcccagctggaatttggagttgcgtggggcctgtagcccctttgttttggccagtttctcccatttgggatggagcatttatccaatgcctgtacccctaatgtatcttggaagtaactaacttgcttttgattttacaggctcctaggtggaagagacttactttgtctcagattagattttggacttggaattttgggctaatgctggaatggattaaaactttggggtactgttggaaaagcatgattggttttgaaatttgaaagggacttgagatttgagaggggctggggtgaaatgatatggttaggctttgtgtccccacccaaatttcatcttgaattgtaatccccataatccccaaatgttaagggagagaccaggtgtaggtaattgaatcatgggggcagtttccccagtgctgttcccaggatagtgagttctcatgagatctggtggctttataaagggctctttccctctgcgttctgcacttctccttcctgccaccatgtgaagaaggtgccttgcttccctttcaccttctgccatgattgtcagtttcttgaggcctccccagccacactgaactgtgagtcaattaaacctctttcctttgtaaattaacgagtcttgggcagttctttttagcagaatgaaaacagactaatacaatagagtctagcaatagagtggagaacaacatagttacaagccctgccctcagggaaaagaaaacaataatcacataaataattagaattgtcataaatactctgaaataaaagtaaaaaatgctaagagatccatcatattttccagttggaaggcagggaatgtttctcccaaaaaggttatttaagccgagttctgaagataatatgatttagtcagatgaaggcctggttatatgtgtgttgatggagaatggacagagagagttgatctagcctggaagagttggacaggtctgaggattcaaagcaagtcagtagggctggtaacacatatatgagcagaaactgtgttgtattgggctgctgagtctggaaaaatacataggattttggatgcctttgcagaccaagcagctaaggaccagcacatttcatggtgacttgatggtgtgcaaatttggtccctctgatgaatcttctagttgaaataatttatcactgtgaaattaagtcatcaagtataagatgaccagctgacttttagccaggtagacaagctatcgacttggtatgatgaaacatcactgagttcatttttatgcctttgtttcctctctgtctcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatatattgtatgtcatatatgatgtttacttatatatttagaatctgcatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttatttaactttctttttctctcccctcttttctctctcccttccccttccactcctcactttcctcctcccaccctaacaagagtcttttccataaaaaggccctaggaagtttttcctgatttcagtgccatgacctgagtcttcagagctctttgttggcccaggttcacaggtgttgtgagtgtggaaaggaaatagcatggagaggctggaggaacttgacacatggctttcaagtctcatggttgatgttagatgttagctgtgcttcctccctgggtctttgccaggactcaccactggtgggtggggaaattgccacctccccaggccagccctgccagtctcacatcccatctgcaggaccatggccttcagagagcagacatttgtgttcttagtcactgcctctggactgcttagaaaatcgatccttgatcctatatttggattccatggtcttataagaaagcaaccactgtcactctgcatccttgctggcccagtcacaggctctacgttaatttatagacatctgaactcgtttgttaacccaggtgctacaggtggaatcctccagcaaagcctggtctccaatgctctgggtagaggtgttgaaaagttaccacctgctgcaagtggatggcttgaaagaatattctggggtgaagggaagtgccacctaagcaagggtttattcctgggtggaagaaactgcaggctctgggaatgagtctttgaaggtgtgtctggctttccaaagtgagctaccaggaggagctcggtgtggggcagtcagaagccatgccaggtatgtgatggagtccctgggtcattgattctgctggaggccaggactgattcagcagagatccctttctcctgtagcggagaaaaatgaatatctttcctttacccatctaaaggttctcagctgaggcacctatacagacagagtaacaagagaaaaatgtacaaatgtgcttaatataaaatttacatgacacagaagcctgcaaaaatgaagacccaaagcaacagaaaccagtgtatttttatgcttaagtttgaagaatagcagacagatgtggagaagtataattggacaaaaggagtatgatttaatggcaataaactggggggagcttagcaaggcctgtttgctcggattcttcgctgcatccctgtgtcttcagagataaggatactcctttcctttgggtataggttgtacactttaaagatgagggtgttataatctactttagaggaaggtcagataattatttatggcctgcttcaggaaagaatggctgcagaaggtcagagagactttcctgcttctgctgttcctcaaatgccaaggtgccatattttggggtagtgtattctgaaccccatcactctctccctccctttctccctccttctctgccctgcccactgagccctgagccctccaggttctctggggacagactttcccaggcataggaggattcgttttcctgcatagcattataagcacctgtcaatttcactatctggctataagaacacagagctatatttgttgaaaaataggaagcttggggtcaaggatgaaaaaagagtggagccttatcctaggtcctgtggtggctgctgtttgggtgctccaggggtcccccagaaagcctcccagatcctctccaccaattgaaatgctgaggatgtcctacatttatttgttgctttcttgggggtgagtgggtgctttagaggggaccttacagcttttgctggctttcagtatcatttccctgttcctgtatcgcagtgctggatttattttcacagagagggcagccgttctctgaattcatgagtgccatggattttaagacaatgttttctgagaacggcaaaattatggggccagaaaacagataaattgttgccaggaaaggggaagggactcattacaagagcaacaggaaggaatttggtgcgtggatgttgggggcggatgatagaagtattctctctcttgattgtggtggtagttacgtgactgtgtgtatgtctaaatccataattttacatcagaaagagtgaattttactgtgtatgactttataacaattattttaaaaagtttttttaaatgtctacctatttaaaaaccgggctgtagatgtttgagtcagtgcttttgtctcaggactatcaaaacgcagtgtggcctgctggaaagagcacaaggcttgagtctgagtctgccgtgatcctcagttaggcctcttacaggccgcatctccacatctgttaagaaaaacaccaccacgacataagaggataatgaaaactatctcatgaagctgtgatgaagatttaaataaaaggatgcatcacgaagtgagagacgcatacctagtagaggctaatttgtgttaacttttgtttctatcactctttctggcagtcacaagcatctctaaaatgctttttgcatgcataatgctagcaacactatttgtttgtatgactcagtctccaggcttaactttcccttttgcataaggagtttggggatgcttgagattgttacattttcctttacatgtataatatactcactttttgtcaagaagtagacatgagcaatgagttagtggaagatacccagtcagagaaaggtttaacgaaggaaaactcccgtttgtattcgggtccaggattttagactacagaaggtacggggaaatgataacaagggcctcattaggaaggtgcttttgttttcctgcctgtgttttccgggagccattgaagtctgggtactttgcatttatcctgtggctaaaatgtctattcgctttgcagctctgggttggttttgctttagaactccgtgctgggtctgaccatcctatactggtttctctactgaagcttgatgccctgaaggcagtcaatttctttttgacccaaatcttccatgaaaaattactgacttcttatagaggtccacaggaagatgagttttcaaagcctttcccgtgcttatctggccaacgtggtgatgtgcattctggtgatactttgttatcacaagggctttgtcgttgatcgacaccttcctgggtctacggtccttgccaggctgctgagcaccattcccccattttacagctgggcccattaaggtgaagcaatttgctttggactttgttacagaggaagtcagcaacagggctcagtgccaatcttagcatgaacttcctcgaattgtaagagcccttttcttttccagtttcatgacagctctcctccaagcctttctgaggactctggaaactatcagctgctgttggccctggttcgtagatgttacagaaattgaatgggggccaggcaggagccagggaaatcagtgagccaggcttcctccgctgtgaagtggctcttttgtacgggctgttctggccataatacctgcgtaatttttttctttcctgtctgcaacctagcctgcggggtgctttctgtttccactgctttttctacataatgggctccctggacagtaccactctcccagacttctcatcccagctgcttcctttctgagccagtagctctcaccaaagaggccaaaagaggacctggcaatgttgagtcattgcgtgcagtatgtgagtagccagtgtgtgaacacagctgcagtgaacggaattagcaataagacacaacgcaaccaggtagcctcatttgttcagattgaggtcttcaaaaagcattttaagtttacgggtggaaaggtgtgatacctttcctcagccatcattaagggctaacactcctataacaaaaacaagttaacaagagaaaaacataacacatttatttaatcagagttttacatggcacaggaggcttcagaaatgaagacccaaagacccagggaaaactatttttatgctcagatttaatgcagaatagtcagctatgaaggaatgtgattggacaaaatgggtatgatctaatggttatagactggggggtgagcggaccagcaagccctgtctgttcagattcttcttggacgctctgcatagtatttattcctcttgggtatggggcaggactcctctaaatggagggtcttcaagggagaaggaagagagtgacctttgtaggttttatgtttgctttgagggagaggagtcctagtttctaagactggctttgaggaagaggaattctggtttctatggcttgcatccagggagaaaaaggagtgtgagaggggagggcaagagaaggcagagagaccttgcttctgaggccttccaatctcctttggttcaaagtactcagcataccaaagtgtcacacttaggggtatcatactgtgagccacaacataagtatctccattcctttttactcaatttcacataaagaaagctggaaaaggtgatccacaatgaagatgtttgtcctccttgtcttaagctgatttctatatctagaaatgtctttattgggcaaaagtgcttcctcttcagccataatgggtgcagatctgattctttcttttctctgacacttactggccctgggacagctggaaactcactttgactctccaaggagcacatccctaaatgtgtgatctcttgatatctctcccacttttgaaaagaactgacaagggaaaaatgttcacttacccatcagctggtttttctctttttgtttaatgtctttggggagaaagcaaagagctaggacatgaagaaaacttctgtctccactgcattttgaagttttgcaaacccagccatctttcccaagagcagagcagtagaagcaaccaggatgcaaccagggttggtaattggttggttaattaaaaagtcagaaaagacagagagtcataaaagatgatgcatgcgtattttaaacctttttgtttctagctgaaaacatgccctctcatttgctattcattcgatataggaccaagtatttctgtttgtagagcctgctgattggcttttcacatgaccctcgttgtgtaaacctcacctatcatgcatcattaacaatttccacttttggtgtctttaaagtgggctggaaacgttaagagcacttgcaaaacaattctcagcctccccctctctcttaaatgttattgaatctttccaaggtttccagcttgctttttatggaaacaagcacttgttttcacattaatatttcatcgctctacatagtatttatttagattgtataattaggatatttaaatataactggcctacagaagtgaagaaacaaatgcaacttgaccaatagaaacagaactgcgcaggcttaccaggaccctgcccctggcctggccctggccactgaatttgagagagaaagcagagtccagggacaagctggcaggtggctaagagaggtgtttcttctgttcagtgagctggctcctgcttgttctctcagttaattactgtcatcagcttgtcagcctccttcacctgcccaagggaaggaaggggactcctctgatctgctggcttctccttctttcggaatatggtggaaccttgctccatgctccagggcctcacggtggccctttttccactaattaaaaatagttcagcgcttctgaggaaaacaacctcagggctcttggtgacgccgttcaccttggaaattccttgtcattcactggtgcagtctgagggatcgatagcaggatggcgtctgcctgaatggcaaggactcattttctgcgtttgtaacagaggaggtgttatccaatgaatcctcagtggtgtcctgggagtagctgagaatttttgtaatgtggaaaatcagatagcaccctgccccctcatcacagctacagtgcatttgatttccccaccactgggcagccagggcagttaaagtcaagagcttccgctccccaggagcttccggtccccccataagctggtcgtgagctattcctgcccttcctaactaggagcaggcaggagatgaacactggagttccatgaagctcctgtgtgaaattatcttacctctacccaagacttactgcactgcctttttcagtgaatcgtttaatgccttccattctgaatatgctggtgtttctgctttgccagccattggtcattccacaccccctcctccacccggcccccaggtatttcctggaaccattgattatggcagagcagatcttattttgctcatatgattaggaacctcaggccaacaagcttgggtaatagtgagagaaaagaagagtggtcctttgctcttctttgtctgagtgccttttgagggaaagagtagataccaccaaccatagcatctctatctctttccagcaaactacaggggtgcctgagactttagggtgggaagcaagctctcacttggaaggggtgacatccagaaccaggattaaacgctgacatttaaaaacagtaactgtggtagtcttaatagttgcacagtttacagtgaaacacttagagttcaaatttgttttactataaagtgaacatggatggagtttgggatttgattctgtcttcatagtttccctttacagttcaatatttcttagctcaaagaacacattcccttaaaaggaatccctcaaaccacttttcatttttattttcttatacaaaagggccttagggttggatgtccctatccccagaatctgaatccttttattaaagggactgtatctaggtactagccggtgccatgaatctcattttggattcaaatggattattttctcagagggttctaatgaagtctggttttattcagatttgactatcaaactcagtgtgcttaaagaaaagcagttcacatcctcttgcatgatcgtgtaatataaactgtagcttttcaaaggttgcccttcaagtaaactagaaaccacaggccaattaacatatgccaattagcaagcaatttcttcttctaacaatttgtttggttctgttaattacttttatttagagcttgtttctccgagccaccttcaaaacaagcatgcagatacttgaagacaattcattgcttgctctgacctaaagagatctaaatatttcagatgctttctttaccactgacgacatctggatgcttttaaaagaaatacgcagttactcagggagtaaccgtataatttgaatatgtggatgaatactcgtatcagatagagtaataaagatatacccttaatgtctcaattttgcctctctgcttattggcatttacacgactgtagaactcggcatttatatgaaaagacaaacaccataaaatctatgtcaaatacatgtgaaatatattctttgtgttgtgggcaggcatttgtttgaagtaaatattctttttgtagataatattttaaaaagaaagacaaaaccatatcgcattcctgaaatgtatttaccaagcatgtattttggaaaacagcccaaaggaacatatttaaggcagtgattttaatactaaactaaggaaatagtttgatgcatcagctaagctcatggatgggggtaatcacatctggtttacctcaagccacaggagaaggagtgagacttgacaatgtaacaaccattatgaggctcaagtagcgtttttggcttgtaagcatgtatgtgtgctgtgttcaattttatgttttaaatttttttaaaaaacttaaatactgctatagccccaaaatatgtaaaatatgtaaacagttggcttgatggccataagggaacacctgtccttttttttttttttttttactgtgtagcctgtgactttcactgcaggaattaaatatttttgtggataggcaaatgtacttttgtggataggtattgctgatgccttattacacagccgaaggaaataaggatctgggtaagcagttgagtcacggcaaagagtaccgtatccaaggtggaggttcatgctagagctacaggtactaacccctcccctgcaccactgatccctagcaagggtggaagtaactgatgacttctctgcacagcccccagcacaatgtctgaaagagagacctaaagggtaactgcctgttttctcagattaatcttagaatcctagcagtacttgttacttcagtttggagatttttcttattctatttcttcacactcttacagacttcacatagcccctccctttagaataactcttgacagcattttaagaaatagactatttaaatcatcttgatccagtgactcaacccaaggtgtaacccgtctgctcaaatttgtggcaaatctccattgatgataacatttctgcaaatgtatgctctgttaggtgtggaagcttttcctaagtagaattggcagccacagtagtacctgcctacctagcaatttaacttaaacagtttccttttccaaaggtattttctattcagaatagaaataataaatatgatttcctcatcactctagatacagcctgatgagatattgttaccagatactttctcttatcaaaacaaccattattatttcataatatattccctaccctttgaatataagctccagttctaaaattttaaatgttggtatcttccacatgtcatagggaaagacttaagccttgtttatgggaactataactgagtaaaaatgtccttggagaccctggtcatggaatttgtgactgttcttctactggggcatgtggtttagacatctgctcaggctagcaactgaatgcttttctgggtatacacttttatagaaaaatgttttttgaaagtcactttaatgggaaaatcctgcccaacaaaggaaatcctattttctgtttttaaatcatgctccctgagttgggtgagcaggacagaaatttgacatcagctctaattcaacacagctgaaaatttctgcccaaacattcaggcctacgggttttgatcatgaggtgagttaagcaaattatatttgaaatattgcctggctgagtcggtgctactgaatcatacccgtgtggagggacagcagggaagatggtagggctttattggaggccaataaaagccatgtgtgtacagcagtactgtggagagccccaggaccccatggctgtccctgtggcaagaaaattatcccagataaggctgttcttggctgcactgaggcaaaggcatgtgctcagcatccagaaaggttcttcttgttggttttccttcctggctctttatacttgggtgaaatgatctcttggaagtgtagtctgaaaaacagcatagcttcttccaagttctcataagatacaggagtctccattcattacttcaataagcattactgagcaccttttatgagcaaggtaggacgacggaggcagggccaggacctcatcatctggtgagggagacaggcggttacacacacagggaggaactcctcctacccagaagtaggcagggttggagattcgggattgaagcgttcctggaagaagtggaatctgcagagttttgaaaagagggggtgttaggtgtagcaatcagaccatttacctgttataactgcttttcattctgacccacagggaaaacaattattcctagggttaaatgatgggacggatgttcagaaaggaaaaaaataataatttgaattgctgaaaggaccgcctgacaagacaaattactggagagtcttcaaagacactttgaaatgccgagcaacctgtactttaaatgatccgttcagaattgcaaatcctacagaactccatttctgctaggaatcccagtggctttgtagtgggtggtatttttaattatcaagtatcagtcttgcaggctttctcttttttgtcacatttgatttaaagtacaaatgggagcaaaagttacaaattgcacacagagagacactcagtgtgtgaaattgtggacatggttcagaatatgtttatttggaatccgctgaggtgatgggagagatgggactggatactcatgttcttatttggaaaggagacattctcgccgcctttcccatgtgcccgcttgcttttctctgcttccagcctgatattttatggacttgtggatgagaggtcctgtgcccatcattgcattccagattgtcatggctgttatcattgtcacctccactcattatgcctctgagtcctggagggagcatatccctttaataagactgaaccctccaggaattgagactttgcagagttctgagagtagaagggaagagaacaccatgtctacaggtgctggctgtttgcttctctgatttctttccatcaccactttgcccaagttacatgactctttggccaggtgcggtggctcacacctgtaatcccagcactttggggggccaaggcaggcagatcacctgagatcgggagttcgagaccagcctgaccaacatggagaaaccctgcctctactaaaaatacaaaaattagcctggcatggtggtgcatgcctgtaatcccagctactcgggaggctgaggcaggagaatcacttgaacccaggaggcagaggtcgcagtgagccgagatcacgccattgcactccagcctgggcaacaagagtgaaactgtctcaaaaaataaataaataaataaaaaataaaaggattcttcaagcctcttttcttgtatgtaaaagaaggaattgaaccttgaggatggttcctaagacccctaccaaatccagcagcattctctgcttctaggtattaagattctcagggaaggtttccgacattcttagtagccctgaaggaggcagatctttgtaaatgcatttgctgtcctgggaaacaagatggtgttaagataaggaagctccatttctcttgcagttataacccaaggcagagcctcctgattaatacacctggcttacaactcactattttggcttaaacagaaatgtcagtgcttccaaagctttcactgagacaccttctttgaaaaaaaaagtttcttttattttaaaagaagcaaacaaactctcttcaacagctccctttatttacttatttatttatgtagctttctatgaaggcttagcaaataaaacagataaaattagaaattgaggtagagttgacagtaaaaacccttttcctcctaccaggggatctctgcagaataaggcctaaagcccactggtttgagagaacatcctccagcaaggtgctttccaagcaagggaaaaactagaagtagtgaaatacacctgatgcttcctgcagagactatgccatcctgtgtgaccgtaacatataaacatcacataccaggaggacatgatcatttaaatagacagcaatgttgtccttcagtctaggcaatgggtgtgccccaaggccagtgtgagggtccgggagacaggaatctgtatatttcttacctgcctctcatgatttgagcaccttgctctgctaagtgtcccctgaagaaagagccacttctcccaaaggtggaagaaagtgaggccctgtgggtcgtattgcactcagatatgttggactcactgtggtatgtcttcctgcggaattttctaggaaatttttactgtacttgttctatacacacacacacacacacacacacacacacacacacacacaccctcagaatatgtgcctgtactgttcaataacttacacattgaactaggagccagggatctgggattactgaccagtggcagtggtcacttgttgtaatgtctttgttgcacttcccagcctaatggccatagtgccctgcatgggtaggagttcccctccctgagagaagtctgggcattagcactttagtgagcttcaaaaatctagtcagtcaactccctaactaggtaccagtgaagatgcactacctgctagcattttgcaatagttttatccactcatgcgaggttctgtgtagggacaacccatgtaaggcccctgttttacctactatggctgcatcaaaatcaacacaaacttagtgatttaaaagaactatttatgatattcgtggatctgtagatcagaaattggggtggggcacagtgaggagggtgtctctgctccacaatgtctgggtgttagctgaatgacttgaagacaggggctgggaccatctgaaggttcagtccttcccaagtctggctgttgactagggctttagctgaggctctcatccagacatctacaaacagcccgtccatgtagctggggcttcctcacaacatggagactgggttccagggtgggtgatctgaaaagacatgtcaccttttatgacctgactttgcaagtcaggcagtgtcaccttcactatgttccatacattgaaggaatttcaagggccatccaggtttaacaggagaagtaataaactctgttttttgatggtggagaggcaatattccagaaaagtgtgttgctatgaccacacctacactctgccatacctgggcatggcatggaaatggccaaggaagttttgcctagtccctcatttatggactaagaggcaggacctgggcaactttgcacagctgatacccatggttcttttttttttttttttgagatggagtctcctctgttgccaggccggagtgcagtggtgcgatcttggcttactgcaacctccgcctcctggggtcaagcaattctcctgcctcagcctcctgagtagccgggactacaggcctgcaccaccacacccagctaatttttgtattattagcagagacagggttttaccatgttggccaggatggtctcgatctcttgaccttgtgatccacctgcctcggcctcccaaagtgctgggattacaggcgtgagccaccgcacccagccaatacccatggttctgatcccaccctgctctctctggacagacagatttctttggacagaacagaattttttaccagattgatagaaatatattaatctaccctctcatcagctgtcaattctcagtttaggtctaaactaattctattctcaagattccaagtgagagcattatagtaaaataatacatctcttaagtcatatctacccagttcacattcagtatcctctcagttcagaatcagaagctgtcagaccaacaagtagaggttcctgcacaagcctgagagagatcctgtaacttgtgccttggaaaaacagccccacgaaagaatgccagacagatcttctcttagcaaacatggtgacttgagctctctgaatttgttcccttatgctacattgtttgttttttaatctctaaaaaaactaaaaaaaatttcaggtaaattttcttcctttttcattatggtttgaattagggtttttgataactttttttccaaattttagggatgttaaaggttcaggaaagtataaagaagaaaataaaaatttcccataatactgccccacaaataataattataaatattttgatgctttgcctatttgagttatttcatcatcattaaatgctcttttattaaaaatgactttaatggctaaatacaaatctgctgtaccagaacttatttaactattccctttattgtttgacaattatttcctctttcctatacttttaatgccatcatctttgcatgaaaaatcttttatttctatttgatatatgtgataggcattcttccatgcttattacaagggcttaataaaagttatttcaatttaaatgaacaaattatttctttttgatagattccaggaaaggaaattattgggtcttaagatatgaacaatttaaagcgcttgttatgtggtctgaaattgctttccaaaatttatgccattactatcaatctgcacgtaatttaaaaaggaaaacaggcaggaattatatgtttgggggagaaatgtaaaactgtattttaaatttgtttaatttagctctgatttcatatttgttgtagccgtaagatgaagattgagtcatttgatttcgtttaagggtgttttaaattccttggttttctgttctgagtctatgctttttctctctttaagtgtgttttcagtcatatatattttcctgctaacactgtatgtttctccttcctgtatgatttgtggtttcatgactgtcaatcattttttcccagatgttctttttcttagtgtctcatttatttcatgtgtgatgacggtgttgctcattatccagtgtctacacttctgtgtaatctcctaccctcaatttcatatctttgattattttagggtcagtaaaaatatatatatatatacacacacatatatatgtatatatgtgtatgtgtgtatatatatatatatatttatctgtgatttttatgtatttgctgtcttctcaccactgttatggtcaattttgagtaaaccttcaagggtgcttcacactaaagttcctttaattgtgtccatatgtccccacaattgtatgttattgccactagatttcttttctatatacacttacttgcagtaaatgcgtatagtcattctgtagcttgtagctcattcttcagtatactagacttctccaatatttacaagttatttgcagttcccattagcactattttattctaaggtagttggccattggcatgtaaattttaaagctaatatagcaaaaatcaaattatatacttggatttaattgttatttgtggaatctgattataatattatataatgcataatctccagactttttaacagtgactattaccgcacctgggcattttgttgttattgttgggtattcattgtatcttttgtagtaaacttgtagtttaagatgaatacgtatcttaatagtttcccttatgcaatttttttttttttgagacagcgtcttgctctgttgtccaggctggagtgcagtggcatgatctcagatcactgcaatctccgcctcccgggttcaagcgattcttctgcctcagcctcctgagtggctgggattacaggcgcccaccaccacgcccagctaatttttgtatttttttagagagggggtttaaccatgttggccaggctggtcttgaactcctgacctcatgatccacccgcctcagcctcccaaagtgctgggattacagctgcgagccactgcgtctggtctgcaaaaattttttagtgtatcttctaagcttttcactcttagttaaggaaatattatctttacatttaagttttaattctgagctcatttcttgcttctccccctgctttattctaagaatctctatcttctgttctcattttcttaaccttgtttattgttttcctttacaagtctgtggccttctacatgcccagcattcaactttgggccctgggatgaatgactaacccatggcccttacctcacttgagtggacacagaacttatcagaatggttgcactacaaggtgaaattattatttggggcctttgaaggaaaggctgggtttcagagaagagtggggaagaatgcatgggcaaaaagaacagcatgagagagggcaacggggttagtcctattggcaaagcttagcttgcctttaggagagttgaggggatacagctgaaccatgggctttgtgcgaggtcctatgaagacagagtttagactctgctctgtggtggtttcgtgcaggaaagtgacataaagaaggcccttttctggctcatagaaataagtttgaagggaaaaagtgagagaaggaaggagctctaagacttaattgttcattcatcaaatcgatcaatactacgtgcctgtcatgtgccagatactatgccaggggctctagggatagcagcaaaaagacatcatcatcctgctctttttttttttttttttgagacggagtctcgctctgtcgcccaggctggagtgcagtggtgcaatctcggctcactgcaagctccgcctcctgggttcacgccattctcctgcctcagcctcccaagtagctgggactacaggcgcccgccactacgcccggctaattttttgtattcttagtaaagacagggtttcaccgtgttagccaggatggtcttgatctcctgacctcgtgatccgcccgcttcggcctcccaaagtgctgcatcatcctgctcttatgcggcttaagctcccatgtatggtggtggtagcggcggctctatatgcagtatacacctcatggcacttaaattctagcattcagggactgtggtcagtgtgtaaacaaatgttcagtgccctagtcaattcctgtgtccttaaaggaatattccctttgtccttacaggttagcccagttgctcctgtgacccctctccccactttttttagaatccctattaaattttgaatttgcccattgatacagctggaagattcagggattctgtttgataaatccacttcgggacttgacatactggaagcagcactttgaaatgaccagacaagggaggtggcctgtggaactgcatagacaaagctcattctttggtcataacttgaaatcagttcacaacttctcaagtttgatacccaggggagacacaggccctagcacaattctgactgaggtgcagaaactgggagagctctttccaggaagcttccctttgtgttctgtctgtgtccacggcactaacaagtgatcttgttttccccctctcgccaggaatcttacatcctttctgcagaacttggagaaaagtgtgaagacataggcaagaagctattgtacttggaagatcaacttcacacagcaatccacagtcatgatgaagatctcattcatatccttttcatcttgcagatgaagcaaggcaaagttattttataaaagagagtctttaaagggtagtttttcatgcctcagaagatggcaacaaatagatgctgccgttatttatagcacagagcacctcagatctctgagattatcaggtatgaaatgttttcgctctagttttcagtaagcaattcagtattttttttcttttttcctttttttttttttttttttttgatgccttggctggagtgcaatggtgtgatctcagctcactgcagcctccacctcctgggttcaaacggttctcctgcctcagcctcctgagtagctgggattacaggtgcccgccagcacgcccagctaatttttttgtatttttagtagagagagggttttgccatgtttgccaggctggtctagaactcctgacctcaagtgatccgcccgccttggcctcccaaagtgctgggattacaggcttgggccaccgcatccggccgcaattcagtatttttaattgctaaatccaaccactaacaattaagttcagacatgcacacgaggaagccaaagaaaatgcagtttcaagtgagtgtaaatccagctctgtgtggccctggtgaaggaaaacagttgactggctcgttttcctacgagctttttcaataccaagcgtcctaaatccacctctgaatttctttatctagcaactctacctagtaatgggcagtacagtaacaaagcaaacaggactttagattatttcctttcaacttctaaccatatacacatggttgaactcaatttagtcctttctgcttcccggtgatagaatttcttgcaccagacttaatatccttggtgtcacacctacaaacaccttcatcaaaactagctgctagtgagcaagatggcctgagaacatactggcttaggtatgcatccgtatgaagcactccattctgtgttgatctgtggacgcagtttgtcactggttagttctgctgagagcaaatgggtgggtacccagtggatgaagggatatgcagccctatatcctttcagttatttaatcacaagttgacacttctctagctaaaaacacttccctattcattcatctttctattcagtagaatgtcttttattagatgcgtttgtggcaaatttagctattttggtctttgcttgtcattgctgtcttactttttagaattccagtttttaccatactttatgggctgtgtgtgtgtgtgtgtgtgtgtgtgtgtgtgtgtgtataagtagctttgaatggccaaggattaatcttagtcataaatactcagatctgtgatttaatgatagagccaatgctacacttccttccttgttataactttacatttttgaccttgtttattaagctgggcagaaaatttcttcaacttaatctgcaatgattttcacattgctttaggtagattttgaaaagcagatattctgttcttcataatttcctgcctcttaaaaatcttgtatttaagctattatcagaaagtttcccaaagaagcatacaaacatagaataaggatggcgtttttatttattccatgttcatgggatcacaaatctttgagcacgtgtaagggggtatggcttccagcaaatgggcaggtgatggggcacagaggaggagtccgctgcagagagtcaatggatatgaaggggttcccgttccccagctcagcagatgggcagttcctaagtgggttgtacctctgtcttcaggtagcagttctgagggctgcagtcagggttctgtgctggtctcttattgtgaaattttctaaaaggttagtttgattctggggaattggatcttatttttactagagctggggaggcagctctagtaaagacccctgaaaaacaaggggttaagcagtatttaaacaagatccttttagtttttccacagctgatccaagccagatttaatagcagcgggatcatggacaagtgataatgcctctttaagcattagggttcccatctgtaatgtcaggataacatacacctctaaggtttttatgggggttaaataaggctatattcataatgtacatttaatatagccatgggtaagtgcatgattttaggtagaaaagtgttatccaagtccatttgtctcacagttcttagtatattagtcacaagctccaagaacatcccatttatacacaaaaagtttcaaggtagattgattcaactattttgtaataaatgcttgaaggaatcaatcagtaactccacagtggcttagatgaaaagtcatttaattataataaaacttctataaatggatagggattattatccctacttgacagtcgaaaaaaacaaggcttgggaacaacttggctgacacaaggtcatttctgatgagtagcagaacttttcagccacaagccccatggtcctattaggcccatcagaaagcagccattgcctataagtaaatggacaggtctgttccatggaacacacaattactttaaatttttaagctataataaaagtatttcactgatgttatgttttttgagaatttcactgatctctgttgtgataagcggagaagcactggtttaggtactgaagtcagctctctccctccctccaataaaatctacaccacgatatggatttcaacccagacttttcttcgaatcccagtcttctgtcactgattgagaataaatacacagaaggtgtctttgaattcatacaaagcagcacttaaatttgagtggaacattatgccctaagatagaaagacatgtttacaaggctctacggaggctcccctacacaaaccaaagccgttgtttcaaattagagcttatctagagattcagagaggctgccagaatcctccagccaaactctgactggtttgtatttccatgtttgatcaaagatacaatgctgagtgtggctgaaagaaacagcttgttgtcaacaatacagaaggattgcacagtgagtgcagtgttttgtttgattccattaagcatgctgccagagcctactgtgcatgtgaggtacccaattaatctaagtccacattggaatgtgattaatgtaagcccacattggacgtccacgtctgaaagattcaagccacagatgctaccatggatgtttattctttgtgtggaaaacactcagtttttgcataaaccatgtgtgtacataagggctattagtgtggcatcaacagaggttaggggtgggcagtgggactgagtttccaaataggtccttgtggcctcctgatttaatatccgagttatgggcagcctcatgggtgtctcctacttttattaagaagacactgattgaccaatccaaggagggagaggaaagagcctttgcctcttcatcgtcctgacaggctcaccaaattacatgtagcatgaccaaagaacaacacaaacccatcagctactgtggcagcgagtgtctgaaaacagtctgcaccattaattgggagagctggtggtggagaggtggctcacgcctagtgcctgagaaggggacaggaggtgtgacttcacggccagtcaagtcgggacttccaggagcattagtgtgagtctctagtgcattttcacagtcatctggggtcctaattagcagtatgttttgaaaaacattttgactgtgtgcaaggtctcctccacgctcaaaatattgtaaccaaaagccttccaaattaaggtggatttttaagcaggaattttctcattttcttcctccttcaatttctacaacacactttcaaaggaaaagaagtacacctgtgatatgtacatttttggcatatttcaaagccctcagggcagttctgcctggccctcagtcatagacgaggtagagacactctgattctatttgtggttgtatttacatccatgtctgggaagcccttatggaattctgtttctctgcttatttggagtgcatggtgcccaattgtttagttttggtggtgcttgagggcatgctctaaatacatccaggtttgtgcacaaataccacagctccgtaggacccttgtttagttcaactttccaaattttagcgtgaacagacaaaggtaacgagagttttgggagactgtcctgcctccttggagatgttttccacttctagagctgaggggctggaagagggatcatgaggatcatggagctccactcatgtagtttatagataagaaaatccagagcctggccaggtgcggtggcttacatcttaatcccggcactttgggaggctgaggtggatggattgtttgagaccaggagtttgagaccagcctaggcaacatggcaaaaccctgtctctattaaaaatacaaaaattaactgggcgtgatggtgcacacctgtagtcccagctactccagaggcgtgagaattgcttgaacccaggaggtggaggtcgcagtgagctgagactgcacactactacactccagcctgggcaacaaagtaagacactgccaaagaaggagggagggaaggaaggaaggaaggagggagagaggagagagagagagagaacaggaaggaaggaagggagaaaggagagacagagagagaggaaggaaggaagggagaaagagagagagaaagagaggaaggaaggaaggagaaagaaagataaagaaagaaaaagaaagaaaagaggaaggaaggaaggagagagggaaggagagaaaaggaaaggaaaaggaaaagaggaaagaaaaggaaagggaagggagagggaaaggagaagggaaaggaagagaagggaagaagggaagggagaagagacaagggaaaggagaagggaaaagggaaaggagaagggaagggagaagggaagggagcaaaagggaaggaaagaaagaaaggaaaggaaaggaaagaaagaaaaggaaaggaaagaaagaaaacccagagcctaagatgacagtatctaaagctttgtgtgtgatgggctggtgcagatatagtagtcacagttctttccttaggctctcacttggctttggagtgggacggggaagagttggagccccacagtgggtgggggagggcaagggcgtagacacagggctgtcctgctgctggctgagcacgaggtgggcttggcacaaggtaggcaacacagagtttctgtgtacaagcatcaaatcctttgaatcaatcttgggtatagtcaaggttttcctctttgctcttgaaagactgtgatcctcatggcttttccatgaggatctccagtaccaaattctccagcactatgggctgtagtggctacccaggaaggaatggtggtaagaagaaataatgtagcaaaagagtagcactttcaaaggataagagagtcccttatctgaaatgcttgggactagaagtgttttgaagttctgctttttttcagattgtggaatatttgcattatacttaccagtggagcataccaaatccaaaaacccaaaatctgaaatgttccaatgagcatttcctttgaacatcacgtcagtgctcagaaggttttggattctggagcatttcagattttggatttggggatttgggatgctcaacttgttctattgtttctttttgaatcaaactaggtcagatgaaccgaagacctaaatttgactaagccattgaaatgcttacttggacacttcattaacagtaaaacactcaattgttttcttataaaaacagaagactccatctaaagaattccaggatcttttgcaaatggtaccccaaatgacaatattgccttatcatctattcctgaatgcacctgtcctgctgtcttactcctttgctaattgcaaacacagacattttaacaagttacatgcttacctaccatgtggatagtctattccaaggaggtacagaatggccttgggttccaaaggtgttttaaagatgttaggatgttcatccctgcgacgttgttataatgaatctgctaattttcttagataccacaggtacttggtggcatatctgttatggggggcagatacttagctactcaggtccctaaggcacaggcttcataagaattattctgcttttttgaggcctattcttgcaattaggtgcagttagcacctctattctagttttggaatttgcctaaattgtcaatagttttggaatttgcctaaaatttctatttgcctaaaattccaattgtttttcagctctttgacaacaattaaggtcaaggtcaagtgtttcaatgggcttcaactatgagcttattggattagtgatcagaaaatctgattatagctactacttagccttaagatcttgcttagatgtatcaaatgagatagtttatttttctgtaagtcagtgagaaaatgttgtaaaacacttttttttaatttatggttcaatatgaatgccagacttatatctgttttctactcagcatcttctcttggctaataagcttgtccaacttaccctgtctaaaatccaattccctccctcctctaccaaaaacaccaaacgctcattcctagtcctcttcttctcaataaaatacagatgtgtttttctaattatttgctcagataaaaaatcagggagtccttcttaatgccttttccattttccatatcccacatccagtctgtcaccatatatatgctcttggttgtatctgcaaaacacatccagaatctagccacctctcctacctccactgccactgccctgttcaagccatgattgtttcttgcctgaactattgcagtggtctcctaactggtcactctgtgcttccgcccttatcctctttaatccattctcagcacagcagccaaactgacgatgtcacccctctgctccaggtcctcccacggctcctcccatctcactgtgaacacagcacagctggacataactaccaacatggcgcctgtttactttctgctgcactcataggtatttatgccatctatgatggcagtgactttgattcactcctgtgctgctgtgtccataacatttgttaacacacagtagaaactcaggaaacatttgaatgtttgaatgagtgaaagaaagaggatctctctctgcactttcatttctcccaactgcttaacagggaaatgtttccagtggtttattttataaacatattgatttaaatatgaaagcaatgcatttccattgtgaatatcacagaagtatggaaaataaagctgtttccctcccagtgcctctacctagaggtcactactttgtcctcctgaagcctttttctagagctataaatggcttatctcaatagtcttgtttgcaaaattaggatcattccatataaattattctacaatatgctttcccccaccccattctgcatttttttttctggggacttttccatttcagtacatccaaaatgctttgtaactcacattttgtaagggatcctacaggcaggttggttagagagaagtactttgcaaataaaatgtgattttaattattattttgatgattattacccctacaggctcattaaatgaggtttctaggatttctggtgtctaaccctgctttgacagagcctaaggtatttgttacatctgttatattaagaaataaaccttaaatctcatgatgactcacaaaagacactatactctcacaaggaaaaaatatttctttgaaccctaaccctatgaggaaggtacaagattcagtattttacaagtagaataattaagcattgattgatttgctgagcttaccatagctagggagttatctcctcaaatgctggttttctgacaccttctgtgttagcgattgttgtatgagcggctgatgtgttaatttagttatagactaacttcatcctttgcttttgtaacttctcactccttatttttaaccttttcagtgggttctgccagttccagaagatttatcagtttttaaagaaacatcacattttggttcaagttctctctctaaaaacctttgtcatcatttagcacattacaaatagtggcatgtagtcccaggctgcatgtcaaaggtaattaaatctcaggagttggtcaggattcataaactgcttaagctccatgcctgctcttcacagatgtggcatgactttgtgattaaattccagtttggtattcagtctgggaccacttatgcttttgcttgtataaagtggtatatgttttcaataaagattagcggaactatgtaagaaatggaagcaaccaaagcctcttaaaaaaaaaaaagaaagaaaggtaaatattggattctttcctcccctgatcaccctcctacccaactcccattttcctcaagttcaaatgcaaggagagaaccctagcagtaaatgcatgtaaattacgcaaatgatagagtctggggaagcttcaagagggtgaaaaactgccagaacttttcagggtggttcagcacgtttgcttagaagagattcatttccatcattcccaggatcctctggagttccttgttcaaaaaagaaaggaggctgggcatggtggctcatgcctgtaatcccagcactttgggaggccaaggcaggcagactgcctgaggtcaggggttcaagaccaatgtggccaacatggtgaaaccccatttctactaaaaatacaaaaattagcatggtggcacacacctataatcccagctatttgggaggctgaggcaggagaatcacttgaatcccggagacggaggttgcagtgagccgagatcgcaccactgcactccagcctgggctacaagtgcaaaactctgtctcaaaaaaagaaaaaagaaagggaaagctttccacagtggttcgtaagggtgtctttttctctttttgttgcattgacattgcactttgggaaaaccacattgtagtgtaggtggtctgtaaacagtcagactccctttcccaaagctccccattccctccatgtctgatctagtactgttgtagtggtctggcttcatgtgatgacttcagcatatttaggtggtgtcaacatatttctactttctcccttggtccctgttggatgaaagtggatcaatttgcttgttaaacccaacgctcaccctgcatttgccttagagttgttctgactacaagtaaaaagggaaaggatgaactggatgacgtatggacagaaaaaccactgttggttaaacattcccctgcttgaacacccagacgagaacccgtttcttaagagaactacagccttatctattactgtttgctaagttctctatgattgttttctccatgtgagaaataactttataggttagaaaactaagagcccaacagcttaagaaaagaaaagaaccaaccaaccaacccagaaaaagcaagctctctttgccctttgatggactctatcaagtcttgagtgcccttcctagttcctgggaatatactaacagataacagcaggttagagcctggagaggtttcaaagtcatcatttcaagagaaaactgaggctttaactggtttgcatagggtgacaaggctggttaatggtgaacagagaccatgttaataactgagtctgctccagtatgcctctccctacttatggcaaccccaaatcctgtatttctcaaggagattttgatttcaagcattctaccctttccactgtcaagagtatttgcatctgacagttgccccaccccaacttggggcttagccggagttatggtcacgccaactgcatatcattgagcatctgagttgaccatctgtctctgctaagagctgactcttccatttcctttttaagacctgacttgagagagtcaatacctcaggcattgtagaaattgcggtcattctaaaatataaaagtgtaaagtttatattaatatttaattcatacaattggaaagaactttaaactgcaattaggtgtcagtacccatctgcttccagcaggctcacacgctcttcgatccctcggaggccgcagagggccacgatcaccttcgaatgtgctccttaacaatgtgcccacagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaattgcacgtgtttactttcagatatcagcaaatcagaaaatcatgaaatattctattcccagactcctagattaaggaaattgaaactaacattaccactagagttgggaacaagacaaagatacccacaataccactgaaaatattttactggagatgctggctaatttagttaggcaagaaaaatatagaagggttacaatttggaaaagaaaaaataaagctttaatattcacagatgatgttattgtaagctgaaaacccaaaagaatcaacagaaaaacgtttacacaattaacacaatcaaaatcaacaggcttcatatatgcagacaataattggaagactgagtataagaaaagaccccattttcaatagcaacaaaaagcaagagaaaatggctaagaatatatttatataagaaatgcataagccttagatgaaggaaattttaagatgaaggacatgagacaagaattgaatacatggaaagacacattaagcttttggataggaaggcatcataaatttaaaaatttccatcagtcaatttataaatatttcctgatcccaaatgggacaatagatgtctagttagcccccatatgcattctcccattcatccttttagccgttctgggtctagacacttaaactgcagaggtacatgtgtgcagaattgcaggtgtacatttgtagcattgtttgtaaggacaaaaatgagaacaaccgacattttcatttgcatcagttggagactggttaaataaattattgtacattcacactatggaatgctttacagttgctaaaaaaaaatctttgtgtacatatgtgcttgtctctgcagagctatcactggaaagggatccaggcgacttagtggaaaaaaaatgggaaggagacttacttttctgctctatactattcttttaaacatttggtaccgtgtgcatatatttacctattcaaaaataaaatcatttctttaagaaaaaagtcataattaatgagcctgagagtaggccctcaagtagggcagggcacacaggctgttgaatggttgcccaggtctccttgcggcttatgcaggattcatctgctatttatttacctactgtgtgcccagcactgtgctagggtatgcacctgatattggtgataaaaaggcaagtatgaactatgacataatgtgatcagatgattttaagttgagaaggaaattgatatggttaagctttgtgtccccacccaaatcttatcttgaattacaatcctcataacccccataatctccgtgtgtcaagggaaagaccaggtggaggtaattgattcatgggggcagtttccccagtgctgttctcatgatagtgagtgagttctgataacatttgatggttttataaggggctcttcccccttcactcagcacttctccttcctgccgccttttgaagaaggtgccttgcttcccctttgccttccgccattattgtaagtttcctgaggcctccccagccatgctgaactgtgattcatttaaaactctttcctttataaattacccagtctcaggcagttctttatggcagtatgaaaacggactaatacagaaatgaatgattatcattgaaacttttatcactttaaagacaagagattgattttgttctggccattttcttgaacaactacatctgggggtgtagtactgaaaattcagcactctctggaacccacgttctctcccttctgggttagggaataacatcaagtctccttcctttgagccctggatcaaagagacctgataggtgattgattgtgtgggcagaatggagacttgggaaatggagtc

SEQ ID NO: 14061 - DNA, 75216 bp, Human
  misc_feature (1)...(75216): n = A,T,C or G
actatatatatgtatatagtcagctggttgtcaacaaggtgctgtcatggtccgtttgggttgctgtaatgaaataccagagactaggtggctaacagacaatagaaatttgtttctcacagttctggatgctgggaagtccaagatcaaggcactggcagattcagtgtctggtgagagcctgcttccttgtttacagatgccttatcttttctctgtgtcctcacatggctgaaggagcaagcaaactctttggggggtctctttttaagggctttaatcctattcatatggactctaccactaagggctaatcatctctcaaaggcttcaccttcaaacactatcacattgggagttaggatttaacatatgaattttgggtgagacacacattcagtctatagcaggtgccaagaccattctgtggagaaagaggagtcttttcaacaagtattgttgggacagctggatagacacatgcaaaaaaatgaggttggactctcataccatgctacaaagaaaaattaactcaaaatggatcacagacttaaatgtatcagttaaaactcttggaaagaaacacaaggttaaggattcttggatatgacaccaaaagcatgaacaacaacaacagcaaaaaacagattaatttggacttcatcaaaattaaaacttctgtgttttaaaggacaccaagaaagtgaaaagacagtctatagattatatttgaaaagcatatctgataagggacctttatctagaatgtaaaaagaactcttacaactcaataataaaaggacaacctaatttaaaaatgggctaaggcacttgaatagacttcattttaatgggagatacacagttaccaaatacgtatgtgaaaagttgctctatctcattagtcatcaggggattgcaaaccaaaaccacaatgagttgccactcacacccactaggatggtttcaatgaaagttttaatagcaaagtgctggcaaggatgtggagatactgcaagcctcatatgctgctgaggggaatataaaatggcacagccactttggaaaaacagttgagcagtttcttaagcaattaaacatagttaccatatgacctagcaattttagatatataacccagagaaattaaaacatatctgtgtaaaacttgaccacaaatgttgtagaagtgttattcataatagctgaaaggtggaaacattccaaatgtccattagctggcgaatggataaatagaattgggtatatatatagaatggaatattattcagccataaaaagaaatgaagtactgatatatgctacaacatggatgaaccttgaaaacatgctaagtgaaagaagccagtcacaaaatactgcatattatatgattctgttctgttcatgtgaaatgtccagaatagggatgatagcttaaacaatacaggatttctttttgaggtgattaaaatgtcccaaaattcactatgatgaaggttgtacaagctgtaaatacactaaaaactgttgaatagcacattttaataaaactgttaaagtaacctggccaggtgaagtggctcacgcctgaaatcccagccctttgggaggccaaggttgggggatcacttgaagctaggagttcaagaccagcctgggcaacatgatcagaccctgtctctacaaaaaataaaaaaattctctgggcatggtggcatgcacctgtggtcccagctactcaggaaactgaagtgggaggattgcttgaacccaggaatttgaggctacagtgagctatgattgcaccactgtactccagtccgggtggacagagcaagaccttgtctcaaaaaagacaggagtgggggaggggaagtagccatttctgatgtccctttgggatatgtctgggcatgtatatgtttaaaagactgagctcttagaataacagagctcttcacagtaaactcatttgttctctccccacttgtattgtagaaatcatgaccaccccaggaaaagagaactttcgcctgaaaagttacaagaacaaatctctgaatcccgatgagatgcgcaggaggagggaggaagaaggactgcagttacgaaagcagaaaagagaagagcaggtaaatcctttacctttattcatttcttttaaagaatttaatgttccattttaagcctgaaactatcttcattttagcaaagttggggtgtgtgtgtgtgtgtgtgtgtgtgtgtgtgttttccccttctcccctgtaaaatcaacacttttttggagtggggatgaggaggtactgaaaagtggtatacaagaatggggaaatctctcaggttctcattttctcagcataactacactattcaatattttcacctatttgtgtttagtgtattttagttttctaagggtgcaactttcttctttaagatttttttgatgtatgtttgttaattaattcacaagtgaccactaaagtgttgctgttcattgtaaacttaaaattggaaatgtaaaaatatacacaaaaagaaagaataaacctcatacataaaccagtcctttggattcagtaattgtcaacagtttgctacacttgcttcgtgtttgtctttacatttctttgttatctaacattttaaagtaaaatttcattcacagaatatgtctttttattccagattaattctgtattattcataaagacatttagaacattgattttttttttttaagccttcctttgaaaatgctgttgacaaatggtctgttacattcggcaaagaaatgaaaagacataaggcttaagtgactttttttttttttttttttttgctaaggagagactttggagcctgaaggaccatttgaccctcactatagaaattccataaaggcagatgaattagaaccctcatgcttgagaaataagatattctattataaatattttgcagttatagtgaaatattctcaaaacacattttatgaaacactgcgttagataatccatttaggtgaagtccaacagtacattacaacctcagtattttatttgttagagttgtatgaatcaagcactttattattggcaaaggtattttgtaatattgtaatagactttatattgagtgcagcaaattaagttatgagttcttgacctgctttatcatctttgaatgtatccacttaattttctcttatttattttttgaactgaaaatggatccttttctttcacagagcttttaaattagttctgttttttgggtgaatttccttttctttttttttttttggtttgtttgaggcagagtctcgctctgtggccaggctggaatggagtatggtggcgtgatcttagctcgctgcaacctccacctcccaggttcaagcgattctcctgtctcagcctcctgagtagctgggactacaggcgcgtgccaccacacccagctaatttttgtatttttagtagagacagggtttcaccatcttggccaggatggtcttgatctcttgtcctcgtgatctgcctgcctcagcctcccaaagtgctgggattacaggaatttcctttccttttattctcagaaatcttaacagcatgattatatatttatattcatatatttaagtggaatacatgtatgatacatgtgaacccaggtaggtataggtctgaatataaccaccagtctagggatcgtatttggcataacaccatttgaaggtgtagcagtggcactctttgattaacacgatgttcattttattctgtttcttcttggtgactactgatttcatgtaattaaacttcattataaaatttatatactaccgaaagcaatctacagattcagtgcaatttctgtccaattaccagtgtcattcttcacagaataagaaaaaacaatcctaggattcatacagaaccaaaaaagagccccaattgccaaagccatcttaagcaaaatataaagctggaggtatcacattacctgatgtaaaattatactacaaggttatagtaattgaaaacagcacagtactggtataaaagtagacatataagtcaatggaatggaatagagagtccagaaataaagccccatactgtcaaccaactgatctttgacaaagttggcaaaagtatatactggggaaaggataccctattcaatgaatagtgctgggaaaattggagagctgtgtgcaaaagaatgaaactgtacccctaccatatacaaaaattaactcaagatggattcaataattaaatgtataacctgaaactataaaaatcctagaagaaaacctgggaaaaactcttctggacattggtctaagcaaagaatttatgagtaagtcctcaaaaggaaacaaaaccaaaaatagataaatgggacttaaactaaaaagcttttgcacagcaaaagcaataatgtatttaacagacaacctacagaatgggagaaagtatttgttaacactatctgacaaagttctaatgttcagaatctacaaggaactcaaacaacaagaaaaaaacaactccattaaaacgtgggcacaggacatgaaaagatacttctcaaaagaagacatacaagtggccatgaaaaaagggtcgacatcactaattatcaaataaataaaagttaaaactataatgaggctgggcggggtggctcatgcctgtaatcccagcactttgggaggccggggtgggcagatcacctgagatcaggagttcgagaccagcctggccaagatggtgaaatcccgtctctactaaaaatataaaatttagccagtgtggtgatagggtaaaggagggcactttcagtataagactatgttcttgggaattttcctgtgttaattcattgagaagctccttccttcctcatatcctgtaagtcaaatgttggatttaccaggctggttttcttaattttctctttttcaaaccgtgcccttgttctgctgcctcaccacagctttccgttacagctcaattaagaaaaattcctgaggctttccaaggctctttgtggtttgtgggcttgcttctcaacagtatatccctccataggctcttaggtttgatcttcctccactctaactcgtatattgtttctcaatctgtttttccattgttgtagatatggctgggagctacacatactgtttttttttttttcttgtcccttttatcattgtggggtagtatttctgagactaaaaggatgggaaggcctgattctactatttttaatctgtatgtctcattgtataaggtagattattatgttgattagtttacaactggcatgaaaattttattgaccttgggaagaaaaactataatatgttttaatcctgttgtgaatagagctggacagttctagaatagtgtagtggattaatgatgaagtattgatgataacagttaactgttgagtgtttgttatgtcaggtactattttaagcacttaatgaattaacctttctaatcatctcaaccaaactttgaggtaggttattattttctgatatgttatagttacacaataattgtgaatgtctttaagtatctgattatggacaagataaagcatatgtatataaaaacactgaaatggatagaaaataaattcatagcattactggtcctttatccgaagctcagctaagtggttacagcagttcagtgtgaatgaccattgccgtaaagaataatagcctttttctctggaaagaacctttgcaataatctagaccagcaatgttaaaattatgttctgtggagctttgaggctctgagttgagtctcctgctgcttctgttcccccatgaaacgtttgaaaatggttgagctatgctgtccaatatgagatagtcactagctacagttagctattgagcatttaatatgtggctaattcaaattgagacatgtaagtgtaaaatttacattggatgttgaagcttccatatgaaaaaataatgaaatctcaatttttatactgaaatattctagacatgggttaaataaaatattaaaattaattttatcttttatttcctttttcaaatggctgctagaaatttttaaaatttcatttgtggctttcattatatttctgtaggacagtgcagatacaaaccatgtttctattttataccaaaattttgagtttgaatgatttggccaagattacatagcagataagtagaaccaagatcttctcacatctgaattagtgttctttctacaggattgtgcagcattaggtccacctgataaaagttgtactggcacgctgtgacacaaatcttgtgtttgttttgcagagcaggattggaaagaaagcatagttaaaatgtgatggtcgggccgggcacggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaatgtgatggtcaaagcattgctttgcatgcttagctcacctcttataactaacgattaaatgatattgattatagctatttagataccgtggtacatctcttattctgtatgacctctattacctttttgggattatttcatttaatgtcattttaaagattttcacagttgtccatcatgctgagacgttttcgcttgagtagttgcataacttgcatgttttccaaccttttactgcattataaattgtctttgacaaatttaatgtgttaatctcattcttccacttttatcaaaccagtgtttgtgcttcttttggctagtagtattagttgcatgtttgtcagtttgccctttgatttcacctgtttaaccaacggccgctacagtttttatcactgcattaataacatttaacatatcttgaaagtggttgtacattttaaaaatattttctgttgctaattttttttctagcagttttgaatactgttgacatagctttgctgttctaagtcaaatattggacgagcagtcgtgtttttcatgacctgtagtacttaaagatcactaacagcatcccgctgtaccaaactgcctgtgcgtataaactgcaataccaatagatgtaatgttagtgactgggtatgattttggaatcgtgtaaatgttttaaataactgtaaaacaaaattaaaatgagagaagaaatcctcaaaaagaaggaaacaagtgacctggtttgtcatgcttgtggctaagccacacagagaagaattattttagtatacctttaaactgtggtaatttgactaatttcctctgctagtttatatcttaaggacaaaaaagaagtataaatgaatcttcacttgcttttggtaatcatataaaattggtagttatgaaactatatatacatttgtatatgaataaaggaaattcatatttatattaatattagaaacctgatacttttagtttaagaaaataagtaaataagaaaattaaagaagttaagtaagtttgaattggtaatatcactgggaatttatgatatattttctttaataaaacaaaacaccagctctgtcctgagaaggcctagaaatagcaaattacctttttgcagtgagcactggcattctgaggtatttagaattttttctcaaaggaaccaggttccttgcaaaaataactggttcttggttaaagatagggaatattttataaagcaaagaagttttctgagatcactggagttttgttgaaaagactcagagccaacttgaactagctcctagctcccattgggtaaaaatagggtattttgagtatcagaaaaggttataaagacttctgcttctggccaaaatggagtattaggaccaggatttaccttcctacctgaaggaaccaggaataaacagataaaatacatgaaaacagcagttcaagacactaggcattaggcagtggaagatagtgatctctaaagatgggaaacaaatgagataaatcctgtgattatctcagctttctagttgtaaacatagaaagaggcgctaaggcagagcccacagcctcgctgccttgaggcagagctcagagtctgtgaagaccaggcaaatagagtttcgtaggatggaatatcaaagaagagagacctgtatattgagtgaagcctgaaaatcttcaaaggctttcctcagatattcagcagaatgctgattagcacatgtgtttgaggaaactacccaaggttagagaaaatatcattttaaaggattagacggaacagtgcctggtacttacacagggctggaaacagtgcctatccctctagctggactggagaaactcataattcatgagggattaggtagagtattcaggagagccttgcctcagtagtggagattaatgagctgtatacttagtactgctccatacttaacctgacaaatgaaaacaaggtccaaaaggatcaaacagtttccatataacttagctgtataccgaaatggagctcaagaatgtttataggaatacgaaaatatccagtacacgaggtaaaattgacattgtctggcatccaaagattgtgacgtatacaaaaaagcaggaaaacacaactgtaatggggagaatgatcagttgaaactgactcgactgataaagatgttagagttatcaggtaataaaatataaatggttattataaccataccatattccatgtgttcaaaaagttagagacatggaagataaaaaaagactctgccaggcatggtggttcacacctataatcccagtgctttgggaggctgaggtgggaggatcgcttgagcccaggagcaacataacgagtctaccaaaagataaataaataaaaaacttagccaggcttagtggcgcacgctatagtcctaagtcccaaggttgaggtgggaggatggcttgagcccaggagtttgaggcttcattgagctatgactgtgccactgtgctccagcctgagtgacagagtgagaccctcttaaaaaaaaaacaaacaaaaaaaaacaaacaaagtaaaaaggtataaaaagactcaatttgaactcctggagataaaaactgtgatgtccaagatgagaaattcccaaatgggattgattgcaaattaaaaattgcagaagaaaagattagtgaactctgggcataggaatagaaaccatcaagaatgaaaaagaggtaaaataacccacccccgccctgccctgacacacacacacacacacacacacacacgcacgcaaaaaaacccacaagcgagttatgggacaacttcaagaaagctaaatacaggcaattggagtccgtaaaggaaaagagagggtggaagagaaaaaatatttaaagaagtaatggccgaaaaccttttataatgaagaactgtaaatccactgattgaaggaactaagtgaatccccatcacaagaaagatgaagaaaactacgtcatggcatatcatagccaaactgctcaaacccaaacttaaaaggaaactcttaaaaacgcccagagtaaagacatgttacctgcagaggaacagagataaggatgacatcacagttctcgttgtaaacaatacaagccagaagacagtggagaatcgtttaaggaaactgtcaactaaagaattcttcacccccagacgttgcactgagacagaagtaaaataatgtcctggattacttgagcaaatcccagctatcaaattattttatctgtaaatacttcaatatgtatctctacagaataaagattctttttttcttttctggagacagagtctcattctgttgcccatgcaggctagagtgtagtggtgtgattacaactcactatagcctcaacctcccagactcaaagtgattcacctcagcctccctggtagctgaggctgcaggcacgcaccactacatctggctgattaaaaaattttcttgtagagatggggtctcactatgttgcccaggctggtctcaaactcctggcctcaagcaatcctcctgccttggcttcccaaagtgctggcattacaggagtgagccactgtgcccagtcccggataaagatttttaaacttaaaaatcatcaaagagcgcagtcagcttttcacctcaaattttagcagtcttccatggtcccttcctagatccattacttttataggagttacggggatcatttcttctgcttttattagctggaaggtcattcagaatagtgttatcatactttaaaaagttagttttttaatattaagcatctagtcaacattcagattttctacattgtcacaaaatcttatgtttgtttcttagagtcagaaactaagtcatacattgtatttggtgctgtctcttaactgttttaaaaaatttttattaataattggtgaaaaaatttttcctcttactcatttttaagtgtacagttcagtagtgttaacaatattcacattgttatataacatatatctagaactttttcatcttgcagaattgaaattctatgccacattaaacaagtattcctcatttctcctttcccagcttctgataactggcattctactttctgtttccatgattttgatttctctagatatctcatataagtagactcgtacaatatttgtcctcttgtaactgacttatttcactcagcataatgacttcaaggttcatctgtattgtagcttgtgacaggatccctttttctttaaggctgaataatattccattgtatgtattaccacattttccttattcatctgttgatggacatttgggctgcttccacctcctggcccatgtgaataatgctgcaatgagcatgagagtgcaaatatctcttttgatattctgttttgaattcttttggacatatacacgtaagtgggatgtctagatcataatgataatttcatttttaatatttcaagagcctccctactgtttttcatagtgggtacacgttttattttatggtagttttgatttccatttgtctaatgataagtgatgttgagcatcttttcatatgcttgttggcatttgtatgtctttggagaaatgtactggtgttttgcctattttttaatttggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttacctcagttttagcagtctttgatggtccctgcctagatccattacttttatagaggttacagtgatcattccttctgcttttattcgctggaaggtcactcaaaagaagacctttcccttagctacagttcacacaggacagagaaatgcttgattctcttcctgtatttgttttcagaataatgagttggtttcttagcatcctccaaagggatgaaatagtgtgtgctttaatatcattaagaatgtacagaattgtaatcccagcactttgggaggctgaggcgggcggatcacgaggtcaggagatcaagaccatcctggctaacattggtgaaaccccgactctactaaaaatataaaaaattagccgggcgtggtggcggtgcctgtagtcccagctacttgggaggctgaggcaggagaatggcgtgaacctgggaggtggagcttgcagtgagctgagatcgcgccactgcactccagcctgggcgacagagcgagactccgtctcaaaaaaaaaaaagaatgcacagactttaacatagatactttcaaaaataggtttatgacagtctggttgacagtctgtgaaaaccatcaccatagttaagttgtgaacatattcatctcacccagaggtttcctagtgcacctttttagtacatttttctctacctctttcctctgatctattttctgttactactgattagttaccataaatggaattatgcaacgtgtattctttttctttctagtttcacacagtttaatcattttggtattcacttattgttttgtgtatgaattgttcattccattttataattgaatagtattcttttgtatggataaacaacaactggtttatccattcacttgttgatggaaatttggattatttccagtttttggtgattacaaataaaattgttaggaacactcgtggacagctttttgtgtggatataacttttcttttccctcaggtaagtgtctagaagtgatatggctgggttgtatagctggtgtatacttaggagctgtcaactgtttgccaaaataggttgtactattttaccttcccatgagcagtgtacaagagtttgagttgctgcacatcattgttaacatttggtatggtcagtcttttctatttcagctattctgaggagtatgtagaagtactccatgatggtttcagttttcattcacctaataaataaagttgtaagcatcttttcttttttaaaaaagtttatttttaattggcaaataataattatgtatatttatcatcttatatacttctttgtggtgcgaacatttaatattcactctttcagcaattttgacttatgtaatacattattattaactgtagtcactatgctatacgatagatcaccagtgagcatcttttcatcggcttatttgctgtgtatctactttagtgaagtctgttaaaaaaaaaattcctttccagttaaattttttaactgagtcgattgtcttctagatatgtcttttgctagatacgtgttttacacatattttctcccagtcagtggcttgccttttcatttacaaaagtaacattttaaagaacaagcatgtatatctgatgtgaggtacatgttaagggttcttttttttttttttggcatatggctatccagtcgttcaggtgccatttattgtaaagattatttcccccattgaatttccttggaaacacttaccgttgaccatatctgtataggtctgtttctggacctctactttgttctattggtctatttatctagcttaaataccatgctggctggtaactgtagccttaagattagtttcaaatcaggtagtgttagagctccaactttttctttttcaaaattgttttggtctgggtgcagtgactcatgcctgtaatctcagcactttgggaggccgaggcgggaagattgcttaagcacaggagtttgagaccagcctgggtaaggtggcgagacaccatctctacagaaagaacaaaacaacaacaacagcaacaacaacaaaactaattagcatgcacctatagtgcccagatactcaagaggccgaggtagaaggattgcttgagcccagaaattcgaggcagcaatgaggtatgattgtgcccctgcactccagcctgggcgtcaaagcgagatctcatcccttaaaaaaagtaaaacgttgttttggttattgtaggtccttcacatttatatgaactttagaatcagctattcagtttgtacatgaaagcctgctgggaatttgattgggattatgttgaatctataaatcagtttggagaattgatactgttaacaatcttgagtcctctgacccatgagcacagtatcttcatttatttatgtcatctttctttcttcctttcctttgctttcctttattttatttattttttttattattatttttttttgagacggagtctcactctgtctcccaggctggagtgcagtggtgtgatctcagctcactgcaacttctgcttcccttgctcaaacaattctgcttcagcctctcaagcagctgggattataggcgcccaccaccatgccagctaatttttgaatttttagtagagatgaggtttcaccatattggccaggctggtcttaggtgatctgcctgcctcggcctccccaaagtctggaattacaggcgtgagccactgtgcccggtcatgtttattttttataattgagattttattggttgtgttgaggattagtatacagacatttcagtttgtacacagttcttatgtactaaaaatctaaaaagctgtgtattgtaattcttttttaaacagttattccagtgagtttccagcttaaaatctggaggcaaatttttaagaggctgtccagtaccagtatcttaaaatgttaagttactgcatacatcccaccaattcacagtttaatagcatatatactacatattcaaattttcaatcttttgcagtacattaacaaagttattaggaaaacagcactaccatgactgaagattttacagagtatgcacaattctgatagggagagccatgatcaaggagtggttttctttaggaaacaattctgctaaaaaataacataggaatagaagtaatttaaaatattcaagacattaaatgcaggactgtgattccatattgccattttgtatactttgtattgtaggatataaaaactaatccctcatctatggaatgtcagagcctcccataattcagtatcccacactattttctggttgtaccaaaaaataaacaaccagcaaatgatttcacctcttaagaaaagcatttacacttaaaaaatgggatgaggtgggattccctccttttaaaaatgtttctagagctactagaaaacttatatttacaaaatagtttatgaaaatattcctctaggctgggcacggtggctcacacctgtaatcccagcactttgggaggctgaggcgggtggatcagctgaggtcaggagttcaagaccagcctggccaatatgttgaagccccgtttctactaaaaatacaaaaattagccaggtgtggtagtgggcgcctgtaatcccagctacttgtgaggctgaagcagaaggattgcttgaacctgggaggtggaggttgtagtgagcctagaccataccgttgtactccagcctcggcaacaagagtgaaactccaatttaaaaaaaacaaaacaaaacaacaacaatgaaaaaaccagaaaattcctgtggatagtacaagaagggaaacaggaatgactcataagacaaggtatgtgatattaatcacacttggcttttttttcctctggctttctcagtttagtttctctgttttctgtaggtaggtaaatctttagtttcttggtttgccactgcgatgtattttctctgctttccttttcacttttgttttgtctgaagatgtatcctttcctgctgccttttttggtttcctgtccacttttgtaggagcagagttagctgagaactgtgctgggtctccacctgggctcttccttcactatcccttcagctgagctgaccttccttcctctttgatattttggtggtggagaggcgcgagagccttggtgaagctaggctgcctagctattgctgtcctgtcccgtcccatcccgtcccatcccgtcctccccagtctctaccagctactgagacctgctgcgggggttaggtcatctttacattctcttagcaatttgtagtttttggtgtataggtcttacagatttttatcttttgtcagatttttccctaagtatttcatttttattgatgctgttgtaattgttattttttagatttcagttgttcattgttaatatgtagaaatgcaatttaattttgtatattgatctcctaaagcttgctgaactcacttgttagttctagtccctttgttatagattccattgggttttttacataggcaatcatgtcatctacagataaaagtttccttattttccattcttatctggatgacttttatttctttaacttgtttggttgtactgactagaacttaatggtgcagtgttgaatgaaaataataaaaacagacctatctgttttatttctgaccttagatgaaaagtagtgggtctttcattacctgtgatgttaatgacaggtttttcatatatagtcatgtactatataactatgtttccatcagctatggagcacatatatgatgtggtcccataagattataattaccatatttttactgtaccttttctatgttttgatatgcaaatttttacctttgggttaaaatcgcctccagtgttcagtacagtaacgtgctgtacaagtttgtagcctaggagcaatagggcatatcatatcgcctaggcgtgtagtagctattccatctaggtttgtgtaactacaatctgtgatgttcacatgatgatgaagtcgtgtgatgtatttctcagactcttgttaagtgatgcatgtgtgtattttatgagattaaggaagttctctctctttttaaaaagtttttatttctatgtatgttcttatacagtatgctaaagaaaaacttttttaggagagtttctttaaaaccttaaaaaaaaatttcattgagcccaaaatgtcatatgacgttaaggaagttctcttctgttcctagttgaatagatatataaatgtttagagttcttacatcttcttgatgaattgactccttgatcattatgaaattacctactttctgatatattatttatcttgaaccaacttgtctgacattacaatacagtcactccagctttctgttagctagcattggctttaaaacagtttcattgagatataattcacacgctgtacaattcacccacttgaagtgtgtaattcagtggtttttagtatattcatagagttccagtacttcaccacaaccaattttagaacattttagtcacccgctaaaaaaccccttatgcccattagcagtcactctccattccctctgctccccgcttaggacccctcaacccttatctactttctgtctctatagatttgcctattctggacatttcatataagtggaatcatacagtatatgtggtcttttgtgattggtttctttaacttagtagagtgtgttaaagattgatccatgttgtaacatgtattggtacttcattcccttttctcactaaatattccattgtgcagatataccactttttgtttattgactcagttgttggacatttggattaacttttttactattgtgaataatgcttctgtgaacacatacaagtttttgtgtggatgtatgtttttatttctatgtatgtactatacggtatgctaagtacggcacttagtacagtatactgagagtggaattgctgggttatgtggtaaatctacatttaatattttgtggaactgccaacctgttttctacaaaagctgtaccattttacatttttattagcaatgtttgaaggcttcagtttctccaccttcttggaacacttgttatcttttttgaggcagggtctccctctattgcctaggctggagtgcagtggtgccattatggttcactgcagctttgagctcccagggtcaagtgatccttccacctcatcctcccaagtagctaggactacaggcacacgccaccatgcctagctaattttttattattttttgtagacacagagtctcactgtattgtccaggctggtctcgaactcctggcctcaagtgatcctcctgcttcagcctcccaaagcactagggttgcaggtgtgaggcactgtgcctggcctcaatggtttttttaaaatacttttttttttttaaatgagaaaagtttaaaaaaaattgtaccacattattactgtttccgatggtctttattcctttttgtagatctgtatttcatctggtgttagtttccttctatctaaggaacatcctttaacattttcttataggactggtctgttatgatgaattcattcagtttgtatgtgtctgaaaaaagtttatttcactatttttataaagaccttaattaattttttttttttagcagtttttggttcccctcaaaactgaacagatagtacagagatttcttatatgctctctgcccccacacatgcatagcctccggcattgtcagcatcccccatggagtgatacatttgctataattaatgaacctacattgacacatcgtcacccaaagtctatagtttatattaagattcattcctggtgttgtgcattctgtgggtttgatatcacacagagtagattccctgtgctaaaattctgtgctccacctatttgtccctcctttccccaacctcctacaacaactactaatctttttactgtctccatagttttgccttttccagaatgtcatatagttggaatcatacaatgtgtatgccttttcagattggcctctttcacttaataatatgtattatttaatgttcttccatgtctttccacggcttcatagctcatttctttttaatgctgaataatattccattgtctggatgcaccatagtttatccatttacctgctgaaagacatctggattgcttctgagttttgacagttatggataaaactcctatatacatttgtgggaaggattttgtatagatataagctttcaggtttttttgatgaatacaaaggagtattgttgctgatcctatggaagagttaatttttgttgttgttgttgagacagagtcttgttctgtcgcctaggctagagtgcagtggcatgatttcggttcactgcagcctctgcctccttggttcaagtgattctcctgcctcagcctcccgagtagctgggattacaggcgcctaccaccactcccggctaatttttgtatttttagtagagacagggtttcaccatgttgctcaggctggtcttgaactcctgacctcaggtgatccacctgcctcggcctcccaaagtgctgggattacaggcatgagccactgtgcctggctgagtatgtttaattttgtaacagactgctaaactgtcttccaaagtggctgtaccattttgccttttctaccggcaatgaatatgagttcctgttccacagccttgccagcatttggtgttagcagtggttttggattttggccattctgataggtaggtagtggtatctcatttagtttgcgtttccctgataacatataatatgggttacctcttcatatgcttgtttgccatctgtatatcttctttagtgaagtgtctataaaggtctttggcccatttttaagtgggttgtttgttttcctgttaagttttttatatattttggctaccagtctttcattagatattttgcagatatttcttcccagtctgtggcttgtcttttcattctcttggtagcgtctttcacagagcagaatgttttaattttaacgaagttgagcttatcagttatttcatggatcatgcctgtggtgttgtatctaaaatatcattaccaatcctaggaactctagcgtttcccctgtattaccttttaggagttttttagttcttttttttttttttttttttttttttgagacgaggttttgctcttgttgcccaggctggagagcaatggcacaatcttggctcattgcaacctccgcctcctggattcaagcgattctcctgcctcagctccagagtagctgggattacaagtgccttctatcatgcctggctaatttttttttttttttttttagatgaagcctcgctgtgtagccgaggctggagtgcagtggcgcgatcttggctcactgcaacttccgcctcctgggtcccagttcaagcaattctcctgcctcagcctcctgagtagctgggattacagacatgtgccaacatgtccagctaatttttgtatttttagtagagatggggtttccccatgttgtccaggctggtggtcttgaactcctgacctgcccacctcagtctccccaagtgctgcgattaaatttttgtattaatagagatggggtttcaccatgttggtcaggctggtcttgaactcctgacctcaggtgatccacccacctcagcctcccaaagtgctgggattacaggtgtgagccaatgcgcgtggcctagttttttattacatttaggtctgtgattccttttgggttaatttttgtgaacgaaggatgtaagacctgtggtttagatttgtttttttgcctgtgtgtgcccagttgttccagcaccatttcctctctttggacccttttttctttttctttttcttttcttttttttttttttttgagacagcatctcgctctgttgccaggctggagtgcagtggtgccatcttggcttactgcaacctccaactccctggttcaagtaattctcctgcctcagcctcccaagtagctggcattagaggcacgtgccaccacgcccagctaatttttgtatttttattagagacggggtttcaccatgttggccaggatggtctcaatctcctgacatcatgatccccccgccttgaccacccaaagtgctgggatttcaggcatgagccattgcacgcagcctggacatttttttttttttttgatacagatatttcaaatggcaaataaaattttatatatttatggtgtacaacatgatgttttgaaatatgtatatattgtggaatggctaaatcaagcaaattaatatacagatcatctcatatacctatcattttgtgttaagcacacttctacagtctcagcaggatttgtttttttgagacaaggtcttactctgtcgcccaggctggagtgcagtggtgtgattgtgggtcaccgtagcctggagctcccaccttagccttttgagtagctgggactacaggccagtgccaccctgcccagctaattttttgcttttttgtagaggcagggtcttgctgtgttgcccaggtgagtcttgaactcctggtctcaaatgatcctccgtcctcagccttccaaattgctgggatttcaggtgtgagccatcatgcctggctaatctgttgtcttaacagtcttcaaatgtacaatatactgttatgaactatagtcaccatgttgtacaatagatctcttgaacttactcttcctaactgaaattttgtatcccttcaccaacatctctccagcctttcctgtccccagccctccacacttattaacaaccattatactctctacttctgtgagtttggcttttttagattccacataaaagtgagatgcttatgtggtctttctgtatctgtcttattgccttaacataatatcctccaggttcatccatgttgttgaaaatgataggatttctttcatttttaagaacgtcggtctgttgtatatatagaccacacttttttgctccattcatctgagatggacacttaggttgattccatatcttggctattgtgaataatgttacagtgaacctgggagtgcagatatctctttgacatactgacttcctttcctttggatatatgcccagtagtgggattgctggatcatatggtaattctttttttagttttttttttttttttttttttttgtggaacctccatactgtttttcatactggctgtaataaattacattcccaccagcgatgtgcaagggtttcctttcctcagcatcctcgccaatatgttatcttttgtctgtttgatgattgtcattctaacaggtatgaggtaatacctcattatggcttcaatttgtatttccctggtgatgagtgatggtgagcatttttttcatatacttattggccattttatgtcttctttttgagaaatgactaagttctttccctattttaaaatcaggttgttttcttactattgagttatttttgagttccttatatattttggatattaaccccttatctgatgtacggtttgcaaatattttcttctgttgcataaattatctcttcactcttttgattcctctgctgtgctttttaaaaagtttgttgtaaccccatttgtcgccctgcttttgttgcctgtgcttttggggttccatccaaaaaatcattgtctagaccagtgtcaagaagctttttccctatgttttacagtttcaggtcttagtttcagtctttaatgcatattgaattaatttttgtttatggtgtgggataaaggttcagtttctttcttgtgcacatggatatctaattttttgagccccatttattgaagagactgttcttcccctattgtgtgttcttggcacctttgtagaaaaatcaattaatcataaatgtgtggatttatttctgggctgtttattctattccattgctttatgtgttcgttttcatgccaagaccttgctgttttgattactatagtgtgtaacatacagttgacccttgaataaggtcttgaactgcttgggtccacttatatgcagattttcccctgcctttgccacttctgagacagcaagaccaacccttcctcttccctcctcctcagcttactcaacttgaagatgagaagatgaaggcccttatgatgatccacttccactttatgaattgtaactatattttctcttccttatgattttctaaataacattttcttttctgtagcttactttattgtaaaaaatacagcatataatacatatatcatgcaaaatgtgttaatttagtgtttaagtcattgataaggcttccagtcaatggtagcatatttgtagttaggctgtgggggagttaaaagttatatgtaggtttttgactgcgtaggggattggcttccctaacgcctgtgtcatttaagggtcaattgtattttgaaatcagtcagtgtgaagcctcctcctctgttcatttttgctccagattgctttggctatttggggtcttttgtaggtccatatgaattttaggattttaaaaaatttctgtgagaaatgtcattggaattttgatggaagttacattgaatctgtagatagctttggttagtatgaacatgttaatactgttcttctaattcatgaacataagaatatctttccattcatttatttcaatttgtttcatctgtgttttatgtagtttttaatgtacaggtctttcacctccttggctaaatttattcctaagtattttattttatttttgtagccattgtaaatgggattgttttcttaatttctttttcagatagtttgttgttagtgtatggaaatgctacacgtttttgtttattgattttatatcctacaactttcctgaatccatgtattatttctaacagtttattggcggagtcttcagagttctttccatgtaagatatgtcttcagcaatcagggacaatttcatttcttcctttttaatttagatgccttttatttctttctcttgcctaattgctctggctaggacttccaacaccatattgagtgaagatggcaagagtgggcatccttgtcttgtttctgatcttagaggaaaagctttcaacttttcactgtttagtatgatgctaactgttggtttgtcatatatggcctttattgtgtggaggtaaattctttctatacctaatttgttgagagtttttatgaaaggatgttgaaatttgtctcatgctttttctgcatctattgagatgatcataggtttttgtccttcattctgttaatgtgattcacattcatagatttgcgtatgttgaaccatccttgtatccctgaggtaaatcctacatgttcatattgaatgatctttttaatgtgctgtttgttgaattttgttagtgtttcgttgaactccagcaccgtttattgaaaagactacctttgcaccattgtattttatccttttctttgttgaagatcattgtactagatttatgaggtctatttctgggctctctattctgtttcattgatctgtttgtctagtcttttgccaataccatgctgtcttgcttacgataaatcttgaagttgggtagagtcattcctctaactttgtccttttccttcaatattttgttggctattttggatctttttcctttccatatacattttagaatcatcttggtgatagaaaataactttctgggattgtaattgcattgaatctataggtctagttgggaagcactgacatcttgccaatgttgagtctttctttatagataggaataatacctctccagttatttaggtctttgatttgtttcatcagagttttgtagttttcctcatagaaatctcgtatatgttttgttagattcatacctaagtattctgttttttggggagtgtaatgtaaatgacactttttaatttcaaattccctttattcattgctggtgtataggaaagcagttgaattttgtatattaaccttctgtcatgtaaccttgctataattgcttattagttccagaggtttttttattgattcttttgaattctccatgtggacgactgtgtcatcagagaaaaaaagatggttttatttcttctgttcccatcagcatgcctttttcccttttcttgtcttactgcattcattaggacttgcaatacaatgttgaaaaggagtagtgagaggaaatctccttgtcttgctcctgatcttagcagagaagcttctagtttcataccatttaagtatgatgttagctgtaggtttttttctggatattccttgtcaagttgaggaatgagaatttttaaaatcgtgaatgggtgttggattttttttcatatgcttcttctgcatctattgatatgggtgtgtgatttttcttcccttagtctgttgatgtgatggattttattaatgattttcaaatgttggaccagtaatttacacctgggataaatcccacttgatcatggtatatgattcgttttatacattgttgggtttgttttgctaatgttttgttgaggattttgcacctgtgttcataaaaaatgttggtctgtagttttcttataatgtatatttgtcaagttttggaatactctgatgttggcctctactgaatgagttaggaagtattccttctgcttctatcttgtgtaggagatggtacagaatgggtataatttctttcctaaatgttttataaaattcaccagcaaacccatctagtcctggtgttttctgttttggaaggttgattggttcagtttctttaatacaggcctattcagattgtttcttgtgtgagttttggtagtttgtggctttcagggaagtggttcattttatctaggtgatcaaatttgtggaaatagaattgttcatagtattctttttttatttttatttttttgagacagagtctcgctgttacctaggctgaagtgtagtggtgcaatcttggctcactgcaacctctgcctcccgggtccaggtgattctggtgcctcagcctcctgagttgctgggattacaggcgcccgccaccacacctggctaattttcatatttttagtggaaacggggttttgccgcgttggccacactggtcttgaactcctgatctcaagtgatctgcctgcctcagcctcccaaagtgctgggattacaggtgtgagccagtatactgtgcctggccagtattattttattgtccttttaatgttcatgagatttgtagtgattttctttctttgagttctgatattaggagtttgtgtcctctgtctttttgttagtctacttggctagaggtttatgatttaattggtcttttcaaagaaccagcttttggttttttcattgatttttctcagttgatttcctgttttcagttacattgatatctgctcttgtttttattcttctgctaactttggatttaattcgctgcttctttttctgttttttttaaggtgattgattaggtgattttagatcttttgtcttttctggtaaatgcattcaatgctatgaatttccctctaagcactgctttcacgtcatcccatagattttgataagttgtgtcttcattttcatttagctcaaaatattttaaaatttctcttgagatctcttttttgacctatgtgttattagaagtgtgttgtttaatctccaagtacttgggttttttttaaaaattatatttctgttattgatttgtaatttaattttattgtgacctgagaggaggcattttataacttgttcttttgaatgtgttaaggtttgttttatggcccagaatgtggtctatcttgatgaatatcctatgagtgtaaaaatgtgtattctgttatttcttctgtgacataatctgtgaatgttcattatatccagttgattaatgttgagttcaattatgtccttactggttttctccctgcttgatctggccgtttctgatagagaggtgttgaagtgtccaactataatagtgaattcatttatttctctttgcaattctatcagtttttgcctacacagacactttgttgttaggcttatacacgctaagcattgttatgtctttttatccttatttttatccttgataaaagttatccttgataacttaacttgtcttatctgctgtgtctgaaattattacggacaactccgctttctttttttgagacagtctcgccctgtggcccaggctggagtgcaggggcgcgatctcggctcaatgcaatctctgtctcccaagacatgtaccaccatgcctggctaatttttgtatttttagtagagatggggttttgctatgttggccaggctcgtcttgaactcttggcctcgtgtgatctgcctgccttggcctcccaaagtgctgggattacaggcatgagtcaccacgtctggccaactccgctttcttttaattggtgttaatatgatatatatttctccatctatttacttttaatctgtgtttttatttaaagtgggtttcttgtaaaccacatccagtcggttcttgttttgtgatccacttcgacagtctcttttagtctttattttttgccaaaatgccgatttatttagaatattgaactgaatattaactgtcaaattgaaatcagtgaaggaaaacattgtataagcaaaacagtttgcattttgggacatactgcaaactttcaaggaattgcgggactaaatataaaggtgtagagtgattatgttgacaaatataaaggtattttatagctgacctcttccatttcctgcccttactctcacccctgcattgtatgcaggcccagcttctatgtcagaacctgcatttctttatctgaggactttctgtggccactgaattccaattttgcatctgtgtgacaagttgcaggtactaggaaattaacattccccaacaaccttgaaccaatgatggaagatgatatataaataatactccagttccctcacccctgaataggatgactccaagatgtatctgacaatctcttttaattggtgcacttagactattgacagtcaaaggaattgcaaagatagttggattgatatttaccatatttgttactgatttctatttgttagccttttttttttgtttctagttttgtctttcactctttttctgcctttgtggttttaattgagcattttatatgatttccattttctgttctttcttagcatatcaattgtacttttttactttgcttagtggttgtcctagaatgtcctagattgtaaatgtatatttacaactacctcaaatctgctttaaaataacactataccttttaacaggtagtgtatcttactataagataatcctgtttctcccttccattccttgtatcattgctgttaactcatttaactttttttaaaaatttttatttatttatttatttatttatttgtttatttatttttgagacggagtcttactctgtttccctggctggagtgcagtggtgcgatattggctcactgcaagctccaccccccgggttcacgccattctcctgcctcagcttcctgggtagctgggactacaggcgcccgctgccacgcccggctaattttttgtatttttagtagagatggggttgcactgtgttagcccagatagtctcaatctcctgacctcatgatccacccgccgcctcctcccaaagggctgggagtacaggtgtgagccaccgtgccccgcctacttatttagcttatacagaaatgtttgtaatcttatgtatatacacattagcttacataatcaaatgcattgttgctattttaaacaaaattttacctgctaaatcaatttttaagatgttttaattttacattcacttattcattctttgatgttcttcctttatgtagatccaagtttctgacctgtatcatttcctttttgccaaagaatttcgtttaacatttcttgcaaagcaggtctactgacaataaatttccttagtattctgaaaaaaatctttatttttgtttccacttttgaaggatgattttgcaaggttcagagtttctaggttggtggttttctctctcaacacttcaaatatttcacttcactttcttctggcatgtgtggttatcattcttatctttattcatgtgttaagtacagtgtttttacccttgtcttttaggattgtttttcctttatttctgattttctgttgtttgaaaatgatatccctaggtgtagtgggatttttttggcctttgtccagcttggtgttctctgggcttccagtggttttgttcccagaccaaactgggttgggctgctgtttctcatggcccaataacaagatgcagatgaactggggaggaagagagtttttatttttgtacctggttacagggagaaggcctagaaattattgccagaccaactcgaaattacaaagttttccagatattatataccttttaagctatatgtctgcgtgtaagtgtgtattcatctaaagacataagtgatgaaacttcttttaatctgtaactaaggtctgagtcttgaagaccttcctctggagtctcagtaaatttacttaatctaggtgctgaggtgattacccttatcttgtctcctgctcgtggaggtttggggagttctttcagacatccaataaacttgtttgtggaggcctggggaatttctttgttatgctttaaggcccaggaaaggcctaggcaaaactcttggtgggcttttgttagattccagcctttgtataagggcactggctttttttagcttttaatatttaacttaaccagtcagtcagtactgaaacagttgttatggagccctgcattaatgagacatggcctgctacagtttggtgtctgatactaatttgggggaaattctcagtcattattgtgtcaaatatttcttttgttctttcctctcctcctgatagttccattccatgtttattataccatttgtagttgtttcagttcatagatactctgttctatttgtgtcagtcctttttctgttttcttttcagttttaaagatttcgaatgagatttccttaagctcagagattatttccttagctgtgtcttgtttactaaaaagtcgatcaaaggcattcttcatttctgttgttgttgatctcttgcatttctttttagttcttttttagaatttccatctctctccttacattgcctatctgttcttgtatgctgtccactttatccatttaaagcccttagcatattaatcgtagttttaaattcttggtccgataatctcaacatcactgccgtggctgaatctggttctgatacttgctctgtctcttcaaaatgtgttttttatattttagtatgccttgtaattttttcttgatagctggacatgtactgggtaaaagaaactactgttaaataggcctttggtaggtggttttggtattaagagtaatgctgatctcctagaatgagttgagaagtactgtctctgcttctgtcttctgaaagaatatgattatgtgctgattagtattaagttaaatctcagagagaacctcctgtagatcttgggtgttctttttgtgttgtactctgcgttatgaattttaggtctcttggccttctcagctctgaactgtgttttctcaaatccaaggagcatctaaactctggttgagtttacctttcctgcactgcagcctggaactgtctgcatagtaatctgaggcagtattggggcttatcttgggtttttctttctgagatatcactactctgtggtttttattgtccaatggctgaaacattattttatgtattttgtctgtttttagttgttcagcgtgagagagggtaagttactgttactccatcatggcttgatgaataaatgtgctgcccaggattcataaggatataatggtaatcaccctcgttggctgactttggagagaactagtctcctttgcctatacacattaacggagctgctttaaaggtagtgcttaagcagtcatcatttgttgccactggttgctggataggttgggaaggtcagaagccacagtccaccatctttggagattaggagggaagtattaagtcatttgaacatagtttttattttcattttccttggtacattgttaggactgtcctgatgtatactttacataaagggatgaggaaaatggccaagcatgacccagctcctttttccaacctttttttttttaatgtcatatagtgtcagacctctcttagtaagttttacattatcaagtgttgtttatagcatgttgtaatagttaattatatttgattataagactatggagaaatctgaaatggttactcatcagtaaaagctgacagctttagaattttaaaaatgattttcaaagacttcactttgaatggggtgcctagtatttgaatgttgaactcccttgtgttagaatttacatttacattgctaccaatcttttatctttcagttattcaagcggagaaatgttgctacagcagaagaagaaacagaagaagaagttatgtcagatggaggctttcatgaggctcagattaataacatggagatggcaccagtaagataatgaactcttttcagtgtttttgtgatgaagatatgagatgtagatttccttttgagttttaaaaaaggttagatggctacaaaaagtacttggcatttcatttttaaaaagaatatgcttaatctcatggttcattaaatgtttattatattttggataaagtgcagttaaattataaagattaattctgctctaaaaacttaacaagctaattataagataaaattactctttaaaagttgaataagaatagacaccttatttatttatttatttatttatttatttatttatttatttatgttttagagacagggtcttgctgtgttgcccaggttggagtgcagtggcgcaatcgtaggtcactgcaacctcgaactcctgggcttaagtgatcctcctgctttagcctcccaaatagctgggactacaggcatgtgccaccatgactggcaaatttttaaattttttgtggagacaggatctcactgtgttgcccaggtgaactcctggcctcaagtgatccttttgccttggcctcccaaagtgctagaattacaagcttgagccatcacaccaagccataagagatactttaaagaaaataatgattttttattgatttacaaaattgacctgtttgtatgatttaaaaacttgattccacatcagaactcttggatttttctgttgtaaaccattttgttacttttttgaagttaacatgaagagataaaagtcatgctttatttgtatggattagacctatctagatttctagagtattgtaattacgtaattttaaaaataggttatatatgtgtacatatatatatatgtgtacacacacacagtttttttaaaaagaaaattatctcctaaaaggtactgttgtttgtagtaacaaaaaaagtacaattaaaaaaaatgaagaaaaatctttcttccgcttagccacctagtatttttctccattggcaactagtattactaaattcctatttattctttctgagaacttttgtatattaaaatgttctcctctcccccacctttttttttggtaaatggtggcatactattcatagtattttgtagtttttatttttatttcatttcatagatctccagtttacatgaaccagctttctttgagagttgggagggtagtattatttcctttggaattcatacagacatagccaatgccatcattttgtgatgaaagtttctaggcccttcagaaagccagtctttccaatttttttaagaagagagtgttaagtgaatataaagtgttttatggattgtattagggttctccagagaaacagaaccaatgagagaaagaaatttagtttaagaaagtggctcgtgtctttgggagctggcaagtgtgaaatctgtagggcacactggcccactataaattcaggttaagagttgatgttgttgaatcccttttcttcagaaaacctagtctttgcttttaagggtttcaactgattggatgaggccaacttggactacaggcgtgcgccactacccccagctaatttttttgtagttttagtagagacagggtttcaccatattggccaggttggtcttgaactcctgacctcgtgatccacccgccttggcttcccaaagtgttgggattacaggcgtgagccaccgcacccagccagattacaactttcctttgtgcaactaaaaatgtatggatggttcttgacttaggagggttcaagtcaggatttttcaactttacagtggtgtgaaagcaatatgcaatcagtaggaactgtattttgaatacccatacagtcactctgtttctcattttcagtacagtattaagtaaattacacgagatagtcaaccactttattataaaataggctttgtgttagatcatttgttcagctgtaggctaatgtatgtgttctgagcatgtttaaggtaggctaggctaggcaatgaagtttggtaggttaggtgtattaagtgtactttttacttaatattttcaacttatgatgggattagtggggcataaccccattcattgtaagttgaggcacatctttactaactccttctgcggaagaggatgcaaaatctttgggtgatgttcactcctgtccttgatagcctgtgacttaaatattataatgtaaagttaacaatacttaaatagtgtaatgtaaagtcagtacagcttgctataagaggatgagagagggaagaaaaagatatttgcttaatgtgtgtatatatatatatgaatgtgtttatgcaaacatattcataacaaatcatatagaaaccttgatttaggaatcagtcttgcaattttgaaaatagttacttttctgattcttgagtagaatgcgtcatatattcccctatgaggattcttaggtattgcttaccagtcatctagcatttacagcttagtgcagctttcttcacaattcatcttgttgactgctacccttcatgaaataagaactttgtttctttctgacaaatgaccctgagaagaaaattaactgctaatactggggatgagttatggtgggaaatggaaacattctaataaagcaagaaggtagtgggaaactggaaagttttaataaaacaagaaagaaattttaaataagtttaagagtcagctgttgaatttggcagtggctggatttatacaggaccactctatttactcactcaataagtattgcagagcatttacagtacaccagcccttagtgatagagtaagacagacagggtcttgggcttacaaggaagttacagtatactggaggaacacagaaaaatatctgggagtgtaataagggctggggcatacgattgaaatatggtgctgtgatagagataaagtggctactttaggcttggaggtcttgaaaagccatcttttaaaacttaacatttaattttgataagaaagaatagccagctatgtgatgagcaaggaggggaagagcaataagctccttgtcttatttactagtaagatcactttctactgtgagctttttaatgatagacaaagaatttggcttcattatattattaataatcttacacgtttctatatgtaaagattgtcctacctttatgtaacttctggggaagtatgattaacttaataacttggccatgatatctgttatctttctttcctttgaattaagggtgataatttattatatgttctttttgtttgtgatcgcagggtggtgtcatcacttctgacatgattgaaatgatattttccaaaagcccagagcaacagctttcagcaacacagaaattcaggaagctgctttcaaaaggtgagctatgaatatgttcagtatattttttcatctctctacaaaattactttcccatagtctgtttttcataccacaggtaatttgtgttggagtatttttatcaataaaagaataaaaatacagacatatatgtaattgtgaaccatgcctaaattttaagtttcctatttatttgtgggatctcaccaggatcagaaaacagaattattttcatttttgggttattttataaaagactttatagtgaatagtagtcagtatcatgttaattcaaattgagagactgacttttttttatagagtgactttaaaaatactccttgaaagagttatgattgttgattttaatgttagcaatttaccactgaaagttaggaatgcatttactggtgggcagggtgattacctttttttttttttttaaagacggctctgttgccagtctggagtgcaggctgggcgcgatcttggctcactgcaacctccgactccctggttcaagcgattttcctgcctcagtctcccgagtagctgggattacagttacacgccaccacccccagctaatttttgtatttttttttttttttgagatggagtctcactctgtcgcccaggctggagtacagtggcgctatctcggctcactgcaagcgccgcctcccgggttcacgccattctcctgcctcagcctcccaagtagttgggactacaggcgctcgccaccgtgcccagctaattttttgtatttttagtagagacggtgtttcactgtgttagccaggatctcgatctcctgaccttgtgatcctcctgcctcggcctcccaaagtgctgggattacaggcgtgagccactgcgcccggccttttttgtatttttagtagagataggatttcaccatgttggccaggatgatctcgatatcctatcatgatccgtctgcctctgcctcccaaaatactgggattacaggcatgagccaccgcacccggctggtaagtactttttttgatataattagtgtagaatggaatctgatacttgttatcaacctgggcaagtaaaaagaattctgaacccgattataacgttggtagtaaatacttaaaccccccagtattaagttatggttgtttagagtcattagtgatttaaaaaaatttaatatatcccttgaggttaagtggaataaaaaactactactatgacaaaaaaatattgtcttttgcagaccgcttattaaaaatatttgaaggaaatgtacacttcctcaccccttttaaaaaagtcttatctctttcaacatgctaagcttaatggttttcttctgtaatgtgcttttttttttttttaagggctttcaccattctgctaccttcctgcatgtattctggtttgccagcatacctcttaaaaatgtgataactagaatccaatatttcagatgtgttgttattaatgtagggtatggtgagaggttaccttctttgccctaagagtgtctattttgataatgtagtccaaggtagctagttattttgatagtcatggcatagtaatattttattgaattttcagcaaactaaactccctagtgcttttgttcacgaactgttgttaggttttgtttgtgaagtcatgtagatttttaaaaattgccatttaaaaaacttagatgctgaactttgctttatttctgtttttttttgttgttgttgttgcctattctgacttattgttctttttctgtgttatttctgtaactcagcatattaactagtttattgtaatcatcaaatttgtttttttgtgcttacctgcgtggttaatataaatgttcaaccaggtaaatgacatgtcattagagtcctttccaaatgaacattgaaccattagtcacctctttcagtaaggccatcgacttgggtaagaatctccctagtagtattgtgatctaattgccatttttctggcattgccacacgcatattgtcagtaactttgtcagtctctggctgaagttattaatctgattgtctatgacatttccctcttatttgccttataagtttttattgagtgacatcatttataggatactgtattatcatgaatgaaagtgagactaagttggcaagtcaatcttcgtgaattcttgctagctcctacaggtacaaaattaaattctgcaggcctattgagaatcttgtaatgcaattccttaagatgatttacaacagacaagagcagttagacttaaaactcatgtacaggaaacaggctagaaggaagtataccagaacacttaacaatggtcttttgaggggttttttgccccctgctttttaggttttctaaaaagtggaggcagtaatttaatttttaagaatttttcccatcctttattctcatattgagacttgtcttcattgtgaaacatttcagactaccctgtcctcaaagtgataaacccaatttgacatttcatttgttttaggtagatttccagcatgagagatggtaaatggagggagggatgttaagaagttttgagctgttaagttcttgcattgaaatcaaaggattttttttttcttttattttatggggaaacagaacctaaccctcctattgatgaagttatcagcacaccaggagtagtggccaggtttgtggagttcctcaaacgaaaagagaattgtacactgcaggtgcgaataatttttatttattgcctcataacttaattccttttgaaaatttttattttgtacacaaatttgttactaatttttatctgtatgaagaattaagtttgtttataatgatattcctgacaactacattgcaagctgctttcatagctttgttaacatgtaggccttcgttatactctttattattattataatttttaatcatttaaaatgtttatgattgtggataatacttctctaatagggaaatgtttacagcagaggagccattacagccaggaacttatgtgtgggctacataaaatttggtgttgagggagttttagatgatacttggtggctttctcaggatggtgtaacatgggctagatcagagtcttattaattcccaaatctgttcctaattaattcttcctccaccccacaaaaagccgataaggagataactttgtcaggaatctgtgtacttattgctgtgtcaatttaggctttcagtactgtactatataagggattccaagaggaaattttgtaatctctggattcagaattttcttttttttttttttcttctttttcttgagacagagtcttgctctgtcgcccatgctggagtgcagtggcaagatctcagctcactgcaaattccatctcccagattcaagtgattctcctgcctcagcctcccatgaagctgggattacaggcagccaccaccatatccagctaattcttttatttttagtagagatgaggttttgccatgttggccaggctggtctcaaactcctgacctcaagtgatccacctgcttggcctcccaaagtgctgggattacaggtgtgagccactgctcccagccaagtattcaataattttcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggtttttagaaactgatgattttttagtaaacttccctggagtaaccaactgagtcagtgcctttattagttacaaatacatgtgatccctaaattctcacctgtaggatctaatctcaaaggcttgggccctgagactatgcagctataaaaattggttaggtaccaagttgatcacaaaatgggattatctttctaagtaaatatttgccaaaaactagttaatcaaagatatcccccaccccttgtgtgctgttctttactctaaggctggagccatgtagacactggggcatttttgttaagtgatagctcctgtccccaggttccttactgtctacaccattatagattattcatacaacttgatgatttgccttgatgttttctctcctttcctcctatcccttctttctctttgttttacactctttgttgcggtgatgagttccttccagaggaaaaacaagaaatccagaaaaggtagagtacttcaatgtcacatcagtttttcttctccagtttgacacttaccagttcccatgctcatttgaattaaggttctgttttgctagctgcctcctggattgtaattctggtccccatctaaggccaggatcatcagacacctgaaaaataatcacgttcaccctgagagcaagggaagagagacttttctcaggataaaaggaaatccagacaaccaacactgcagagaacagagcctgatcccctaagcaacctgccgagaaccagagggaccaaatgaggaaccttactgcagtttatcatttgaaatgctttgtaggaagagggaggtagggaaaattattttgttcatgctgaaaaaagtgtttctttcctgtctctgggaatgagagtagatgagagatactgaatttactccttgatctggcggtttttattaggtggtagttcttttatgcattaaatatagatggtatataacctttcagatctaaaatgaaaaaagtcggagaaatggatctttccccatctctgcattcccttgtactccttaaaaagtacaagtacattctccgacagtgccctcttctggctaagacattctacatctttttttaattcattactctgtaatcttggaacttgtattttaacacatctgaagatgaaagccttcagaaatctctaatttgcttctatgtaaactcccagattccacccttgtgcaaactaataattaggctgaaatattgcaaaatgattcctccggaagtgataacctcatgattttatgaggatagtcttagctgtcctaactctgagaaataaccaactgtttgttatctaagggccatctctagcttttttatgtgcacatttaaggacaccatggtgttctccctccactgtgactagtggggacctttgaccacctcagaagcaagggggcaaatatatcgagagagaccttaaagccaggagacttgatgatctaccatgctttcaaataattagacatgctctgggaagcttggaggttactccttcctctgccttcttggagagcagacagatgtaagctatccctgatactcttacctgcttactagaacttgaataatgcacctttggaatagggcttttgtcatttctcttccagaaggagagtcatgctatgtggtgccaagaggaaatttgatggctcagctcactaataaatcttgtggacaaacttaatttcttcattccatagataaagaactgtgaatcctattgaagggtctttttatgttctttctggcttcccaagtcagtaaggtacctcaaaccagggagataaaagtgcctgctttgagcattgctacccaggtgctgaaggtgaacatgggtggaatctaggattttggaagcagacaatggcttttagctaagcgcattctcaagctcagtgacatctaggtctcagatagacttgagcccttgtcatgagactggtctggtttatggcatggtctgtgagcctacttttttgcttctttgagtccaggcccagtatctttgtgctgtcctttgcaatgctgagatgtggcattcccaaactttcttatagaagtttataaaaatagctagaaataaatatattgccttctatttccaaatattagacagataatccttgaaaagttgtaaatttgaattacattggcttagtttccccttttctgcctttcttgtcccctctaaaagcttaatgtgataaactgcagtaagccttcatcctcctgtgtcttttcccatcttcattgatctctctgcctttcctggaaagttgctcagatgactcaggcactgttctctgcagagtttgctatctgggtttatttttctgatgtgagcctttcttttcacttgctctccaggtgagcctggcatttgctaggaaccagagtggaaccggcaaagtggccagcaacagagtcctgatccaaatggagaaagggaaccaggcgtacctcaacctggagtgggaaacttgataggaggtcagaagtacttcagctttggattctcattttccttatttaaggaactgagcgccagaaggtagagactaagaaagggaagagagaaaacatcaaaccttcagtgtgcagatttcaggtgtagccttatttagtgagttcaggacagtgaaaaataatgagtggaattacagtttataagtagttccagctgcatgatagcttgtttccttgtatgatgccattcttggatattaagaatatagtagtttaaaacaacaaaagaagtgaagattttatttggccaccatttgttacttcaggcaataccatttcttagatttttttttttcccaggttaatgatttcctggtaacagggttgcttactttaattaatttttttggctgtttctatcataactttatgcatatgtgtttgccatcaattctaggctttcccatttcacaactatttcatgttaaattctaatctagtacccaaggctgaaacatttagaaaaaacaaaaaaatagatggcaaatctcagtggaatacagctttaaagtacagactatgatgaaagggaagttatgtagtttaaagtacatctaattttttaaaaacataaatacgtttaacagttacttcttctaacattaacagaggcctatactcagggaaattctgttttttactccctcctctcatacatatgtggatacctgcataaacatacatacatatcacacatgtatagatgggtgtagaaaatttcacaaatacagcttgattagctttcacaaagtgaaaacagcaaagtaatcagcaccctgtgtgtgtgtgttttattgccttattaatgcatgaatatggttgtattttcagtggtcctcttgttacagttacccatctacttctatccccaataatagcaaaactgtttttgattttcattcctgaattgcattgagaggttatcatcattgtgtactacttagtgataagcataactggcatgttattcttttgctaagatgtaataatttcttttttttaccatctgtattcaggctgttattcacttacttttcattttcttagtcattgtcacttgaattgttttgcttctctattttattaacttgtgtagcttctggaattctccctcatttcccctgagatctttggtgctaaactcaaaatagcagtttgaacgctggcaccaattagaattctaagtaattttttctcaccaataactctgtactatatccctgtatacccaggttattattataatttcttttgcatccaaatctcactgtaatctttttcttgtatacagatggtatgtattctgatcttattttttttccagattgcttttccttagagttttcatttatttgactttatgtttgcagtatctgatgactgtttattgaactttgagcctgccttgtggtgggacagtttgcttttatacttacatcatatgactctggtttacaaattaattttcctagtaagcaaaagaaactacatcttaggtgaacttgttttttcttttttagtataaataatctggcatactgttatttaaaatttcttgaactagatatccaaactacaagcaaatgaaatatttctgggtcagcattatgtttcaggaaactatgactgggcttcgtaatgtattagattaggaggctgtaacttagtccttgtctttgactgtgtaacattactcgagtcattagtcaaattgttggattttttttcagatagtttcctcatttgtacacaagaaaagccagatactttacatctctgggttgttgtagggatcatctgcgagtatgtgaatagtactttgaaaatataaagtggccgggtgcggtggctcatgcttgtaatcccagcactttgggaggcctagatgggaggatgacttgagatcaggagttcaaggccagcctgacaaacatgatgaaacctcgtctctactaaaaatataaaaattagccgggcgtggtggcacatgcctgtaatcccagctacttgggaggctgaggcaggagaatcacttgaatccgggaggtggaggttgcagtgagctgagaacgtgacattgcactccagcctgggcaacaagactgagactctgtctcaaaaaagaaaaaaaagaaaatataaagtacggtacaaatgtcaagttttaattcagacgtactgaaagggactgagtgttgctttcattagtaatttaatcatagagataaatatgggaagaatttttatttcatgatatctggggtttaatctgtaagtccccagaatttttgttataacaaaaagggaccagatacgggctctttaaccgaagtactcctactctgggcctccctgctgctactaaaccaccttacctcactcatgtatgtcacttttatagttttctttggaacatccattggttatgtgtcttctgctatgaattttctatcactaacatggctttgaacgtgatttgatcagatggcccattttcctgtcttcctctattcccaaagattaatgaatttagttttctacctgacagctaccttttagttaatctggaagcttagaagaatcacaggtcatttgatgacgacttgttattttctctgatttaaaggacatgccatggaatttttctttttttctgtgtatgtgctttattaaatagaagacagaatggtggaagaaacaacctgaaatgtaattaagaactcttaactaaatagaaaagagttcattattggatttctcaatattaagctaaagagtcaagttagtgttagagatatattttagtaatatgctctattttttgttggccataatttcctttatatcttctgtttaccagtgctgtaatgctatatatcaacctttagtcagtttaccttcatttttccctccctattaagaatgcccaaaaagtcctatctctgtattttggtttggagctctctcatttattggaagctcttattctttgaagttgtcatttcttttcattatgtgctgttaactcctttcacctacttatcatttgataccttttgcctttttcactgtgcctgtattttatgtttcacactaacattctccccccattttactttgcccattctacagaagtttttaaatcttttttattagataacatacatggtacaggctaaaaggcacataaagctttccagtgaaaagtatctttttcatccttattccctagttaccatcacctttctatgcaggcaacaagtatttagtttcctctaactcattctgaagataatctgtgcaataagtaaattaatgcatatattcctttttaacgcttttagaaaatatggtataatgccatattaatgtacactgtttgcattttgttttcatttatatcttgggagatcataccatatcagcatatgtaacactctctcattctttttatggtgtcatgtttactctttcttgaactgaaattttagacaccctgaatattcttctaggttgaggtatttcttctggatattcttcttttaaaattaatatagtactcaactgataggttatgtgcaaataatgatctcagaatctttttttcatgtacagaaaatgttactgttataagtaaacaaacttttacattctaaaaagataatgaaaattatttttatctttatagtttgaatcagcttgggtactgacaaatattgcttcaggaaattctcttcagacccgaattgtgattcaggcaggagctgtgcccatcttcatagagttgctcagctcagagtttgaagatgtccaggaacaggtaaaaatgaaacaaaaagaagcaggtgaaagaaagtttttggctgggcatgtcgctcactcctgtaatcccaacattttgggaggccaaggtgggtggatcacgaggagttcgagaccagcctagccaacatggtgaaatcccgtctctactaaaaatacaaaaattagccgggcatggtggtacgtgtctgtaatcccagctacttgggaggctgaggcaggagaattgcttgaacccgagaggtggaggttacagtgagccgagatcgcgtcattgcactccagcctgggtgacgagagcaagactttgtctcaaaaaaaacaaaacaaacaaaaaaagaaaaacaaaaaaaaccacaaaatttcccaacataataaggggctgagtttcaccagttggctttggtaatctatggattgtcacaaaggagtgttctagaaatttagtcttaaccaaatagaaaatttcttagtgactgtaggcagaatttctcttagacacataaaataatcttccccttccaaacctgacattctttaagccctgtatatgtacttttttagaccatgtaagcagttactgatagaggttttttcttgtagaaatttcaagtgttgaaagtaggccaggtgctgtggttcctgcctgtaattccagcacttgggaggctgaagtgggcagcttgcttgagcccaggagctcgagaccagccagggcaacatggcgaaacccagtctctacagaaaataaagtaggtgggcatggtggcacacgcctgttgtcccagctgcttgagaggctgaggtgggagggttcacttgagctccaggaggctgaggctgcagtgagccgatatcacaccaccgcactccagcctcggtaacagagtgagacctatctcaaaaaaaaagaaagtggctagtctttgccacttttgtgcagaaaagtacagaaagcaagtttctttttgttcactgttttcttatgtaagcaagaaaatactctctttctgtctctttttttctttctgtctttctctctttctgtctctccatctttccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattaaatcaatcacctccgaatcacagtctctctcaccatccatccttccctcattatcttgcttcatccatccatcaatccatccctctctcatccatccctcctttccctccctcccttccttccttccttccttcattccttccttccttccctccttccctccatccctccctccctccttccctccttccctccttccctccttccctccttccctccttccgtctgtccctgtcaccacaggctggagtgcattggctcaatctcggctcactgcaaccttggcctgtcaggttcaagcagttctcatgcctcagcctctcaagcagctgggattacaggcgcctgccaccacacccggctaattttgtatttttagtagagatggagtttcactgtgttgcactccatactgggtgacagagcgagattctgtatcaaaaaacaaaaacaaacaaaaatgaattagttctttcctttaataaaccgaataccttctgtttgttgtacactttaggatattatttatcttcctcccccaatcctacaactgtttcatttgactccctgatgaacgtgttattgtgatatactggcatctgaaagaattatgagggaattaaactatgtaacctttattaatgaatgattctttcacaggcagtctgggctcttggcaacattgctggagatagtaccatgtgcagggactatgtcttagactgcaatatccttccccctcttttgcagtaagtttcttcttccttcttcctttttttttctttttgagaataaaaatgtaagagattcctcagaaagcattacatgtttggaaatcattttggattttctagtgttatttttaattccagatattttcttgtttagatcatttcctcaagcaccctatctttttccatgccaaaattctgaattctgaattacttgcatcagaattaatgaagttttaatgttctggagaaaagctatctgaagacatctctttatcaaaagtattattatttagtatttatgtcatcagataatcactgtctgttacatagtttaccattgtaccatcgtgcttttaggttattttcaaagcaaaaccgcctgaccatgacccggaatgcagtatgggctttgtctaatctctgtagagggaaaagtccacctccagaatttgcaaaggtaaggactatgcttttgggacattggcagaaaaaatacaattaaaagagtattgcaaccaatggtaaggtgaacaggaagataatttttgttaaaatttaaaatgttagaattttatctgtttttggagaaacagggttgttgttgtttttgttggttctctttattatttaaaaagcaaatttagagcatagcttgaaggtgcacatttacgatgggactgcaaataaagcatagcatgaaggaagaatttgtaaagcttattgaaattaggcttcatacaattagtatactgtttaggagactatcctttcagttctcttaaaacagtggttctcaaagtgtggtctgtgagttctctgggagtccatgagattctttttttttttccaataggtttttggggaacaggtggtgtttaggtacatgagttacttgtttagtggtgatttctgagattttggtgcacccaacacccaagcagtgtacgctgtacccagtgtgtagtcctttatctctcacccacctccgaccctttctccctgagtccccaaagtacattgtatcattcttacgcttttgcgtcctcatagcttagctcccacttatgaatgagaacatctgatgtttggttttccagtcctgagtgactttatctacttgttgattgatgggcatttgggctggttccatgtgtttgcaattgtgaattgtgctgctataaacctgcgtatacaagtatctttttcttataatgacctcttttcctctgggtagatacccaggaatgggactggtgcatcaaatggtagatatacttttagttctttaaggaatctccacactgttttccatagtggttatactggtttacattcccagcaacagtgtaaaagtgttcccttttcaccacattcatgccaacatctattttttgttttttggttttttgagacggagttttgctcttgttgcccaggctgaagtgcagtggcgcggtctcggcacactgcaacctctgcctcctaggttcaagtgattctcctgcctcagcctcccgagtagctgggattacaggcgcataccaccacacccggctaatttttgtatttttagtagagacggggtttcaccatgttggccaggttggtcttgaactccagacctcaggtgatccacccacctcagcctcccaaagtgctgggattacaggcgtgagccaccacgcccagctgcattttttaatatgtttgttggctatttgtatatcttcttttgagaattgtctgttcatgtccttagcccactttttgatgggatttttttttcttgctgatttgaatttcttgcagattctggatattaaaataaatgggtatttttgtagttgtttttaatttggaatcatttttcactgaacaaaaccttagcatttttggtctttaacaaagtatctaaaatacagaatttcctagttttcacatttgtgaaagttcctttacctgtttagtccacaaagaatgtgttttgatagggagtcttactccaagaattgatgtatataaaactttgctctctgaaattattttccttgggctttgactacagattagtgcaagatcactgacaacattgccaaagatggaaatgccacttaggtacttgctgcttcatctttagaagtgtaaatcaccctagaagtcaccaagtacatgcctggttgccttcttgagtatctcacctcacttctggcttttagtctattgaatttcataatcatcattttccttttacaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgtaagatatcttttagaaagtgtgtccactttctctcccttggtactagttttctagctgctaatacttaaatattaatggattgtacatgataattgatttattgtgctttgggctactgtttttgttacttgtttattttgatgtcagatctgtttgtcttgttttattgaggcttatagagaacctcttagtcctctgctgttagcaggcctttagcagaaacattgggaaaactctgatatgtgtagttccaggctcatactggatggcctgagatcaaccaccggacatcagaaggcatactgccactaaaatagtcattccttatctgtctgtctcatttagagcttattttagacaagtatcagaaattcaatcttattttgctttatcatctccgtgatgcttttgataatggagtggaagatttactcgtgacataaataatttgagactgtattaatcaaatttttagatactacagaagaaaaaaatgaaagtgataacataatggagaaatggtacagttacaaggtatgggagatttaaagtacaaagtagatgcaaagagacattgtcgcaaacatgacatttggaatatattagatagttataatgtattaatacaaaatagaaaactctgggattatagcaggctacagactggatgcagatcagtaatgtagtgctaatgtgaattaatggcagtatgatgctgcaggagtctgaagtacatcattcaaaatctgggaagtaatcctttgtattctttagtcactagactactatatattttagccatttcttttttttttttcttttttaaaaattatactttaagtcctagggtaaatgtacacaacatgcaggtttgttacataggtatacatgtgccatgttgatttgctgcaccaattaactcgtcatttacattaggtatttctcttaatgctatccctccccctgcccccaactccacgacaggccccagtgtgtgatgttccccgccctgtgtccaagtgttctcattgttcaattcccacctgtgagtgagaacatgcagtgtttggttttctgtccttgtgatagtttactcagaatgatcgtttccagcttcatccacgtccctgcaaaggatatgaactcatccttttttatggctgcatagtattccgtggtgtatatgtaccacattttcttaatccagtctatcactgatggacatttgggttggttccaagtctttgctattgtgaatagtgccgcaataaacatggatgtgtctttgtagtagcatgatttataatcctctgggtatatacccagtagtgggatggctgggtcaaatggtatttctagttctagatccttgaggaatcgccacactgtcttccacaatggttgaactaatttacactctcaccaacaatgtaagagtgttcctatttctccacatcctctccagcatctcttgtttcctgactttttaatgatgacgggagataggatctcattgtgggtttgatttgcatttctctgatgaccagtgatgatgagcattttttcatgtgtctgttggctgcataaaagtcttcttttgagaagtgtctgttcatatcctttgcccactttttgaggggttttttttttcttgtaaattagtttaagtactttgtagattctggatattagccctttgtcataggaatgcttgtgatttttgcacattgattttgtatcctgagactttgctgaagttgcttatcagctcaaggagatttggggctgagacgatggagttttctaaatatagaatcatgtcatctgcaaacagggacagtttgacttcctcttttcctaattgaataccctttatttctttctcttacctgattgccctggccagaacttccagtgctgtgttgaatacgagtgctgagagagggcatccttgtcttgtgctggttttcaaagggaatgcttccagtttttgcccattcagtatgatattggctgtgggttagtcataaatagctcttattattttgagatatggtccatcaatacctagtttattgagagtttttagcatgaagggctgttgaattttgtcaaaggccttttctgcatctgttgagataatcatgtagtttttgtcgttggttctgtttatgtgatggattacatttattgatttgcatatgttgaaccagccttgcatcccagggatgaagccgacttgatcgtggtggataagctttttgacatgctgctggattcggtttgccagtattttattgaggattttcacatcaatgttcatcagggatattggtctaaaattttcttttttgttgttgtgtctttgccaggctttggtatcaggatgatgctggcctcataaaatgagttaggtaggattccctctttttctgttgattggaatagtttcagaaggaatggtaccagctcctctttgtacctctggtagaacttggctgtgaatccatctggtcctgggctttttttggttggtaggctattaattactgcctcaatttcagagcctgttatttgtctattcaaggattcaacttcttcctggtttagtcttgggagggtgtatgtgtccaggaatgtatccatttcttctagattttctagtttatttgtgtagaggtgttgatagtattctctgatggtagtttgtatttctgtgggatcggtggtgatatcccctttatcattttttattgcatctatttgattcttttctcttttctttattactcttgctagcggactatcaattttgttgatcttttcaaaacaccagctcctggattcatttatttttttgaagggttttttgtgtctgtatctctttcagttctgcatctgatcttaattatttcttgccttctgctaacttttgaattggttggctcttgcttctctagttcttttaatggtgatgtggggtgttgattttagatctttcctgctttctcttgagggcattaagagctataaattgccctctacacactgctctaaatgtgtcccagagattctagtatgttgtgtctttgttttcattggtttcaaagaacatctttatatctgccttcatttcgttatttacccagtagtcattcaggatcaggttgttcagtttccatgtagttgtgcggttttgagtgagtttcttaatcctgagttctaatttgattgcactctggtctgaaagacagtttgttgtgatttctgttcttttacatttgctgagcagtgttttacttccaattatgtggtcagttttagaataagtacaatgtggtgctgagaagagtgtatattttgttgatttggggtggagagttctgtagatgtttattaggtccacttggtgcagagctgagttcaagtcctggatatccttgttaaccttctgtcgtgttgatctgtctaatattgacagtggggtgttaaagtctcccattattattgcgtgggagtgtaagtctctttgtaggtctccaaggacttggtttatgaatctgggtgctcctgtattgggtgcatatatatttaggatagttagctcttcttgttgaattgatccctttaccattatgtaatggctttctttgtctcttttgatctttgttggtttaaagtttgttttatcagagactaggattgcaacccctgctttttttttgctttccatgtgctttgtacatcttcctccatccctttattttgagcctatgtgtgtctctgcacgtgagatgggtctcctgaatatagcacactgatgggtcttgactctttatccaatttgccagtctgtgtcttttaattggggcatttaacccatttacaattaaggttattattgttatgtgtgaatttcattttatcattatgatgttagctggttaatttgcccgttaactgatgcagtttcttcccagcattgatggtctttacaatttggcatgtttttgcagtggctggtaccggttgttcctttccatgtttagtgcttccttcaggagctcttgcaaggcaggcctggtggtgacaaactctgtcagcatttgcttgtctgtaaaggattttatttctccttcacttatgaagcttagtttggctggatatgacattcttggttgaaaactcttttgaaaactcttctttttactcttttttctctaatcttgtcttcacactttatttcattaatttgatcttcagtcactgatatcctttcttccacttgattgaatcggctattgaagcttgtgcatacgtcacgaagttcttgtgccatggttttcagctccatcaggtcttttaagctcttctctacactgtttattctagttagccgttggtctaacctttgttcaaggtttttagcttccttgcaatgggttagaacatgctcctttagcccagagaagttagttattaccgaccttctgaagcctacttctgtcaactcgtcaaagttattctccgtccagctttgttctgttgctggcgagaagctgcgatcttttggaggaaaacaggcgctctggtttttagaattttcagcttttctgctctggtttctccccatctttgtggttttatctacctttggtcttcgatattggtgacctacagatgaggttttggtgtgggtgtcctttttgttgatgttgatgctattcctttctgcttattcgttttccttctaacagtcagttccctcagctgcaggtctgttggagtttgctggaggtccactccagaccctgttttcctggattaccagcagaggccacagaacagcaaatattgcagaacagcaaatattgctgcctgatattttctctggaagcttcgtcccagaggggcacccgcctgtatgaggtgtctctcggcccctacttggaggtgtctcccagttaggcaggaagtcagggaccctgaatggaaggaccggctgaagccatggcagaaggacataaattgtaaagatttcatggacatttattagttccccaaattaatacttttataatttcttacgcgtgtctactgcagtctctgaacataaatcgtgaagatttcatggacatttatcacttccccagtcaatactcttataatttcctatgcctgtctttaatctcttaatcctgtcatcttcataagctgaggatgtatgttgcctcagggtcctgtgatgattgcattatgtgtacaaattgtttgtgaaaggtgtgtttgaacagtatgaaatctgggcattctaaaagaacaagataacagtgattttcagggaacaagggagataaccataaggtctgactgcctgcggggctgggcagaacagaatcatgatttctcttcttgcaaaagcgaataggagaaatagcgctcagttctttttctcagcaaggaacagccctgggaaaagaatgcattcccagggggcggcctctaaaatggccgctctgggagtgtctgtcttttgcagttgaagataaggcataaaatacgccctggtctccttcagtgccctcaggcttgctaggattaggaaattccagcctggcgaattctagtcagaccggttttctgctctagaaaacactgtttcttgttaagatgtttatcagtgacaatgggtgtacagtgggacatgaaacctcatcagcagttctaatctcaccctggccttgtgatcttgctctgcccccattttccttgtgatattttattgccttttgaagcatgtgatctctgtgacccacaccctattcgtacactccctcccctttgaaaatcgctaataaaatattgctggttttgtggcttgggagcatcacggaacctgccgacatgtgatgtcacccccggagactcaggtgtaaaatttctctcttttgtactctttctctttatttcttagactggccaacacttagagaaaatagaaaagaacctacattgaaatattgggggctggttcccccaataggctacacggggttcagggacccacttgaggaggtagtctgtccattctcagagctcaaacaccatgctgggagaaccactgctctcttcagagctgtcagacagggacgtttacatctgtagaagttgtctgctgccttttgttcagcctatgccctgcccccagaggtggagtgtatagagatagtaggccttgctgaggtgcggtgggatccacccatttcgagctttctggctgctttgtttacctactcaagccccagcaatggcagacgcccctccccccgccaggctgcagccttgcaggtcgatctccagctgctgcgctagcagtgagcaaggctgcatgggcatgggacccgctgagccaggcatgggagagcaatctcctcgtctgccatttgctaagactgtgggaaaagcacagtgtttgggcggggtgtactgattttccatgtacagtctgtcacagcttcccttggctaggaaaggaaaatcccccgacccattgtgcttcctgggtgaggcgacgccctgtcatgcttcaccttgccctccgtgggctgcacccactgtccaaccagtcccagtgagatgaatcaggtacctcagttggtgatgcagaaatcacccgtcttctgcgtcgatcactctgggagctgcagaccagagctgttcctattcagctatcttggaacggaacccagccatttctttttaatcatcacatgttaaatttgaaggaactggcttagtttttagaagagtgatcggtctcattaaagtggagggaaaaataggacccttaaggaaaatcaaaagatagtgacttaatttagctagaaataaggacttaatatctgtcttcaaatatatatatatggctttgtggagtggtttttggaccagtaaggcagcttatttagtaagtttagttgaaagacctttgtatttagagtgtgactcctgacttgcattttcaagttagttcagctgttgatgtgtcacttttacgtctgaaaattaagacaatttataaaacttaaaaatgttgcgtaaatgttaattattgctctcaattatctcagcaaccatacaaaagccagtaaagaggaaatgaaacctatactaaagaatgagagggaaaagttggaatccaggtgatggaatacctgggaaagattcctaggaaagattggtagttttttccaaatgtactaaaataaggggaaagacagttctagggaacaccagacattccatcatcatgataagcgttcccttaattagccccatgggtacatttctgctctaaaattctatcacaatttttttgttttttaattttggtcttggaaggaaatgaaactaaggatagaactgtttgctataacattactttttgtttttgcaggcataatgattataaagtggtttctcctgctttgcgagctgtgggaaacattgtcacaggggatgatattcagacacaggtatgaagaagtggtaacttttttttgtcctttaaaaacagtatattgaacttcatgatcatgtttctattatcgtattttactccatattattagggaaacttgatactctgttacactaatgtttaaaaatgttgggccgggggcggtcactcacgcctgtaatcccagcactttgggagactgaggcggacggattgcctgagctcaggagttcgacaccagcctgggcaacatggtgaaacctcatctctactaaaaatacaaaaaattagccgggcgtggttgcacacgcctgtagttccagctacttggaggctgaggtagaagaatcgcttgaacccaggaggtagaggttgcagtgagccgagatcgcaccactgcactccagcctgggcaacagagtgagactccagctcaaagaaaaaaaaaaaagttggtttaggcatctactctcaatacctttagtatctctgacttgacctgttgcttgtagtagtttggggttgtcctatgatagtgactattttttggtcaggcagatttgtttttcttcactcctatttgaaatagttctcatgggcatcagaatcctctagtagcatcttttctctgtctttttcatctcaatatcaccttctctgatagctttctccttttgtacatggtaagtcccctgtgtgaggaagattcttccctcctactttctaatgtcaccatctactctattcaacttctgtatcaagacacaccattcacagtgcattgttctagccatatttcttcctgaaatctcagctgtgttgtgatgttgaagtcttttagttcttctgcctcatcgaccatttatttctccctagcaagctccttttcctcttgtctccttttgtggacatcttccacggggcaatccttctgcctcattcatagatcttatttataatgtcagtgattacccttgtgtgcatggattcagaattgggaattgggttttagccttagcgttttcttcaccagttctgactttcagcaatacatttaatgccttttctaatctctaaaattaaggagattagatttgttctctcaggtgtcttctaactgtaatgtatttactttaaatatattctgtacacaagggaactcatttccccttgcattacctgaacctctgcttatgttccctgtatcagtgaatggcaccatcagttcccctgaaacctggacatcagcttgattctttcctctcctccaactccatcatcagttactaagtcctgttgttctgtctctattcatcctttgcagggcttagttcagacacttcagaagagaataggagaagaaaagaatatatgtttgactatatttgcataaaatttctctggaaggatatacagggaactgaaaatgttggttgtctttgaggggaactggttggctgggatacaagaaggggaaagaggcttttaacaactatggagtcttttataccctctgaatttttgaaccctatcagtatctttctgtccctcacccacctccatatgctatatgcttttgccatatttgttccttgaattggctgtggccactctcagctcagagttttaacgcatgctttattccctctgcctggaacatgtgtctccactgctaccccttgctctgactgccacctcacacatatccacattctctgctcctaatgttttcttgttcttcaagtcttggtattaacattattttctctgagaagccctgtttgaccctaaactcttaagttaggtacttatttttttttctttatccatcagaatattaatcacattgtattgtaactaattactagattttaagattctagaggtggattatgtcagtgtttatttctgtgcctctgtaaatctaataatttctggcacaatatatagggacttaaagaatatttattgaatgcaatgaagttctgaatctctacatctacttctgacctatctcaagtttcagtcctatatctgcagtagtttcttacatatttctgcttgcatatctcacgtttgtctcacagtatatcttctttcccccacaaggcaagttccaagtttttatttttcctatttcaggtaatgatataactattctctttacctacacatgaaactttgcagttacatgtggtgtctccctcccttatagtttgtatagcaagttgctgggtcttcttgattgttattgttactagatccccatcaaattacgtacttttggtccttgtcacacacacaggttgttgctgtacccatccatcctccgactgtcctaagcagttactcttctcaatttattccccctaataacagctgaatctttcctaaagtaatgttatttgcattatcttcctctagaaataataagctgctttagtgcctgtaagataaagaaacttgaaagattcaaaggaatttctccttaagattttagtctcattcttctttctagcctattatttttggggcatagaactcttttgtaatagcctcatcatggccaggtatgctggctcatgcttgtattcctagctttttgagaggctgaggtgagagaattgcctgagcccaggagttccaaaccagcccatgcaatatagcaagaccccatctctaaaaacatttttttttaattagctgagcatgatggaatgtaactgtagtcctacctactctactcaggaggctgaggcaggaggattgcttgcacccaggagtttgaggttgcagtgagctatgatcatgccaccacactccagccttagtgatagaacgagactatgtttcttaaaataaaatagcctcagtagtctgttcttacagtactttgtaatagcttgtctctgcattttttcatttctagcttatgtgcagtgtcagtccctctttttgctaatgaaatcctattgcctatttaataggcataaaagacttcattttaatttgcatttctttcattacttaggagataattttctattaaaattttagtttctcttttcagtttacacatagcaaccctctcatttgttgcaaatatttttcacagtggatggtgtacatttaaaatctgttacgatttttgacatgaaaacatgtttcatgaaatttttattttcccctataatttctttatttttatgctcatacatacagtcttttaccatccccaagtcagctattttctaatattctgctttatgatttcttttaaaaatatttactcttaagtagttgcaaatttattttggtgacttagggtttatattagtctgttatttcattgctataaagaaatacctggccgagcgtggtggctcctgcctgtaatcccagcactttgggaggctgaggtaggtggatcacatgaggtcgggagttcaagaccagcctgaccaacatggagaaaccctgtctctactaaaaatacaaaattagccgggcgtggtggcgcatgcctgtaatcccagctactcaggaggctgaggcaggagaattacttgaacccaggaggcggaggttgcggtgagcagagattgtgccattgcgctccagcctgggcaacaggagcgaaactctgtctcaaaaaaaaaaaaacaaaaaagaaataccgaagactgagtagtttataaagaaaagaggtttaattggctcatgtttttgtaggccatacaggacgcatatagtagcttctgcttctggggaggtctcaggaaacttaaaagttatggtggaaggtgaagagaaagcaggcttgtcttatgtgacgtgagcaggagcaaagagtaggagaaggtgctacatactagaacagaaccatggggatggcgctgaccattcttgaaggatccacccccatgatccagtcacctcctaccaggccccacctccaaccttggggattacaattcaacatgtgatttgggtggggacacagatccaaaccatatcagggttaagaaatgatattgaaaaaattgtctttaatctgtttagctttttattccagttctgtcatagccacaagtcattggaagaaaggattaacttattataaactttataaatagctgcatttgtttctagaatagatctctgttctctgtttagtgattaattcttaaatctgccatatactattttaatcaaacttatattattttagtttctagtagagtaggtctccttcttcatgtgtatttgtgttacctccttcacctttataaactgatagctgaggtcatatcttttttatctttgtatcctataaagcatctaatatacctcattaagtacgtattcgttcattgactaccaagtagtgtgttatcagaggacctacaaatctgagactcctgacttttctggccacttgatatatttacccattcagaagacttacgctattgggatgggaaggtgaatgagtaatgcttttgtaattacaatagtaacattattgtatcttattaagtacagtttagcagttgtgaatgtgtacaatgaaactgtactgatactcttagaaactaattcttattaacagtgaatacttttttttacctgtataaagttacttatttataaaatttcaaggggagatgttatgtctttcataaaatgtgttccttaagttaaacattgatatttagaacaatacaataagtaaaattttcaaactttttcttttaggtaattctgaattgctcagctctgcagagtttattgcatttgctgagtagcccaaaggaatctatcaaaaaggaagcatgttggacgatatctaatattacagctggaaatagggcacagatccaggtaacctcataggacctaacttctctttcagtatttttattgaaaagtaaggtttttttctcagtcaccctttaaaacacatttgtttttggctgggtgcggtggctcctgcctgtaatcccagcactctgggaggctgaggcccgtggatcacttgcggtcaggagttcaagactatcctggtcaacatgctgaaaccttgtctctactaaaaatacaaaaaaattagccagtcgcagtggcaggtgcctgtagtcccagctacgcgggaggctgagggaggagaattacttgaaccgtggaggtagaggttgtagtgagccgagattgtgccactgtactccatcctgggtgacagagcaagactccatctcaaaacaaaataaaacgtatatcgttttcattattgctttgaagaccactttcaatgttgttgtcttatttcatagtcagctttttactttatcctagcttatagatgttaagtcttttgaaatttacacttaagccttcattttttctgttgccgttaatatttgatgtttcaccaagacccaagaaatagttatcaggggaaccacctccagtgtttcatgtaggttcttttctgttttccctaagtgtcggccggtctgagaaataaagggaaagagtacaagagaaattttaaagctggctgtctgggggagacatcacatatcggcacgttccgtgatgccccccaagctgcaaaaccagcaggtttttattagtgattttcaaaggggagggagtgtacgaataggttgtgggtcacagagatcacatacttcacaaggcaataaaatatcacaaggcaaatggcagagcacggggcgaaattaaaattgctaatgaggtttcaggcatgcattgtcatcgataacatcttatcaggagacagggtttgagaacagacaaccagtctgactaaaatttactaggcgggaatttcctcgtcctaataggcctgggagcgctaagggagaccggggtttatttcatcccttatccacaaccatataagacagacagtcccagagtggccattttagagacctccccctaggaacgcattctctttctcatgactgttccttgctgagaaaaagaattcagtaatatttctcctattcacttttgtaagaagagaaataatagctctgttccgcctagctctcaggcagtcagacctgatggttatctcccttgttccctgaacatcgctgttatcctcttcttttttcaaggtgcccagatttcatattgtttaaacacacatgctttatgatgcaatcatcacagggtcctgaggcgacatacatcctcagcttaatgaagatgacgggattaagagattaaagtaaagataggcataggaaattataagagtattgattggggaggtgataaatgtccatgaaatcttcacagtttatgttcagagactgcagtaaagacaggtgtaagaaatgataaaagtattaatttgggggaactaataaatgtccatgaaatcttcacaatttatgtccttctgccaggcttcatggtccctccattcagggtccctgacttcttgcaacaaataatgtcttgtattttcaaaatgttttgatgggctttatgctgagcacgattggctttaacgctttccaagtaagatatttatttttccagtggacccatgtagattgcctcaaattttcatgaatttttggatacccatttttctttaaatagttacttggtttttacttttgtctttgtattggtgggagagtaactcaagtggacgacaagcagtgggccaaagtgttcagcctgggcaatgttcaaggatggaacagtgggtaggaaaagatataacacagacatagagggccttggagatgaatggaaacagagagatcatctaatccaaggttttcatttaccacaattttgtgtgtgtgtgtttgtgtgtgtgtattgaagcatccattacattgtatcccataaatatatacaattattatttgtcaataaaaaatttgaataaaaagatgaaacggctcatggaattaaaatgatttgctcaagagcacctctagtaaaatgacaggaccgggattaggtgtctttccagtaatcaactttgtcaaactttgttgacgtccttcacaggtataataagagtttttgaccaggaaagcattttgtccccaaaatgctgaattaggaactgagattaatagctataacaatctatagcattcatatgaggtgatttcatctgtatttgattgcctgtcaccaccaggcttttttatgcagaacttctcagtttcttaatgtaggaaatgatataaacccatgttaggtacttgagccaggaagaaacagggagaaagtaattttgggaaggctactttagtgttagtacatgaaggggattgagtaaaagtactccatccaactataagtcttattttggtaatctgggaggtggtggcttggagaatagcatggcaatgccaaaggaaaggaaaaagatggactcaggattttaaaaattgagaatgtaaattaatagcctttgtgaactagaggggtttaaaaggaaacttgatatagcgggcagatgatgtgtttgagatgactagcagacctaacgtaaactgctggctaccctgggctgatgctccagtgagaagtgaggactagagagttttcgcacatggaagttcacatgctatgagagaatggaatagcagaggagcagaaaattgagctcttaacaatttgttactgtgggcagaacaaaagaggaaagtgaaagagaaaagaactcagagaaaataggagattataagatcataaactccagggaagatgttttcagtgataccaagacagaataaggattagggataggctgggtgcggtggctcccacctgtaatccctgcactttgggaggccgaggtgggtggatcacctgaggtcaggagttcaaggccagcctggccaacatggtgaagccctgtctctactaaaagtacaaaaattagccgggtttggtggtgtgcacctgtagtcccagctacccgggaggctgaggcaggagaatcacttgaacccaggaggtggaagctgcagtgagctgagattgcaccactgcactccagcctgggcaacagagtgagactccatctcaaaaaagaaaaaaaaaggttagagataatgacataactcttttcaatttatttctgacaggagaaggggtgttaatagtcaaactagcttagaaattataattagtatcatgaatatttttataaatctcacagttttttccatttaagtttttctttaattttagactgtgatagatgccaacattttcccagccctcattagtattttacaaactgctgaatttcggacaagaaaagaagcagcttgggccatcacaaatgcaacttctggaggatcagctgaacagatcaagtaagtaccaatcaggcagcatattgtaagttaaagaaaaattattattgtgtctatcactttataacctcccacatattacctagagtaaaagattagctgcctttgaggggaaaagtaagtgagagacgatcttaccaaataagaatgtttagttccagtccttaggaaattgtccttggtgtcataattagatgtgtatttaattctttataactctcccatttctttttgctgaaaaacaatcctgggatataagaagtaggcatagtcgaggcttgaggcaatagaaatccttgcttcaacctactctggagctacttgtcagaaatatcttgggtaatataggttacttgtagaacttgagcccaagtttaataactcactcttgccctttttagtttagatgtcttaatagtagaattggatcagaattgaaagagtggtatgtctgagaatgaagtgccaaatttagtagaggcaggtatcttctaaagtactatggtattcttgttaaagggaggagctgtagcagctcaagacttaaatggctcccttggtagcagcttagtgattgactgattgagatggagtctctctgttgcccaggctggagtgcagtggcactgtcggctcactgcaacctccgcctcctgggttcaagcgattctcctgcctcagccttcctagtagctaggattacaggtgagtgccaccacacccagctaatttttgtatttttagtagaaacggagttttcccctgttggccaggctgatcttgaattccggagctccggcgatccacctgccttggcctcccagagtgctggaattacaggtgtgagccatcatgcccgacgagcagcttataagcttaatgagtggaagaaaacataaatatggatgggaatcagttcttcaaaggagcatcatataattaaatgcaaaattcaggacatctagtatttcagatagggaaaaaaagtaatgatgaagagaaaaatggagcctagcctagactcagccagtcttaactttatggggaatccaaaattaaggaaagatggtttcaaatgagtgctaaagcattaactccttactcatacgtaatatcagacaaacatagctactacttacattgttgctttgtggactgaatgtaggcattcatcagatgctagttttgagtgttctgtttggaattaaaaaataaaaatagtaacaaagtacagaaatttatcaggtagagaaaataagaaatatgtacctgaaagaataaaattacaaacagattaacatatgcagtagctattttggtgaagttcatcatgggcaggttatttcagggagacagaagcacatttgtcttgtaggttttttccaacctccaaaattctgattctagagtactatgattttaattatgctgtcaccagatggtaaaaataatgaagtactatagttatttgaataagctttatgttcaaattcacatttatagttattaattgtctctatattttatagcaaatatattttcttaattgaaataagccaggccgggtgcagcggctcatgtctgtaatcccaccactttgggaggccaaggcaggtggatcacaaggtcaggagttcgagaccagcctggccaacagggtgaaaccccgtgtctactaaaagtacaaaaattagccaggtgtggtggcgtgcacccgtaatcccagctacttgtggggctgagactggagaatcgcttgaacccgggaggcagaggttgcagtgagctgagatcatgccactgcactccagcctgggtgacagagtgagactccatttcaacaaaaaaaaaaaaagaagaagaagaaataaaccataaacatatatattttattatgccatctttcatgagaaagtattcaggagtattttgctctgttagagaagcgcagaattgctgctgtccctttttaaaattcagcatagctatttataataaaattaattaccaacctcctagcagtttcttcttccccacatgaagagttatcttgaaagaatgtcacaaaaatattacagtccaaattacaaaaaacaaactgactttatcacttataaaagacatctatctggcttctgctgcttcttgttgcagataccagatttggatgcaagaaacaattagaatattttaggaaatatcttggccgggtgtggtggctcatgtctgtaattccagcactttgggaggacaaggcaagcaaatcacttgaggtcaggagttcgagaccagcctagctaacatggagaaaccttgtctctacaaaaattagctgggcgtgttggtgttctcctgtagttccagctacttgggaggctgaggtgggaaaatggcttgaacccaggaggcagaggttggttgcagtgagacaagatcgtgccactgcactccaccctcggagacagagtgagagactctgtctcaaaagataaaaaagaatgttttaggaaacatctagaattttaggttgaatataatcaaatgttaatacatatataacacatgttcttaatgaaggataaggattattaactgaaattagagaaacattcatcaaagaagtgaaacttactatttgtatagagaattggcagttttggaggggagaatagcatgaggaaaagtgagagaatgcagtgtttttggaggtggcaggtcagtcttgctataggtcgttctttcacaaggatgattaagtaatcgactggtgaatactgggatgaaagcctcagtcttgggtattgggaagacttggcctgtctaagctcacgagtgacacaaagtaaggcctgtgtctaggttcattatttttctgtatggatgttcagttgttttagcactgttgaaaaggtggaatcctttctccatttaattgcctttgctattctgttaaagatcagttgactgtttttgtgcgggtgtgtttctgggctttctattctttttgtgtgggtctgtgcatgaatttgcagtttatctgagaaaccaaacacacaaacacacagtttatctgagaaaccacacacacacacacacacacagtttatttgagaaaccacacacacacacacacacacacacacactggtagtacagtataggaagtcctcacttaatgtcattgataggttccaggaaactttgactttaagagaaacattgtatatatcaaaaccaattttatcataggctaattaatataaatcagttgagttactacgtgatatttctggtcaaggaaacatccccaaccttcaaaatatagacccaaaaaccttctaatattaaacattgaaacagatgtcagctatacataaatgtaagaaagattaataaaaacaagtatgataatatccaatttttggtgaatccgtgaatgatggcagtagtagtggtggtgggttaaatcaaagaatacagatttacaaaacaaaagttatgagcatctcctaccatcctgccaccacacaattaaaaaagcaacaataacatataaaaaaggattcccagcactgaagaatttaatgaatgaaataaaaatacagttgagatattcagcagtggatcagatcaagcagaagaaagaattactaaacttaaaggataggtcttttgaaataactcagtcagacatacatgaatgaatgaatgaatgaaaaaaataattaaaaaagaaagcctaaatggcatctaggataccatcaggggaacaaacattcaagtattgtgaatgtctgggccctctattttgttccactggttttttgtttgttctttcaccaataccacactgtcttgattagattatagtaagttgataatgtcattcctccaactttgttcttcagtattgtattgactattctgggccttttgccttcccatataaactttagaatcagtttgttggtatctattaacatgctgggattttgtttgggagtatcacattgaatctatagatcaagttgggaagaattgccatcttaacaatattgagtcttgtccatgagcatggaatatttctccatttttttttttagatcatcagttttgtagttttcctcatatatatcctgttgtacatatttattagatttacacttttttgatgctgatgtaaatgagattctttttttttttttttttttttttgagacagagtttcgctctttcgcccaggctggagtgcagtggcacggtctcggctcctgcaacctccgcctcctgtgttcaagcaattctgcctcagcctcccaagtagctgggaatacaggtgcccgctgccatgtctggctaatttttgtatttttagtagaaacggagtttcaccatgtgggccaggctagtcttgaactcctgacctcaggtgatccacccgcgttggcctcccgaagagttgggattacaggcttgagccaccatgcctggcctgtttgctgagtttttatcatgaataggtattagattttgttaaatgcttttttgcatccgttgaaatgatcgtaagttgattacattgattcatttttttaaaatgacggatcagcctggcatatttggaataaatccacttggtatataattctttgtatacattcttggatttgatttgataatgttttgttgaggatttttgtattcatgttcatgagacatattagtctgtaattttcctttcttatgatgtctttatttaattttggtattggggaagtgctggcctcaaagattgagttaagaagtatccccactgtttgttttctggaagagatggtagaatactagtatcgttttgtccgtaaatgtttgccagaattcaccagtgtgaaaccctcatcctgatgttttctattctgggaagttattaatgattcaatttatttaatacatgtaagcctgttcacatcagtcatttctccatgactgagttttggtggtttgtgtctttcaagaaattgttcattttatcatctgaatgatcaaatgtgtgagcatagagttgtttgtagtattcctttattatccttttaatatccatgagatcaagtgatgattctctttcatgatattagtaattttgtcttttctccttttttcttgtttggctagagatttatttttatatatttttgaattcttcctcccccacacaaaaaagcaatatgtgagaaagaaatagattagcactagcagtaagtttcaaaatgaccttaccaaacattcacataatgcaactggattcattatccctgcctctctgtactcaacttgagaaaccagaatgataaaaaatgacatgactatttactgtgaatgtgatacagtaatcatgtctctgaagttcaagtatgattaatcttgattacatacggttatacattctgcttgaattaaaggaaaaataccagttctagaatcctctgacatttgtttattcttcccacaacttactttactaaaattctaatcatctttgaaagatttggcttatcaggcttgtgctggcttttagcaccaagagtgtcatgtttgagaggtgtggctatctatggaaacaaagatgaaattactcaaacctatactattttgatgagtcgctcatttcaaggtattaataagtaagtattcctgtttttggaatgcataaattgtgaagagaaaagaatggagaaaggtgccagagaactggtttgggataatttatttagagggttttttgtttttgttttgtgaaaaggtatagcttgtatggttgaaagagtgcttgttttttgtttttttttttaagtctctgcagtgaagttgaggatgacttgctcactaatttcataagtttaacaaaattaaaagttttgtttgactacattattctttgtatttaggtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtaagatgctttggttgaagaagtttatggccaagaatgaattgggtcatagatagagttcagtaaaaacaatactactactgctaggcactggatgaaaagaggactgttaggaaattgctgcttctgcagactggatattacttgcatatgtatttaagatgtcagtttataatactagctttcagatgtaatcccagcagtcatttctgtgctattataaaatacttatgagatacaaataatctttctttacatcaagaacagagatatatgacaaaatatagtttaggaatatatagttatggaatttccaatatttattgaagttttcaataaagattttcctttattcttcattttaggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtcta

SEQ ID NO: 14062 - DNA, 24645 bp, Human
  misc_feature (1)...(24645): n = A,T,C or G
tgggaagctaaagtgggaggattgattgagcccaggaagtcaaggctgcagtgagccccgccccaatcacaccactgcacttcagcctgggtgacagggagagagaccctgtcaaaaacaaaacaacaaccaacaacaacaacaaaaaccaccaaaaaaccaaactagtctttgagtcatggcagtttgtttcaatagctattgggtaaaactggtttcaggttacaacaggcagtttcagcagacagggttgcagagaattacattctttgagcaatgaaatgtgccctcagtgtttcccctcccaccattttcgttgggtatgagaagaatggcccaatctgtatgcttaactttcacaagtgtaatccagagtaagtcatgaaattgattttagtagtgctgaagtataattttctgaagagtaaaaccatgactctcttacaaatataaaaaaaaagtatcaaatattttatttatctcattaacttataagggagccagtaagatatttaggaatgtagcatgaatttgctaagaatcaggaatgtttaaatgaatttgctgagaagggtaaaaatggcttaatatgctacaggtcaataaaacaatgttttggtgtatcttttctacagacgggcaagaattattttaagtactaccagttttctggtgaaatactttagtcaatagaaagtcagagctccctatggatgcaaatccgtccagccttacactgaaagggcacacagaattctcttttcctcatttccaagtctttgacaatgtttgctgacaataggtccctgttagcagtttttggtaatgaagtagaaaagaagaaataaaaatttagtgcactgcgggtcgtaagtgtaaacatagttttgtgaagattttgtttcaggccaggcacagtggctcacacctcccagcactttgggaggccgaggcgggcggatcactcgagcccaggagttggagaccagcctggtcaacatggcgaaatcttgtctctactaaaaatacaaaaaattagcctggcggtggtggcacaggcctgtagtcccagctactcaggaggctgaggtgggaggactaccagagcccaggaagtcgaggctgcagtgagccgagatggcaccactgcactccagcctgggcgacaaagccaggccctgtctcataaaaagagaaagaaatacactttgggaggccgagtcgggcggatcacctgaggtggggagtttgagaccagcctgaccaacatggagaaactcagtctgtactaaaaatacaaaattagccgggcatggtggcgcatgcctgcaatcccagctacttgagaggctgaggcaggagaatcgcttgaacccaggaggcggaggttgcggtgagccgagatccggccattgcattcattctagcctgggcaacaagagcgaaattccgtctcaaaaaataaaaaataaaaataaaaataaagaaatgagattttatgttagatatatacttctatatatatactcacaagtatgtggtattgagtttgatgtaaaatatttttgttcaccgtaggctgggatcaaaacagtttgaaagccactaatgtgacacatgagggtcaacagtgaaaaaaactggacttttgagttcttccttccccaaaataagtatcccttcagtgccaggctcagtcatgcactcagaaaacgattcgagagaacagtagagaaggaccgtgccaggtgttcggctcgtctctgcttaactgagatccgcggccttcttgggacaccacaagaatcagagtgcaagcggaatggaaagggcgagccagccggccccagcaggcagaagcagaggcttgcagctaagctgttgatccttggggaagcaagcccaagccctgggccccatcagtgggcactgagaggcgccagcggcccagtctcccgcgagcggaagaacctcgcgcacgcgcagtgaaaacccagggcccgcgaagcgtccgaagtcccttcccaccgcccggcttcgcctccagttctcggggaactgtacggcccagtcactcccgcctcgtcacccccgccaggtttcccccgccctctccggccggggctggtcgcgactgcgcgcgcagggcctgagcgggcgccggagggaaggggaagcggcgggtaaggagggcctgcgttcgggcgcgtctgtgacggggttgggaacttcctcttctactccctccggctttccggacccctgaggactggagtgagagaagcctctagaactgtgtatttccttgtctttccttctgccgccgcaggccttcctccgacagtctaagtgtcgccctccccagaccttctcgtccggaccgctcctgcctcccccgccccaactggggaatcctgaggctgtgtccccagtccctctgttgtcgcctcgtttgtctgagatcccttccctgacctttaggtagcgcaggaacgattattagcttttagtgtagcagcagtttagggctagctctctaggccgggcccccaactcaagcacaaagaaccacgggtgttttgacacttgttccggggattctttctgacacccctttgctgaagcagtttccacatgttcccagcagtgaattcaaagccagcaaacataggtccgctttagttcctctgggcatttctaccgtttcctaataatctgcttttttttttgagacagtctcgccccttctcctaggctggaatgcagtggtgcgatcacaactcactgcagcctcgacttctcaggctctagcgatcctctcacctcagcctcccaagtagccggaagtacaggcttgccccatcacagccagctaatgttaaaacaattttttttgcggcggggggctcgctgtattgcccaggctggtcttgaactctaggactcaagcgatcctccctggccgggcgcggtggctcacgcctgtaatcccagcactttgggaggccgaggcgggcggatcacgaggtcaggagatcgagaccatcctggctaacacggtgaaaccccgtctctactaaaaatgcaaaaaattagccgggcgtggtggcgggcgcctgtagtcccagctgtcgggaggctgaggcaggannnnnnnnnnnnnnnnnnnnnnnnnnnnnnnnnnnnnnnnnnnnnnnnnnnnnnnnnnnnnnnnnnnnnnnnnnnnnnnnnnnnntcaacaatctgcttttcaagtttggggcacgtgaggcatgcaacgtcacagaattgtgctcttttcctttggaaatatggtcactccacatgccaccttttgggatgacgttcctactccactgacagtgggatggtatcagcagttactgagaagcatggtaacagactagtatttctgttgtctgccacccgaatggatattcagtcaactctttcttgtagcaggaggcagcattttagctcagtggctgtgcttgatgccttgaagtaggggacagaggaggtaccttgtaattaaaccactagggttcaaaatgtgctgacagaaatgtaaaacagaaaaggcctgacagtcatgtcatgttgataatagttccaggtcacatttctgtgtagggccaaatacatggtttctccgcccccaccccctttttttccttttttttttttgagacggagtctctctgttgcccaggctggaatgcagtggctccatctccactcactgcaacctctgcctcccaggttcaagcgattctcctgcctcagccgcccacgtcactgggattacaggcgcccaccaccatgactgggtaattttttgtattttttagtagagatggggtcaccatgttggccaggctggtcctgaacgcctgacctctggtgatccacccgcctcagccttccaaagtgctgggattaaaggcgtgagtcaccgcacctgctttttgttgttgttgttgttgagacacggtcttgctctgttgtccaggctggagtgcagtggcaccatctcagctcactgcagcctggacttccctggctcaggtggtcctcccacctcagcctcccctgagtagctgggactacaggcctgtgctatcatgcctggctaatttttttgtatttttagtagagacagggtttagccatgttgcccagactggtctcaaactcctggactcaagcgatctgcctgcctcagcctcctaaaaatctgggcttacaggtatgagccactgtgcccagcccctttcaccctctttaaaaaatttatttttcacttcaatttgggtgacagagtgagaccctgtcccccaaaatagatattttttaaattggcacataataattgttttatatttacatttatgaggtacagtgtgatattttgatacatgtatataatgtataattatcaaatcagggtaattaccatattcatcacctcaaacacttcttgctattatatgctagttatatgtaatatgttgatattctgtagatggtgatatgaagttttagcagctaccttcgaatctctcaatcaaatttctcaataagttaattcctagaaagtgatgataatcagccttgttattttgactttgataagtttaaatgctataaacgtaaccattttttttctaacatcagcccacactataagtcttattacccattgtcattgatacctaaattacaaaatcttagtcatcttaaatttccctgtgctattccatatgtcttatattacaggatctcatggtttttttttttttttttttttttttttttttttgagacagagtcttgctctgttacccaggctggagagcggagggcagtggtgtgatctcagctcactgcaacctccatctcctgggctcaggtgattcttgtgcctcagcctcccaagtagctgggattatagccctgatccaccacgcctggctaatttttatatttttagaagagacggggttttgtcatgttggtcaggttggtctcgaactcctggattcaagtgatcctcacgcctcagcatcccaacgtgctgggattacaggcgtgagccactgtgcccagcagtttctttatttaaaaagtaatttagaacgtgtccggtggcctaataattcctatgcagtgtgatatggtggaacagtcctggatttagagtaagaaggcctggattcagatactgagactgtcatactaacattgtatccttggggaaactttgagcttcagtttccttttctctcattttagataagattatcttttcttctcacctcttaattattgtgagagttaccattgacataatatgtggagaagttaaaagttaaaaaaaaaacccaacctaagctgttgttatttctccttgttctcattcatttcacaaacattggaaacctaacatatgttatatactggtgctaaagctatgaaagatagtacctgcctttaaagggctgtgtttcaaggagctctgaagcgcgcgcgcgcgctcgtgtgcgcgcgcatgcgcgcactaagagtagggtggtagggtatttgataaggtagacctgtgctatagaatgtaaaaccaataagcttagggtgagcaacaaactcagatgagtttgggaacatatttccacaattccagaggagcaatggggaaaggttcctggaggaagttatatttgaacagagtcttaaattataacaagaatcccgaagggctttgtgtgctacgggaagtgtacacattgaatgattttaagcagttagactgatcacaactgcttttcgaaagttgctgttgtctgtgatgtgtgctctgtgatgtgtgctttgttaactttctgtctttgtgttttattattattttttttactccatcaagaagtgtcctctcctcataccttaatattaactgtttatctttcagtttctagtgcaggtcccatttcttgtgtgaagcattctccaattattttagcttccctacttatttcattctctgaaaccatattagaaatagtaatagtaccacactttagtccttatttgttttatgtccttaagtagattttaagtatagagaatgcttcttatgtgtgaatagaaagcatgttaaaaaaattttgttgcttgatctctttgtattttgtttttcagggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatgttacatgagtctgttgctttgactgaagaatgattcaatcactcatgcactaatgtggaaatataaattgatctaacttatctagaaggtaatttagcaacatgttattatgtgactgaaaattcatatcttatgacccggtgctccttttctaggaatctgaaggaattaattagtgatgcaggcacatatttacaaaccaggattttattgtaacattattattattattttattttattctttttttgagatggagtctctctctgtcgcccaagctggagtgcagtggggcgatcttggctcatggcaacctctgcctcccaggttcaagcgattctcctgcctcagcctcctgagtagctgggacacaggcgcatgccaccacacctggctaatttttttttttttttaatttttagtagagacaggatttcactgtgttagccaggattgtctcgatctcctgacctcatgatccgcccgccttggcctcccaaagtgctgggattacaggcgtgagccactgcgcctggcctgtgactttatttatagtagtatataattgaataaaatcttgtctcagtaggttttatggctaaataaattatgatacatgtatagatctcacaaatgagatctaacaaatcttaaaatatatgtatactattatggaagaatgtttacaatatataaaattttaaaaatcaggatataaataaacccctattttgtttgaaacacaacccaaaaaaacttatatgtatttacacatgagaaagcagccagaatgtttgatagcatttatctgtaggtaatttttttccacaaagtgtttataatcagcatatgttattttactcaaaactatctcttaaatgtttttgaagagttttaataacattagagaatgtacacaggggcacagtggttcatgcctgtaatcccagcacttcgggaggccaatgtgagaggattgcttgaggccaggagctcaagactatgcaggacaacatagcaagaccccatttctaaaacaaaaaaaattttgtttgagacagggtctctctctgttgtctaggctggagtgtggtggtgcactcacacttcaatgcagccttaatctcctgggctcaagtagtgctaccatctcaccaccctgcatagctgtgactacaggtatgtgccaccatgcctgactaatgtaaaacaaattttttgtagagacagggtctcactacattgcccaggctaaaaaaaaattttttttttttttgagacagagtctcgctctgtcaccaggctggagtgtagtggcgtggtgctcggctcactgcaacctccgcctcccaggttcaagtgattctcctgcctcagcctcccgagtagctgggactacaggcatgtgccaccatgcccagctaatttttatatttttagtatagacggggtttcaccatgttggccaggatggtctcgatctcttgacttcgtgatccacctgcctcggcctcccaaagtactgggattgcaggcgtgagccactaacgcctagccaaaaaaaaattttttttaattagctgggtgtgtggcttgtgtctttagtcccagctaacgggaggctgatgtgggaggatccaggagtttgaggctgcagtgagctatgatcaagctgctgcaccctggactgggagacagagtgagaccccatctctgaataaaataaaacaactggaatgatgaagaggggagtaggggaaggggaaagaaagagaaggcacaccaaaacgatgtatagtcttacaggatatgcaataaatatgcatagaaaaaagatttgaaaggctgagatgggatgatcacttgagcccaggatgctgcggcttcagtgagtgatgatcatgctactgcactccagcctgggcaacagaacaagacactgtctcaaaaagagagagagaaaaactatgtgaagaaagacactacagtgttaatacaatgtatgtctgtgtatggaaaaatatgtttttcattttagtttttctgtcttaaagttctttttccacagtgaatatatattactcttttttttttttttggtgacggggtttcactttgtcgcccaggctggagtatagtggcacaatcttggctcactgcaacgtctgcctcccagtttcaagcgattctcctgcttcagcctcccaagtagctgggattataggcttgcactaacatgcccagctaatttttgtatttttttttttagtagagacgggttttcaccatgttggcccggctggtctcaaactcctgacctcaagtgatccactcacctcagcttcctaaagttctgggattacaggggagagccactgtgcccagcctcttttattttttattttgtgagacagagtcttgctttgtcacccacgctggaatgcagtggcaaaatcattgcagcttgacctccagggctcaagctatcctcccacctcagcctcctgagtacctgtaggaccacaacacacaccaccatgcctggctaatttttaaattttttttgtagagattatgtctagctatgttgcccagactggtctcaaactcctaggctcaagcaatcctcccacctcagcctccctagtagctgagactacaggcgcacatgctaccacacctggctaatttttttttttttgaggcggagtcttgctgggcttagtggcgcacacctgtagtcccagctactcaggaggctgagccaggagaattgcttgaacctgggaggcagaggttgcagtgagcagagaccatgccactgtactctagcctgggcaacagagcaagagcctgtctcagaaaaaaaaaaaaaaaaagatgggtgtggtggctcacgcctgtaatcccagcactttgggaggctgaggtgggtggatcacctgaggccaggagttcgagaccagcctgaccaacatggtgaaacctcgtccctactgaaaatacaaaaattagctggttatggtggtgcgcatctgtaatcctggctacttaggaggctgaggcaggaaaatcacttgaacccaggaggtgttggttgtagtgggccgaggatgcaccactatactccaacctgggtgacatagtgagactctgtctcgaaaaaaataaaaaaataaaaaaataaaaaaaagaaagtgaagcccttggaaaagaaagtggtatacgtagttaagtatttaatagtttctcttatgttatagattattggttattcctaatattaaaaactagcattgtgtataatccctgcactttgggaggctgaggtgggtggattgcttgagcccaggagtttgagatcagcctgggcaatgcggcaaaaccctgtctctaaaaaaaaaaccacagaaaattagccgatcatggtggtgagtgtctgtagtaccagctactcgggaggttgaggtgggaggctcacctgagcgtgggaggcagaggttgcagtgggccaagattgcgccactgcactccagcctggacaacagaatgagacactgtctcaaaacaagcacaaacaaaaaatgaacattatgtggcgttttatcataattgaagatagagaccttgtcttactctccccagtgcctcagtaaatgtctgttacatgcatataaccttatgttaaaagcatagactttatttgttgttgttgctgttgttgtttgttttttttctttccaacttttaggttcaagaggtacatatgcgggtttgttccatgggtaaattgtgtgtcttgggggcttggtatgtagataattttgtcccccagttaatcagtataatacctgataggtagtttttcaatctttaccctcctcctaccctccactctcaagtaggcccgaatgtgtatccatgtcttcttggtgtccacgtgtatgcaatgtttagctcccatttatgagtgagaacatatgatatttggttttctgtacttgtgttaatttgcttagaatcatggcctccagctccatctgtgttgctgtaaagcacatgatttccttcttttttatggcaaaagcatggactttgatgtcaacccctaccttgcaacttgctttaccatgcaacttgtggacaagtgacttaaactttgattctgtttctttaatatgaaaataaggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcgggaggctgaggcaggagaatggcgtgaacctgggaggcggagcttgcagtgagccaagattgtgccactgcaatccggcctgggctaaagagcgggactccgtctcaaaaaaaaaaaaaaaaaaaaaaggaaaataagaaaaataataatatctaccacatgggattataataagggttaaattagcatataaagcaattaatactgcacctggttcattgtaagtttttcataaatgtgttaggtatcgttatcgtttaaattttgtgctctttactcaaatccttgattgccttttttagtgtctgtctactctgcaggcatcaaactatcagtgaaatcaagtataatactttttgaatatggtaagccaatgtttgtttttattttattggccattttgtcttcctacttctctaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggtaacttttttgctatatatcgaattagttgattaattatccagtgatgtgttctctgaaatgtgggagagtgttttcattttttggttcagtaacagacatttattgaatgattactctttttttttctttttttaaaatgtattgaatgattaagatacaacttttgtgttctgtgggtgggcagtagtattttaatatttctacccactatttttatcaaaatctttcttgagattgattactaaggcagattagtgttatagataaaaattactgacagagctactaacataccactgctgttgacagaaccaattatttcagttaagatttcctagggggggtcagccccccgcccggccagccgccctgtctgggagggaggtgggggggtcagccccccgcccggccagccgccccgttcgggagggagatggggggttcagccccccgcccggccagccgccccgtccgggaggtgaggggcgcctctgcccggccgcccctactgggaagtgaggagcccctctgcccagccaccaccctgtctgggaggtgtacccaacagctcattgagaacgggccatgatgacaatggcggttttgtggaatagaaaagggggaaaggtggggaaaagattgagaaatcggatggttgctgtgtctgtgtagaaagaggtagacatgggagacttttcattttgttctgtgctaagaaaaattcttctgccttgggatcctgttgatctatgaccttacccccaaccctgtgctctctgaaaaatgggctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctagaaaaccagagacctttgttcacttgtttatctgctgaccttccctccactattgtcctatgaccctgccaaatccccctctacgagaaacacccaagaatgatcaattaaaaaaaaaaaaaaaaagatttcctcttgctactctgaaaaattaagcaaaacctaacacttggagaaaatgcatacactaaaaataaaaaaattcaatgaatcctgtaaatcctttcattataaaataaatttggtattgatatacaattatggcctctgagtagcctttgaatcatctttagattctaaacttaattctgaaaatatgttttaccatagtataaaatagtttttatgtttatattagaaaaatgatgtttaaatttatttctaagaattactttaggccaggtgcaatggttcacgcctataattctggcactttagcaggccaaggcaggcagatcgctttagcacaagaattcaagaccagcctgggcaacatggtgaaaccctgtctctacaaaaaaaaaaaaaaaaaaaaaaaaaaggcaaaaaattagcccagcacggtggcatgcacttatagtcactgctacctgggaggctgaggtgggaggatcacctgagtccaggaggtcaaggctacattgagccaggattgtgccattgctctccagcctactttagacctggttttgagatttgaagtttttactcttgtcatgcactgaaagattaggttgctattgaattacaaatgattttattacaagttaaatacactactaagcattaacggtgtaattctgtaaatacataatttaaaataatgagttattagtttttctccactcttagcaatgttaacataattttgtaggtttttctgagtgatatcttgttttactacagatatagttgattgttatttgcagtagctatgttgtataagtctgctgcaaacacggaattagcaaatactgaacaattgctcctaggggaaatacaggtttaggttcctgcaagcctatagtcacaacatttttgtcacatagtcaatagagccttgttttatatagatttttttcttgttttttttttgttttgttttttttgttttttttgtttttgagatggagtcttgctctgtcacccaggctggagtgcagtggcacaatctcggctcactgcaagctccgcctcctgggttcacaccattctcctgcctcagcctcccaagtagctgggactacaggcgcccgccaccatgcccggctaattttttgtatttttagtagagacagggtttcaccgtgttagccaggatggtctcgatctcctgacctcgtgatccacccgcttcggcctcccaaagtgctgggattgtaggtgtgagccactacgcccggcctatataggtttttgtctaaaaccaccttatttaatatatattattgattcattaacaatgaactcatggccaccagtctataactcatccctgaatgaaactctatctaacataggtattttctctgtaaggcacttcatagctttcttgcacttagggacactaggtaacaactgaacattatggttaggggccattttaaacagcaaaattaccaacaaaaagcacaaaaatgcaaaaaaaaaaatgacactaaatagactgtggaaaaggatacttgtttatagcataagagctgaaatgagaagacagagtgaaactttgacctcacccagaaagtacatgtagggtgatttaaattttttgccactctgtgcatgtctgtgaatgactgcaaaagaacaagtgcagtagtccccctttatccatgggggatacattctaagaaccccccagtggatgcctgaaactgtaggtgataatgaacctaatgtacattatgttttttcctataaatacatacctatgataaagtttaatttataaattagagacagtaagagattaataatagctaataataaagtagaacaattatgttcatatttgtaataaaagttatgtggatgtactttatcttaaaatatcttattatactgtccttacccttctggtgatgatatgagatgataaagtacctatgtgataagatgaaatgaggtgaatgacctaggcattgtgttacagtgttaggctgttaatcaaaactaatgtaaaacttaagaactgtgtatttctgggccaggcacggtggctcatgcctgtaatccccgcactttgggaggatgaggtgggcagatcacttgagcctaggagttcaagaccagcctgggcaacatggtgaaacctgtgtctacaaaaaatagaaaaattggctggggatggtggcatgtgcttgtagacccagctattcatggggctgaggtgggaaggtcacttgaacccaggaagctgaggctgcagtgagccaagattgtaccaccgtactctagcctgggtggcagagccagaccctgtctcaaaaaaaaaaaaaaaaaaaaagaattgtttatttctggaatttccacttaatattttggaaatattaatgggtaattgaaatcatggaaagtaaaactgcagataaggggactactatattaattttggggttacaaatacattttagcaagtaggtatattcacaaataaggaatacatcttattccttatttaattgtgtataggaatacactatttaaatgtttaaacaagggagagaaattatccagacacacattggcatgaatcaggtgagaatttaggagtgggacaaaagctttcatgactgagttggtttttccaagtgtagcagacacagagtactaacagaaatttcttctgctaggagcaaggcagtgtcccctagaaatgggacatgttttcctacagctttttctttttttttttttttttttgagatggagtctcgctctgtcgcccaggctggagtgcagtggcgcgatctcggctcactgcaacctccgcctcccgggttcatgccgttctcctgcctcagccttccgtgtagctgggactacgggcgcccgccaccacgcccggctaattttttttttgtatttttagcagagacggggtttcaccatgttagccaggatggtctcgatctcctgacctcgtgatccaccctccttggcctcccaaagtgctgggattacagtcatgagccaccgcgcccgcctcctacagccttttaaaattataatttataatttaaaattagacacagtgagagtgtctaattcaagtcccgaagtgttttttaagcatgcccagtagttatcatctagtggtatttcagtgaaggaaaatactgcaacgatcaagggagaagtaaattgatttttttttaaggcaaccataatatttttcaactttgaaacttttcctctttgatcatattggagaaaatataagcaacttgtgtagaaaaatgagactataaaattcagagggagcaaaatcttaaatggttaagttatattacatgaaatgcgtagatttttttccatagtatatatattattgtacttacaactgaaataatttaggcaatttaatattattagatatttgattatatgtctgtttcttatattttagagaatgattttacttatctttaaatggaatatgcttattataaaaagtttaggtaatacagaaatataaaaacaacaataggctcggcgtggtggtcacaactgtaattccaacactttgggaggccaaggcgggatgatcacttgagaccaggagtttgagactagcctgggctgaacatagtgagaccctgtctctacaaaaaaaaatttttttttttttttttgagatggagtctcgctctgtcactgaagctagaacgcagtggtgtgatttcggcccactgcaacctccgcctcctgggttcaagtgattctcctgcctcagcctccccaggagctgggactgcaggcctgtgccaccacacccggctaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcccccgagacggagtgttgcgtctgtcacccaggctggagtgcagtggccgtgatattggctcaccgcaacctttgcctcccgggttcaagcaattctgctgcctcagcctcctgagtagctgagattacaggcatgtgccaccatgcctggctaatttttgtattttttagtagagatagggtttcattatgttggccaggctggtctcttaactcctgacctcatgattcgcccccctcggcctcccaaagtgctgggattagaagcgtgagccaccacacctggccctgggatgtactttaataaggcatatgctctttcttgatatcttgctcatactgaactgttgttcatgtcaactctgttcaaactctgttctgttaatacaagaactaattctccttggcactctttctacctagtacaactactttgttttctctagtctaaaatttgaaggctatgtgttgtgttcttgccacctttgttctgttttgttttgagacagagtctcactctgtcactcacactgtcatgcagtagggcagtcatagtcactgaagccttgacttcctgggctcaagtgatcctccctcctcagcctccagagtagctggaactaaaagttcataccaccacgcccagctcattttaaaattttttgtagagacagggtttcactgtgttgcccaggctggtcttgaactcctggcctcaaacagtcctcccacctcagcctcccaaagtgctgggattacaggcatgaggcactgtgctggcccttgccacttctttctagcctgaggcatgagggtggttgaagactagagatccactagggctgagatccttacttaggaacttgactttgatatctctctattgagttcttgttatttatcttatatctgggtctacttaacctagccagagatgtatcccactagtgtggactttggctagcacagtgttctgttagagagcaaatccaggtgatcctttctaccttaactgatggtcttgtaaagactttcccttttaatgattttgttcctcaacttttctcagttctgcttttcattcttgattctgtctgcaaattattattagtgagaattctcaagattttgttagttgaccatttttcttcaatattgcttcttgtctgggatacagagaaaagattagagatggaaggataggagacaatctcttgctagcattataatgcctttgtgcaaattaggaaatagtgccctttcagggagaacaggtcttacaacttggcaaatgaacacaggttgactctcatgccgtttacctcctcagctaagcatgcttgagcaaggacaacctacctcatcatatgcataatccttttaggatatggtactcatgccaccagaatttatttttcttgctttgtctatcattcttaaatgttaatgacataattttatatcttttttgttacgttgtaagtatagaatttgtggctattttaatttttaaattttgttagataattgtgatcttgtttcagtttgcaatctttatttggaaattcttcttttttttttttatttttgagacagaatctcaccctgtcatccaggctggagtgcagtggtgcaatcctgcttcactgcaaactctgcttcctgagctcaagtggtactcccacatgaacctcctgagtagctggaactataggcatgtgccaccacacccagctaatttttgtattttttgtagcagcaaggtttcattcaccacattggccaggctggtctctaactcctgggctcaagcaatccacctgacttggccccccaaagtactgggattacatgcgtgagctaccacgtctggcctggaaattcttatgcatggggggatactgtgaagcatatatattttttagttgctattctgcttatatatgaagcatatattttaacaacaaccttttttattcttcattagtgaagaaaatacttcccttaaaatagtcagtaccaatatttggtattgtaggaaacaaacaccattgtttgatgatgattttttatttcttgatggttaaatgtatcttatctttatagaaatgtgttttttcaatattatttaaaaattgtttaaaacattgtgctttttaaatattgttttaggagtatccgattttaatcttcgtgttgcattgcaaacacttctgaaagagtactgtgaagtatgcagatctcccaaagagaacaagttttgtagttttctgcagacatctaaggttcgacctcggaagaaagcaagaaagtacctgtatgcagtaggtgagagagcccttaaaaaagtaatagaaattatatttgtgttccagatcaaacctttttaatattttgttgttattactatacatgtcagaatatgtgggtgtgttgaagaggcatatttaatttcacatacagactacagatttataaactgcatttatatattatgacaaatatgtctaaaaagaaatagctattcatttgatatctgttattctgtgatctaaacctttgagttcgtagattatccagttatcaaataagtgactaaagaagtgctgctttaaaagtaaaaaatttgaattattgtgaaaaataaagaaaataaatctcaagtttttaaactattcacagtatcctagtcattaggagtgataggaaccaatgatctccaaagtgtggttataaaagatgatccataggaatatcagaggaacatattacaacttcttctttttttttttttttttgaggtagtcttactctgtctcccaggctggagtgcagaggcgtgatctcggatcactgcaatctctgcctcctgggttcaagcgattctactgcctcagcctcctgagtagctgggactacaggtcatgcgccaccatgcccagctaatttttgtatacctatatatatatatatattttaagtagagacagggtttcaccatattggccaggctggtctcgaactcctgaccttgtgatccgcctgccttggcctcccaaagtgctgggattacagccgtgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14063 - DNA, 18141 bp, Human
  misc_feature (1)...(18141): n = A,T,C or G
gaaccaaattggatcgattgccttctaaaacaaaaaaaaatcaacattccctaaaggcttttaacaggactcagtctatgcaacataatgttcaaaatgtcctagataaaatccacaattacacagtataaaagaactggaaaaatgtgaccaacttgcaagggaaaatataatcaacacctgctaactcctagatgaccaaaatgttataatacagattttaaagcaacaatcataactagagagtagttgaacaatttctctcctaaacataatcatacttgcataaagacatttcagtcaatgatgaaccacatatacaaaggtggtcccataagattacaataccatatttttactgtacctttatatttagatacacaaataccactgcgttacaactgcctacagtatttagtacaataagatgtactaaatgcaggtttgtagtctaggagcaataggctataccatatagcctaggtgtgtagtaggctatacctgctaggcctgtgtaagcacattctatgatgttcacacaacagcacaattgccgaaagtggcatttctcagaacatatccctatcattaagtgaggcatgactgtatatgctgtattctaaaaaaaattaatgcatttatataccagaatctatgcataagaatgctcatactggtgttgtttgtaataccaagcctgagaaacagaaggaataaactgtcacaaaaccacaaaacggaatagtatcagtatacatcagtgcaaataaaagaattacacctatacacttctacatgcaactacctaggattaatttagaagcataatgaacaaaaaaagagtacagaatcaactatgcttacacagctcataaaattaaacatacatgtatgttaggttttgaagggaaggcaaggattaaagaaagagagggtggcttaacaacaaatacaggatttatgtccagcataagacctacagaggtgggagaccagcttaatgccagtgcccgttgcttcttacaggctggggtgatttataggcctgggtgggagtggtctggggggccatggcctgcttcctgggaaacatgttgataaggtgttcccaggacgaggcggctctggcccttgttccagtggaatgtggtactttctcccagcagagtataagaggcagcctgtttctcacgcccgaaccccgtggaatgtttcactttgactaaggtctgcaaaatggcaggggggcttacaaaaatggtgcagtttggactaacaacgtacataaatttttaaaaagcaaaagaataaatcccaaatatgggaaagtgttatctgtggaagaaagtaatgggatggtatcagaaaagacactggtaatttaaacagtgttgacaatgtctcagttttaaaattaccagctggttcccatgtataagttgcttacttatctgttacacctatttatgtatatataaaaataggtttccaaacgacatcccatgtgtatgaaataacagaatttttatgccttattaaaataatttctctaaacacttgaagagcccgagccgcctcttaccctaaacgaaccccacgcccctgaattgatcagtcacttccgcctccacctttccagctccacctaaggaagcggaagtactttactcttgggtcctcccacctgtagggggctctccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaagtgagttcaagaagggtcctgaattgggacggagtttgttagtggaagctttccgaggtccgtccggcattttccttttttatgattttctgtgccttaagacgggttgaggcggcgaaccgccagttccctggcgggaagaaggctcccaatctcctcacgagagaggtctttccgggagcctttgttctagatatgtcttcagcgtttcctcgacattacctccgcaaggtagcctctctttttagagtgcgagatggcctacctttttgcccccacccccctcccccgccccggccaggttttagcgataggaaacctctccagtcaggccagcttggtgttggatctcccccacgtgacttttctctgcagaactttactcttgttcacggaaaatattgctttctcgcactcgtccttttgcctcttatagttcaccttgttttgtatttttactcaaacttttcctccatactattttccccttttccggaagctctaccctcttcggtttgggaaattctgacattttctttgtggatcatttctccacaagaattgggcttttcgcctccttagagccgaaaaggagggaagaggcctgtgtttttgcctactcagcccttaagatgcctgcagcagagaagcacgtgtgttagtggctctgctttttgacattgttgccaaagccagtactcgactagatagttaatcagattttttttgaagggtgcacaaataggtgtatctattcggaaataacatggaaaataatttaatgtacaactcatgttcacataaaagccttttatttgttgtacctaagttagccacaaataggttttgattgtaaaaagcaaaaactttgaaataaacctgggtttagttaaaattctattacttatttaactgctaaaaaaggaatagaattttttttttaatgaaaacatgaaataacatggatagggtgtgtaaacagtgacgtgtagcaaattctaattggtggctattgatagtaatttgatattaagatgacctgaaggagtagttcaagcctaacaaatgatactgaatagaaccaaagttatatgttatggatagtattgctctgagtggtaagacattattgaaaacgttcaaaagatttagaacaacaacttctgactttgttgttacctgtaaaataatgtgcttttgtcagtgtctttaatgacagcacacccagaggtaggactctcaatgagagttcatttcaactcatttacaaatatatgaatagaatgttgtttgtacaatatgtttaaatgcaggataaattttcagagtatattttccatgcttaatggagttaaaaggaatatttttaggggaaaaacttaacctaaatattatttagagtgtttcactttagtgtcatcccatacttcacatctgtattgtattctagtataatgccttaaaaatcagctttttaaagtttaagcattccatgttatccagagcatttaacatacttttaccaatatacacgtacacttctaaggtcatgtgagtgaaccagtaattctttaggtttgagtttgttgagtataagcataaagtcttactgtactacatgtgttgagattattggttttggtggttgtgtcatttttttcagcgaagtctcagaggtttgagaaatgccctgtaaaactcagttttcttacaattattgaatctttttgtatttttagtcagtacaacctatcatatttggttccttagcatcctacctactgcatgtaaaaagataatttcattaagatccatgaagccctccttgatttataagtttttttcctcattggtccaccgctagggtttaaaactccctggtagcttgtaagtaattagtgaagtggagttaactctcactttcaactttgtaaagggattataactaatgatatgtgctaatgtgaggacttgaggcagagatcctaagtaacttaatcaagatcacatgactggtaaatggaggattgggatatcttattctgaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctgtttttagatgtggaaatgtaaactttgctagaagaaccagctgtaatcgatgtggtcggggtaagtatttaaagaagattctatttatactgtatatgtatcatttatttatttctccaggttcatattgcatgatttttctgttttcagagaaaacaactgaggccaagatgatgaaagctgggggcactgaaataggaaagacacttgcagaaaagagccgaggcctatttagtgctaatgactggcaatgtaaaacgtatgttttttaaattattgtctgctctttcttccaaaataatagatctggccactacttgtttatattacagctcttattagtgacattgacaagccagggtaaccttttaaatccaaggtattgttattcagtctcatctttaagtatagtataaagaagttttaaattattctttgcattttttaatggtaatagttgtcactatgatggattatgtataccagtaaacaaatgcttatggtaagctcaaaaccaatcgtggggtggtggtacttaaaagtactaaggcctattacttcctttattgaaaaatcccaatttttagactgtatagttagtgtgaaatacaccacaaaactcattttgcctgtttacaaaataatgttagattcataagttgtgtgccgtaagtaattaagtctaattataggtaggtttcttaatgatttttattttcaggcttagatttaattcttcattgatttttccaacttccatcttttctctatgcagatgaatcctatgtgtatgaaagaggtctaaatcaaaaaagtattaaataaatttctctttttgtttgtttgtattttttgtttttgagatgaggtcccactcagtcacccaggctggagtgcagtggggcgatctcagttcactgtaacctctacctcccaggctcaagcaatcctctcacttcagcctccttagtaactgggaccacaggcccatgccaccatgcctggctcatttttttatatttttggtagagacagggttttaccatgttgcccaggatggcctcgaacacctgagctcaagcattctgcctgccttggcctcccaaagtgctgggattacaggcgaggcatgggccactattcctgaccctagagtcttaaataaatttctgatcctcaggattataaatttgtattggaaaagtttccagctacagatttggtcactggatttggtatgctttggaattcagtgcttgaactgagacctcaaaaaaataaattaatattatttatagggtataaccatactctttaaggtatattcagagactgagaaattagtggagctgttaatttaaagttatattttttcataagacatcagaatttctatacaggttcagtatcacttacctgaaatgtttgtgggttcagcatccctaatctgaaaatctgaaatgctcctgtgagcgtttctgttgagtgtcatgtcctctctcaaaaagttttagattttggaacgtttttggattttggatttgtggattagtgatactcgacctgtggttataatttgtcatttacttctcaaaatgacagaggcacttttcatactatataaattttgcttctctgcttaaatggttcagtccgttgttggaacccacatttactcttcaggccactgtacattttctttgtttacattaccacttaataaacatttctttgacagtggtttcatcctagtttttattttaaaattgtaaaatatctaaaaatttgatattcatctatattatagcctactaatttagtatttttcacttctaaagttgcagcaatgtgaattgggccagaagatcagagtgtaatatgtgtaatactccaaagtatgctaaattagaagaaagaacaggtatgataaaaccacattgtaactaaatgattttttttaaagcactaaatattgaaacgataattgtatcaccttcgagtaagagccacagtaagtgaggattctgtttattctgccctgaatgtttgttactgggatttttttccccccatacacacatacaaatcttttgtttcacaatttataaaataacagtgttagggacctttatcctaacaaggagggacataagaatactttcagaaatattctcctcctctccctttcactggtttgcatgtttgttattagtaatgatataatgataccatttttaaattcttttgatagcctgctgtgacttaaagggcaaagccacaccatttaaagtgttcttctaaagctttggcagtaattctgaaacttaagctatgtgctagattatctgaaaaactttttcaaatatcgattgcaaaatgcagaactgttaaagttatttggcggtgggtttccaacatctgcaggttttttggatggtgtttgataatcattggcctaaataatagttgatcattggctttgtatgttactggtgaaatgaaaatgtttacctaatagcatatagtttttccattatcaccaattagcccaaccacattatctgtttacttaaaatctgattttgtctttcaactgcttatatgtcacatgatcaaaggattccttctatatctagtcaccctgtcagacttaggcttggtgaactgcttccctgttttctttgcctctctaactttaggccgttttcattgtctgtttagtttctagggatcagagggccactgttcaatcttttcgacctagctcttccagacttcaacagaaattctacttttatccccccccaccccttttttaaaacttacattctcatatgtgagaacattataacataatgtccttgatccccccttccccagcccaaccgccactttcaaccctcaaatcctgccttattcttaggaagtgattttgcctttccaccgattgggtaagttaaggccttctgacaaggatctcgtttttttcttccctcacctaaggtatgcaccgtacctccttcaccgcccccaccaacccccgtttgattgattgtttattctgtctcctttgcaggtttctcttcttttggccactgatgttgggattcttcgcagccatccctggccctctttctttcctctattttcatggtgttttcttctaagcccaaagtttaagtaactttgccatgataacccaagtttatgtctccagctcagacttctttgacccatatatccagctgcctattcaacattgccatgcaaatgtcaaactcattatattcaaactgaatttgtgattttacccctgggacctgaccctcttccaatgatctctttctcatgattagtaccactcaccatacatttattacataagctggaaatctagatgtccttcttagcctaaatagccctttcttgatatctcccataccccaaaaattcttttccattaccaccctaggcaaagaattactatgttttgtggaaaaatagccacctagctggtttctacatgtttttatttccaaatttaaaatccttttttaaaaaacccattttgattgcttttaggataaagtctaaaatctttttaacagtttcaaaacttaaaaaaactttgacctatttcctgactcctttatagtttcattatcacaagaactatagtttaacagagaagtaagcaaattttatttgataacttctcacttttcttattgtcatttttcagtcattctggtgtcttgaacctttctcacttcccttgctacaagtatttgtctttgctggtaacagttgaaggtgtgaaataacttactctgttgctttccgctttcttttggctatttgtaataaagcagtgcagggtttggggagcatttcctaagcatgagacaggatatgaataaaagagaatgtgattcactacctctgaaagattgctggcttatcctgcataattccatcaaattgttcagtaatttacttctctgtttcaggatttaggattatttttgtttttgtcagcttttttttaaaaaaaaaaccattaaagataatggcataaaaacaaacttagtacattgtgatttttattcttttggattctttccttagaatatgttctcaggagttgaattaattgttcagggtgtagaatcacagagttttcctgttagtgccttagttcttcctttgaagtacatgttatattcatccccctttcccgctttttttccattgtcacaatcttgatccaaacattcattttaaacctgtgtttgattctttcttggcccttgctcagctttttacattatactgtgagacaaatttgaaaatatattcattgtaagacttactaaaatctacggaaattcttggttgctttctaaagctttccatagaaattcaaattcattagatgattccagaattgtgttttctgtattcattccttgaagacatttataggccactgtgcaaggtgctggggatacctaggtgagcaaaagagtcttacagcaccaaagattaatgaagtcctctttaggaaagctatgcttaagctaagaagtgaaagatgagttacctgagtaatggattaaacactcttctttctgtttgtggagaagtaattaggagaggtggcggcaagagtggaaataaaaccaatttatacagcattatctgaagtgcttgaaattagtagaatgacggaaacatacatatcattccattgattccactatctcaggtattcagtgaaaatggtatgcttcagttttttcacgatagggagctagtgtattttccatttatacagagttaatgagctagatttatattgtatgggttcatagaacataccttaccaatgtctttgttgtcagcagactattttgctgcctcttaaaataattttatttacatacttttgaaaaattaactactagagttatagttcactttctaattttactatatttttgagctttccatatttgtcatattacttttcagttttttcctatgtaaattatttccaatttagatcccacgtatgtttaaaaatatttttattaacttccaagtattttgaagttttcactagtacaaagtataatgaagaaaagatgctatattagtgtgggtttttttcagaaaggtgaaattttaaaaatatttttttaaatatgataggcaaattttaagttacaagtcctaatttttataaaatatttttattataaatctatttaatattttgctgatgaatgaagtccctaagtctggaaatcaccggccttattgtactgatactgctctggagtatgtgaccagttagattgtattactcttgatcaacacatacctctttaattttcaatgggagactttttcaaaatatgtcaactcacttttcctaaaactagctcattttctttaattccagtctctcctttaagcttatgtcagagacctgccaattgaattgtatacattggttgtgacatgagagaatagtggtttgctaatctcaactactttttaatagaatcatttaatttcaaaatttactggctacttcagagaacctgtgtgacttttacctatgtgttaaaaccaattaaaccagggccaaaggatggcctttattgtgttattgtgtttgtctgtgtaattaggaattttccaagctctaataaggcctgctacattttaaagtagcaaaatttcagaatatcagaagatttcagactatttgcagttggtaaacagtggaatttaatgcttggttgttactgagcccacccttcccagaagaattacgattaactgtagaggaaagtcctttaaaacttggttatagcagaagtttgagatgttttccaccaatactttctatgaattaaataagtcatgtagggcaatttggaattgaaaagagctagaagtacagccatatgacgttacaactaagttctctgtattttctgtggtgatttctaatatgctttctaaagactagtaatttattagatgggtaggcagccattgttgattagatgttttttgttgtctggagatttgggcatgatgtgtttattatttaaatcaattgtcatagggtaacaatttgtgccctcttttttaaggatatggtggtggttttaatgaaagagaaaatgttgaatatatagaaagagaagaatctgatggtgaatatgatgaggtaagctatattttggtgttcaggttgaatataaattagaaaaacagaaaaaattcttaaatgcaaaggaaaacaaacttttttttaagtgcaatttgagtcttcagcaactgatcattttcaggaaatcataaatatctaaaataattttttagaaaatgtattaagtttaatgcattatcagctgacaagcattttgaaattgtttttctctagtttggacgtaaaaagaaaaaatacagagggaaagcagttggtcctgcatctatattaaaggaagttgaagataaagaatcagagggagaagaagaggatgaggatgaagatctttctaaatataagttagatgaggtgaacaattttcttgtcctatttcccttttgtcttattggagttataccataacatgaatgcttttgacagcctcagacacttggtgaaaatatattctgtgttttcatttgttctcacaaaggttttggatttccactctgccaagtactatttgtacttggaacactactgttctggagatacagtggtgaccgaaacagaaccagttttctcttacacagttctagaggaggaaatatataaataggtaattttgatagcagtaacgttatgaagacacatgatgtgataacagtttaaaagcaactttggttttgccgatggataatgtctaaggaggtgaagtttgagctgaaacttgaatgataggaaggagccagcaataagagccgaggtgagagcacatttaggcagagaacagcaaatacgggttccctaaataggagataagccagcagccttcaaaaataccatacataggccagtatagttagagcagaggggagaatgagatgagggggacagcacacatttcaggtctggtgatacttgttctgtcaggccagagtgtaagttttatgccatgttaagggtaccttagagcctgatcataagaggtcttggaatgcaactaaagaaataataagccagttttgaagtttttaagaaaaaagtgagatgtgtttatctgtcctgtgtttcagagtgatgactgtcagtatattgagatactagagaggcagaatggatcttcagatttgaggagaccagctaagaggttactataatatgctagagaataaggaacagagtgtctaagactaaaaatggtgatttcaaggacttttaaggaggtggacttgaaaattcttgggtgatgcataagtgtgacagaaaaagtgtgtatggcctccaggtttatgtctgtgcaatacctgagacaaagttgtcaagtctctatttgagatgagtttagtaggtgaattttagaattcagaattaatttgctgagatacctgtgatatatgcatatggaggtgctcagtacacctaactgttttatctttcctggtaggtaacactaatatctaaatgtctaattataattgaatttttgttaggatgaggatgaagatgacgctgatctctcaaaatataatcttgatgccagtgaagaagaagatagtaataaaaagaaatctaatagacgaagtcgctcaaagtctggatcttcacattcacgatcttcatcacgctcatcctccccctcaagttcaaggtctaggtccaggtaaacgggtacaggtcaagggtaacaccagtcaaaatgtcagtatctaacttttttatttataaattttgtttttcttgacgaaataaactttcctttttattttaaaaatttaattcaaatcaacttttaaaataatttttcagcttagtaccatacagttgttgtccagtatttttagaaaagtaaagtcttagcatgaaacttccttaacctattttagcctcatgcttttgactaaaatagacttaaaaactgaattaaatttttatatacacttatatttaattaatctaaagagatagcttacatatagaaattaagtaaaggggagatctgtattttcattcaagatgttaaaggctagcacagaaattttctaggcattaaatcattgcttattacataatgtttttaatagtttgctttgatatcagtattgtgaataacggagcaaattcagccatattagttctgttgacttcatgctcataattttgagaagtccaggcgtaaactaaaactcttttggtgtacttgaatattctttgtttgttgatgtaaaatatgtaatctctgattttatagttaacaataaaaataaaattttaggtgagtgaaagcagtgatttaaatttaacagtgtcctcttgaaaaaccttaatcacagttaagtgatggcatgggcaatgaattttaatcatatttaggaataaaatactagatattagtgtataacaattagatatatgttaattgagcactacaaagcctgaaagcttaacaaagtggggctataactagtaattttttggtaaaaatatagtgatctttttctacagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtggggaggatcacttgaggccaggagttcaaggttgtagtgaaccttgatcacagcactgtaatccagcctgggtgacagaggagtgtctcaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaaggtttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcat

SEQ ID NO: 14064 - DNA, 17901 bp, Human
gtacagtacttgctcaataaaagaaaagtttcaccttatttaagcctgacaactttctataaggttaaggaaactgaggctaagcacaaattacttattttttaaagttacctcagccagcattgtgggtagaactcaaactataattcaaattttcatattctaagtctagttctcttcatgacatctcaatattccaaagtaacagttgctaataaggaaccttaagaattgttaaagtcttaaagggatattttcacacactgctagtggttgccattaaatctgaaaaatatgcattccatggatcagtagtcacatctctagaactgcatcttaaaaattgtgagaaacacacaaaaatttatgtagttgaaaacaagctaaatataagatatttattaaataaactttggtgcaaataataataattggttttatttgttggaaaatttctaggtgccagatgctattctaaggagtatgaatgtatcaacactaaaatgaagttggtactattattatctccattcaacacatgaggaaacagagagacagagaggttaagtagcttgtccaagatcacacatttaggaagaaggagcaccaggaattgaactgagatgtcttattcaagagtccatgttctagtcacttatcaatcttcttctgagactgtccatggatccacccatgctgtcccattgtgtggcagcacctatgtaatggaatatagtgaacctttgtttaaaaaatgtttcaataggtattaaattatatagggacatgcttacattaaaatattaaggggaataaacagtatgcaaaactgcatactatattatttcagttctagaaacctgtgtgtgtgtatgtctaagggtgtataaatcaaaatccagacctaattagtggctgtctccaagtgacgggttatgtgtcatttttttctcctttgtgctttctaaatattctgaatatttgttaatgagacagaactgctgtgatcatcagaaaatttagattaaaaaaattcagggtgccaaaaaattctagaatacttaagaacagcacttagtttaccttaaaagttaaaaattgaatccagaagtaaatatttgcaagaaaaacaattatcaaggattgctaacttttagtttcttaaataatgaatccagaagtataaatacaaaatatttgcaagaaaatataattatatcaagggttgggaggagaagaaggatgtttagactagaaagggtagtacctacctaaaagagagtgcttaatagaactgtgctggattaagtttgcacagtggaccctattttaacttatgtcagctctacataagcagtctcctgacagtcgtcattaggattcactggagactggaactgtgcggacagagggcctgtcttcagaagagaaaatgggggaagagctttgaacccagaggtacaatctctggattggagagtttcaaaggtgccagggaaaagcagtacaaagagccttctttttgacaataactctaaaacacactttgctctgtgaacgcccgtcctgggcagggcctatcagcagggccagatgagcctatagacacccagggtggcgcgttcccagccgccctgcgcatgccaatcttatcagttttgatggaagcctggggctccagataatgctacttggccccaaacgctggacagagcatgctttttcctgtttggctgggaaagggaaggctgaactgctgagtctgacacttaacaggacttcggcattcccctgaatacagactagatcagagattttatttttttaattgaaaagtaacttgggttctctttagaaacccttatttggtgtgcgcatctggctatttcacagagatttcagttttgcaaagaagtcggagttgatttcttccctcagacaagctattggttgttggtgggcaacagaagttgctcagcatagacaggggaaaaaacggttacggatgagactgaaagaaaacctcaaaggagaactctgagaattcatctcaggatgaagctgcaagggcaaaggagaagtacttgtgacacaagcaaatgggtccattgatcaacagatgcaagaagattcttctcccaactactgtacctcctgcaacgatgagaatctggctccttggaggcctgctgccattcctgctgctcctctctggcctgcagagacccacagagggttctgaggtagggggacaattgagggggtgatctctttatgatcagtgctccaacagagcattcacccggccacagcctttaaatggccgaaaacttaggcattcagaatctagtttcattcagacattttaacaaatcatgttagtaaagagtgttgaaaacagttatgaaaaattgtagaatccttcactgttagtacacttgacattatggatgctagtggcataaagttattttcctgatccactgtaaaaattaagtaaaatattgcttccatagtacaaacaatgcaaaataaaccaagtctatttggctttaaactctagcatacagattgacttaagttttaagtgaatattttaataaagatctgtgtaacaaaaaacaacctaatgttaagagatgacagagtacatatttgagatctagtaacatattaacaaagtttcagagttcatcatgacagttgacagaacattgtattattggtttggtttggctcggcttggcttaaatagataccgtagacctattttaatacctgatgtgaagagttattggttaaaatcatttaatcagtcttaaaaatgtgttctagttcacaaacaactagctgacgtctcatcataaataacatagtaaaaataccaaatgggatgttctttaagttccagttccaacatccttaacattgactggatggaatgtgatcctttaacatgtccctcaatgagtactgtttattacgaaaacatcatttctttgccaagaaaggaatgttttagaatttatataatttatatatggctctaaatgatagtctgatgatattttgtggacttctattcaaatctgtcatttcagtttagcatgcactagacgtgaataaacaacattctgttggctacccattagaaaggaatgtccttttccaggaggggagggactttcctaggcacattcctgaccactgtccaacccttgactcactctgctgtccctgagggggacaaatgtacttgactggtaacatgggaaaaaacaactgggtgtgctgagtttggctctgctcttcatcctcctgggagttagcctgatggcaaagggcatcagttctctgtttccccatgacaagaatcttacctgggcaggccccagttcagtactgcctgcaaacgagtcggtcccattctggaatttgctcttaacaagccacttgctatcagacctaacaatgtgactgctgtagcgtgccctttttcagtaagaaaacagatattttggctttcatattttgctatttttattatcaatgttttcagaacccaggtagacaagaaggttgttacttatgagagcccccttagtactattcatagcttaaggataaagttcaaggatttaatttggttttgggcattcataaaagtgatatttttgaaaacaccagtgagagactagaaagaggggggaaagtagaggaaacagaaagtgtaattaaactacaagattttgaattttttcttcaaagtacttactatgcaaacatgctgtgattttagtgatattaaaagagttacttcctctctggggagatgagtttttcaagctttcagtaatttatttatcaaaccaaattcaatctctagcacaggtcattgatgcagtaaggattggaacagtgtaatgattttcagtgtaacttacttcagtaaatattggtttccaggagaagacttacccttatagagtacagcaaatctgcaaccacattcaccatctgatttgaaaaattaaactcaagatttttctttttttacaggttgcaattaaaatcgacttcgacttcgcaccaggttcttttgatgatcagtaccaaggctgtagcaaacaggttatggagaaactaactcaaggggattatttcacaaaagacatagaagcccagaagaattattttaggatgtggcaaaaagcccacttagcctggcttaaccaaggaaaagttctaccccagaacatgactaccacacacgctgtggctattttgttttatacattgaacagcaatgttcattctgactttactagagccatggcctctgttgccaggactccacagcagtatgaacgttcattccacttcaaatatttacactactacctcacctcagcaatccagctgctgaggaaagacagcatcatggagaatggcactctgtgctatgaggtgcattataggacgaaggatgtccactttaatgcctacacaggggccaccattcgatttggccaattcctctccacatccctcctgaaagaagaggcacaggagtttgggaaccagacactatttaccatattcacctgcctgggtgcacctgtacagtacttctccctcaagaaggaagtcttgatccctccctatgagctgtttaaagttataaatatgagctaccacccaagaggagactggttgcagttgaggtcaactgggaacctgagcacatataactgtcagctgctaaaaggtattctttatctaaattgaggccactcaggatcacagaccactgctcttttataaaagttattttttctcagtgggtttttggggaaagatcaaaaacatgaaaactagccttcggtaatgatggaactgatagattagagaaaatccactttatttattgacttctcttttcttcctactccattacctccaggacaataagttctgcagtgaaattattatgtaaaaaattgcagacagacagagtaaagcttgactggaaggtggagcataaagatagcacttttaccttctccctcaaactcattgcttttctcattgtcattacatggataaggagttctaaaagtaaagcaagaggcaagatatttattcattaattttctgttcattaatcatcttctattgtgatgggggccctggaaatacagaatgaataaagcaaaattataacctaggaggatttttagtctaacgagaaatggaaatatgaacaaatgtatacactcaaaagtactaagtgatataccaaatatttaagcaaacagctgtggctgctcagtgcagggagctactcattctctccaggaaaagtgaggaaggcttcataatagccatatggaacttgtcgtgagaatgggggttttcaatgaaagaaaagtcattttaagcaaagaataccttgctgtggtttgaatgtgtcttccaataagttcctgtgttggaagcttaatctccaatgcaacagtggtatgaaatgggctctaataagagttgattggacctttcctaataagagatgattggataaatggattaatgttgttgtcatgtgagcaggttagttattgtgagagtgtgtcattgtaaagagaatctgatcactggagcctctctctgtcttgtgtaccaacttctcttccaccatgctatggtatagcataaaggccctcaccagatgctggagccatgctcttggacttcccatcctccagaattgtgagaaataaatttattttctttacagattacgcagtctgtgatactctgttattgcaacagaaaacagactaagacacagcatatgttaatcacaaggatttcaaacagcctggtgtcttcagggactctgaaattctggatggctggtgtgtaggatgtgtaggatatgggaaaagaataggagtaggaagggaggaggggatttatccaggtaggagaattctgatggggcttcattataaaaggtcttgtatttcatgctaaggaccttttaattttatgctgtaggtaataagaagtaattagaagtttttaaggagtagaaatcaatttggtcaacatcttagaaagggctctgatgacactgtgaaaaatgaactgaagcaggaaaatttagagatatcaaaatacaaaaaaaagttaaacattttttaagaaaaacatggctgattgaattttatgttgccacctagccatttcatggaggggtagttgtgtagcaaatcctgtgccctttttgattcagaaaaaaaaaaaaaaaagactgttcatatgtaaatttattcacactcacagtcagctggaacccagttgcagggtctaccttcaatatatccccaaatttgtcttcgctttatcattattgctatgatttataattcaggctctcagcatttctcaacatttcagggcagtagtgttgcaaaagtgttcaaactggcatccacactgaggtctagaatctgctcactctgtcctagccataaatacagaccagggagaggagacctatcaatactttcatctcctcacatgtcaccttggaaacatggcagcaaaacgagtgaaatgagtatctgccccacagacacaggagattagtgtttgtagaggatgaaaaactatagtagaatatgaagaaaacagtgagattttgataataaatgaaaacattcatagccaggttccaggattctttggaactacacctgactaggatatgattacttcattctcatcatgaatttggaacatataattcttcactaggatagtaagcacagtaaaatatattcaatgaaaaattacagaagatttatattaagcattgagtgggaaactgagggaaaggagtatataatataaaccattactcacattctgccactctataaacctcaaagaaaaatatttcaggacacccccacccaaattaatgatctttgctttcctatggcgaaactacccaaatgcaactttaacttagttttgagttaaggtttagctggggtagccacatagatcactaaattctgacagttcggttggtcttaatgaaatatttggaatcaccaatcacacttaagggaatcaataatcttgtgtcgctctataagctccctgggggcaggaactcgactagtatttgaggaactagtatttgagaactaggcaggcaggcagtttgagcccagacccactctgtttgaatttatatcccactgtaccacttaatagctatgtgttcttggtcaagttgcttaaactcttttttcatctacctaataattatcgtaacagaacctcagaagacttttgtgaaaatgaaataaaatgtaaaattattggccaagtgcggtggctcacacccgtaatcccagcattttgggaggccgaggtgggtggatcaattgaggccaggagtttgagaccagcctggccaacatggtgaaacctcgtctctacaaaaagatacaaaaagtagccaggtatcatggcacatacatgcagtcccagctactgaggaggctgaggtaggagaatcgcttgaatccaggaggcggaggtttcagtaagctgaaatcatgccactgcactccagcctgggcgatagagtgagactccatcttaaaagaaaaataaataaataaaattatttatatattctatagcatataataatggtaaattagtgttagctattactaacttcagtcctctggcacatagaagtgcccagcctattttgttgaatgagtgaatgaatgatggtgaatatacctctaagcaatctgagccttagactacatgaccatctaacacaattaattaaaaacagttccaatatttgaagaagggaagatattctagaagcttcaacccctagtcaaaagtaagctgttgtcacaatgtaaatgatcaacatggtcacttgcaatgtgagttaccgtaactaaatttttcccagaaatttatcaattagaagcttgtgtggccatgcagaaaagcttgtaaacggcagaataaaaataccactggtcatgatgtgaatcatcccgttgtttgggggatccacagtctacactgtgagtcacttagtagccctctcagtgatcagatctgctgtctcggtattgcagtgtttgttttcaagtgaccctcattttatttcataatggccccaaagtgcaagaatagtgatcttggtgattcagatatgcccaagagaaagtgcctcctttgaatgaaaagtttaaagttctcaacttaatattttctttataaattgaagtgaagagggaagagataggtcagaggcatcatataatcagccaagagctggaattggagcattttctcaccctccacagctacgaaactatctgggaaggtaaaagaaggagaggaataagctcacattgcagggatgcctttcttcctttgatcccagactctgactaagggttgcagagaaggctggtccatcctctggttctacctgacctacctaagcctcatctgccattggctagttagcatcacagtcatttagttgagggcaaaaaattgcagtaatgcccccttacctatggttttgctttctctggtttcagttacccgcagaatatattaaatggacaattccagagataaagaattcctaagttttaaatggtatgccattctgagtggtgtgatgaaatcttgtgccttccctcttgggatgtgaatcatccacagtctacactgtgagtcacttagtagccctctcggttatcagatctgctgtctcggtactgcagtgtttgttttcaagtgaccctcattttatttcataatggccccaaagtgaaagaatagtgatcttggagattcagatatgcccaagagaaagcgcctcctttgaatgaaaagtttaaagttctcaacttaatagaaagaaagaaaaaattgtatgctgaggttgctaagatctactgtaaaaatgaatcttctacctgtggaattgtgaagaaggaaaaagaaattcatgctagttttgctgccacacttcaaactttatcattgatgatatatatatatatgtatatacatacatacacatatgaaaataacatagggttcactactacctgtagtttcaggaatccactgaatgtcttggaatgtatccactaaggataaagggacactactgaatacagtcttggacaggacacaatatctatctcttatgatttaaaaaatgtttgattgccagccaggtgcagtggctcacacctataatctcagcactttgggaggtcgaggcaggtggatcacaaggtcaggagatcgagaccagcctgaccaacatggtgaaagccgtctctactaaaaatacaaaaattagccaggagtggtggcacgagcctgtaatcccagctactcaggaggctgaggcagtagaatcacttgaacccaggaggcagaggtggcagtgagccaagatcgcgccactgcactccagcctgggcaacagaatgagactccgtcaaaaaaaaaaaaaaagtttgattgccttcagaatgttttcagttattcgctacagtgttgtttgtttgtttctttgtttctttgtttttctctcaatcagtaagcgaaggaacatcagaaaggtccttaaagtgatttattttaactgataagtagtacttaccccaacattctggagcagtattggactgagccatacatgaacaataagaggaaggaggtagtgtgtctttcttatctgggatccttaacagggaggaagtaagatcagtggactctccccagacccaactttctagatagctaccatttcccacttcactgctccactaaccccagcctagggaattcacagatggtgttctggaacactgatatctaactcctcacgaaactgtaatcttctctggacactatttctcattctttcagcttcgttttgtttcatgagcaggagccacaagctattctgtgtccccagaagtccctataagccaagtgaattatgttttctctcctgttccctctcaatctgacagacgtgatactggaaagaccacttgaagacctttaaaattacccagcagcatactgtaattctcccaaagaagagacagtatatttaagagcatagcttctccagtccttcaatttatgctaaaatcagtcctgttagcatgtaactcaagtttaaagagtttccaggaatctgttgcttttagagagacaagagatcaaattaatagaattatactatttaaggaagtaaatttgcaaaaggaaaaattgtcattctaaactaacagctttcctctctaattattccatcacccctcacatgacctgtactggttgccatagaaacaggtgtcttcatgcccattggaagactcaaaatatgttaacagaatgttagttatttgcccttaaatcttgcttctttcagcaaaataacctatgccaaaaatctgtagacacacaaatacatgctctgttctatatcattggattcacaaagaacagggatttatttgttaaaatgtttcacataatcaaaattcttaacatgtttctagagaaatataggcaattgtttgtagtcagcctggttttacatgtaaacttcactttttaaaaacctgtacgattctagtggggagaaaatgaatgaatgcatgtaaaatctcttagaatagtatctgacaaatgttaagtactcaaaacttttaagatactattatcattattattatttattttattagctttctattttgcctgttttcttttactctgggcttcaattatctaaaattagtttaccctatttgtggcatcacaatgaccttgaagtagagtgtctgtctcagataaatggatgaaagaatgagtcattgaataaatctgggagaccacacggcatggtggaaagtgaataaactttggagccagaaagatttgggtatatgttagtagctaggtgaccttgtgcaaatgacttaacctctgagcctgtttcttcatttataaaatggaagtgatactcatcttgtgggaatgttgtgatagcattggtgtctctgcctcctttcaaacacaactgagaaactctgggaaagtactttgcacatggaagtgggataatggtttaatggcacaagcatgtgcttcagtgaaattgatagtaagaagagaaacaaaggaagaggcagaaggaataacgcttttcattttcgggtgctaagtttttgctaggtaatattctacaatattaacactcttgctccttgcattttgacagaaagaggctatagatagcatttgcctcaaacactagacttggtatactgcacgtcagctttacctttttctgtttaaggactatttacttctgaacagtctgataaaattcagattcagacttcatgaaataaaagttataatcattatgtatttcttccagactttataccctaaggcagagatgaccaaaatcaggttataatacactgataaaatgatatttgtttggcagtttagtttacaaaacgcttggacacccattatctgtttagttttcacaatcaccctgtaagtcaggttattgactccgctgtactgatgtgaatgctgagattcagagagcttaagggatttgcgtaaaattattcatagtttacaaatgacaaaaataggatccttccccatgttttctaataagaattccaggacaatattctccatagactggtttcaggggattcatccattcttcaacaaatatagctgagaaactaccgttagttttaagcttcttgactatgactgtttacattataaatcagttcacacacacataaatatgcaaatacacacatattcataaaatacaacagttacccttttcataggcagtgttaatgctagtgtttctattctaacttattttattacattattaaacaatgatggctatgacctcctaagctgatgtcacaacccatcaattgatcacattctccaattttaaaaatcctgtaaaaaggtaaagagaaaattaaaaactttgaagagatagttgaatagaaaactaaagacaactacaaaagtaaaaaaaatgtgaggtatcctcaaataaaactttagtttgtaattaatgcacagctgtctttcatttattttcctaaatatatggtccatgtaacaacaataataataataatgccaggtagaaatgataatggccataaaagaggtagagaaaaagtatcaacagagttagttactttaacctgacataataaaatcaaaaggaagctatttttaacatcctaattattataaagaggacttatgaatttttttgaagaatgactatgattgcaagacagtagtgtctatgtgtttgtctcttatttgggtatcatcataatagcagctattattcattcattcaacaaatcagtatttattggtcacttgttatttgctaggcactatcctaggtgcagggaaggaaataggtgaaaatccctgcccttggggatttacattctattgatgtgaggcagaaataaacaaaataaataagtaaattatgtcgtagttagtaggtggtacatactaagatgaaaaataaagcagagtaaggagacagtgaacactatgggaaggagtggcaatattaaactgggtgatcaggggaaacttcactgagagggtgacatttgagccaaggttgaaaggagatgagagagccagtcccatgtatatctgaggaaagagcattccaggaagaaagcacagcaagtgcaaatgtctcaagtaagaagcaacagcaaggatgccagtgtatgggaatgagagaaaaataatagaaagcgaagacagaagatgatgtagattcgatcacataggaccttgaaggcagttgtaaggactttggcttttcctcttagataggataccactgagaggttttgggcagaaaacatagaagattgtgtcaaaactgacctagcagcccagtagaggataaactgtaatgaggtaagcagagaaaccaagtagggggctatttcaatcattcagttgagagatgaaggtggtagagtggaggcagtaaggtttgaccagattcagagccaaaaggaggtcctgacacactggaagtgaaaagtgagggaaaaagaagagtgaagaatgactccaaggtttggctagagtaactgaaaggatggaggtggcactcactgagatggagaagcctggggatggagtagatttaagagcaggagtttggtatttgacatgttatatctgagctgtgcaatagtaacccaagcagagatgttgagtggacagttgatgcacaagtgtagaattccgagtgacccaggatggaaagataaatttgaggtcagtgggttatgggtggtatttaaagccaagagactggatgagctccccacaaaggtgtataaataaaggagagaaaatgtccaaggatcaaacctcaggacactcccattttaaaaggtcaagtacaaagaagatggagaggccaggtgtgatggctcacacctataatcccagcactctgggaggccgaggtaggtggactgcttgagctcaggagttcgagaccagcctgggcaatgtggtaaaaccccgtctctaccaaaaatacaaaaaaaaaatagccaggcatggtggtgtgcacctgtagacccagctacttgggaggctgaggtggaagaatcacttgagctgatgttgcagtgagcagagatcacactgctgtactctagcctgggtgacagagcaagacccatctcaaaaaaaaaaaaaaaaatggagaaggaatggccagtgagggaggagaaaattgatagagttggtgtcctaagagcaaaatgaagagtaagtatcaaggaggatggagtgattcactaccataaatatggttgataggtcaaatacagtgaggactgagaattgacattacattccaggaagctcaacatataatctcttaaatcagactctctaggttaaatactggctctgtcacttactgtgtggcctaacagagacccttaagctctctaaatactgggaaagggtgggactggaaatccttgtgatctttagcctcagtgaagaggaaaaaaaaacaaaaatcgtttgagaaccattctaatgattgacctgctaaagtggtattaaggcttcctaagtctctgtagggattcatataatttgattttaacacaaactttgacaaaagtttagaaagacatatgctcttaattttccttgccaactcttattggtgaaaattgaggtcttgaaaattactgtatctactccagcttggtgacagagtgagaactccaactcaaaaaaataagacagaaattactgtatatatatatatatatatatatatatatatatatatatatatatatatacatacatacagtacacacatacacacacagagtaatttctgtcttttctgtcttggaatttctacttgtatacacacacacacacacacacacacacacacacacacacacactcctatatagaaattccaaaaaactaaaaaatgtatatattgtgtgaaaatagtagaaatgtatttctccctcatctggttatcctatcaaacaatatgagcaaatattgaggcaattagagttgaatctcttcctcccagaaacatcttttctaccttaaacaatagtgaaaactggctgcaaagagattccagtctttatttagactattttttacagggtttccatctcccatctcatttcagtccccaccccattatatggccaattattagttatatctgacaatatttttttttattttccagttttgcttccacacctaactggctgctaacctgtcccacatttcctgtgaaaggtgtatatgtgtagttagaacacacacacacacacacacacacacacacacacactccaaacaggattgtgtgaatatttcttgctcaccttgtaatgaaaaattctatggatggacatgtaatacacagacaaacaggttagtggttaagaatgcagaattgagacaaactggccaagtttgaatggtgcctatactatttacaagatgtgtgacactggcaagttttttctcatctctgtgtcacaatctcatcaagtaaaaaccaaggatattgagaataaaaatctcataggtttgttgtgaggcttaagttaatatatagcaagggctcgaaatagatcctagcacaaaatcagcattcagtctgtgttaactttcataatggtgatgaagatgatgataattgagatggggataatgctaacagtgattatgctgctggtgatgataaagatggaaaattagatctctaccaccagctggctgggttacctgggagtacatcttttaacctcttggtgtctgtttcatcatctgcaaaataagcaagttatgttagaaaaatctaaaataatgtgttttaagtagctaacttcaaatgtttttattaggaattttctaagttaagtaagtggatcaatggatagatgaggtagttttaaaaaaaactctgctacctaaaatatttcctttgttttgttttttacagcttccagcaagaaatgcatccctgatcctatagctattgcatctctctcctttttgaccagtgtcatcatcttttccaaaagcagagtataaagaaatcttgtggctccttttatttaaaaaaaatatttaaataaaatcttttttattggccttttggctagaaatggacatttattttccaggaaggatgatcccatcatacttctgctgaaaccagtgcatggcctcctctttgctaattctcttatgcctttccttgtacccctttgccttatttcaatctgggcaccctaagtactcttggggaaatcactctgcccagctagcaactgatgcagagctggctcagcccactgactgtgattggcctgtaactcaggccttagccaatcagtatatttcttcttcatggacacaaagattcatgctggaatagaaaatgatccaatcagagcctgtgagatacaatcagggtacttttgtggaattgcaattggaaatagaatgggagcttcttttctgaatggatattaatgaaagcagggtaggagcttatagctgccagcaaagatcccgccaccaggagaggagaccccatctccttgagaaaggatctaacacaacaaaggaagagctgataagtgaaaagaaactgagacctgatgagaatgtataagcctctggatccaactttgcctaaagctgaatactacaagatttttcattacataaatcaataatttatgtttttgcttgcataatttgaattagattttctatgtcaagcatcaagcagttgaagttccaacgaatacaagcactcttccttatttttttttaatttagttattctaaataggaacaaatcaaagaagattaaattagaaagcaaaggacaaattcttcaccaaacagaaaagctttgaaccccagagattaaccaaggtgtgaattttcttcagagattttttatgagcattcaagattaagctagtatggcctcagatgagaagacacatggaaacttgagaaataaaagggaaagttaatgaaagatgttagtgaaatttcattcaccagcagtaatgggtgttcatgcatgttcctaagacattacaaaagttaaaatttaaactcatatgttaattcatagagaacttgatggcaaatttaagtcttcatagcaaatttaaatattaggaaaacatgagggtatgtgtgaaggttaacagagagtatgagagaaaaaaacactgattacaaacaaatatcagcaatatagcgaggtctcattacatgtaaactagtacatgcaaagaagtataaattgttgaattgtatagctggaaatgtcctctaacgcttccctcaggtagtaatttaggtagcgacataagggattatttaacccgatcacgatcactgaagaccctggtatcaggctaaatggagtaaagatgagggctagctctataattttggattttgaaagtccatgctccttatcccttttaagatttggataagaaacagcaaaactgaaaatcggtccatctatttactctccataggacttcctgaatggcctgtgtcatgatcaaagaaatggaatggggaataagctacataaaattacctggcagggagttcaggcatctctgtactatcattctttaaattgggatttgaaactaacagggccaaatcacctctgtcacctagttgcagtagcctctacagtcaataaaggaaagaatttctgccaggcatggtggctcacccctgtaatcccagcactttgggaggccgaggaggacggatcacgaggtcaggagttcaagaccagcctggccagcatggtgaaaccccgtctctactacaaatacaaaaattagccaggcatggtggcacgcacctgtaatcccagctacttgggaggctgaggcaggaaaattgcctaaacccaggaggcggaggtagtgcagtgagccaagttcacaccactgcactccagcctgggcaacagagtgagactcgatctcaaaaaaagaaaaaaagaaagaatttctacaaacagacaatttatgtgacttgcataggatagggtctttggcagtttggtggctacctagtagagagtcctgggga

SEQ ID NO: 14065 - DNA, 18367 bp, Human
agtaggagcctccagtcttctgcttatggcataaaccttgctgtcagtactctagaagtcagggaggaaagggcttggggatcccacttttctccgtgagactgttaacaaacctcctttttcagcacagttgcctcctttcccttctgtgtcttgtgtcaccaagttgggtatctctctgattaaatttcttggtaaaacaaagctggacgatgagtacttgtctctctgccccaggtgcagcagtgtacctgctcctcattgagaccacttcccagcttaatcacttaactcaccttttacaggacctgaagcctcaaatcagtacgcctctctggggttggtgcttgttgggttcttcctcaacagggagctttctctcgtttactcagtaggttaccaaattcatacacttcacatctttttaattcttacatattgttctctttggtgttctttcgccttgtgtgatccactcattcatgcattcactcattcaacgaatattttctgaacaccttctctgtgcctggcactgtgtcaggtgaagtggatgcagtgagccagtgggcagaaatctcttccctcatgtgccttacattttaggagcatgaggcagagaataaacaaacaaatgacatataccgtatgtcagatgatggtcagtaacacgtgtgggaaaagataatgtggggaagaggtagagaacatgctggtcagagaagccccacagataaggtgctatttgagctgaaagctggcaaaagtgtagaaacaagccttgcagtagaaagtgaaggaggtcctgcagctctgggctgattacctgggcatggttaggtgctcttcctctgctccttgagcatcttgagcatgctttaattataacacttatcatcatgtcctattgtgattattaaatcacatgtctgtttccatgacttggcagagccgctcaacatctggaactttgtcttactaacttttatattctcagaatctaatacatcatattagatgttcagtgcataattgttaattcaatgaataagaaaggaaaacctcaagtaaattgctgactagaatcaagccctcaagctctgaatttagggttaggagcctgggttaggaagaaagactgtatatatgcttttgaggcaagcagtcagtgagggaatgaggcatgattacttgcaggtggctacaagcaataaaaatgcggtcaaaaaggttagcagagggattgccccactagtagataggaactgttacaacagcctgtgacaatgaagacagattgcaaacttcctacttaggcacagatgagaatgtaacacagaagaaactggccgcaactggttaaagccaagatggtcgaaaacttggctgactgctgacccttagcttcattatgcccttaatatcataaaacttccatggggaaattcccactcccatcatgcacctgacgccatgacagttccggattaaccatctttagtcaagaaaagggtggcaccccgattccgggaattgcccgcccatttcccagaaaacccctccccttgattacagagtactccataccttcattgtgcttattcatatagtacgtgaaccacattgcctgtgactcaaatctttgagtgcctgcactcctcccttgagggtgtcgttggttttgctccacaataaaatgtctatactttcgcttgggtctcattttcagattctcttatgctttgaagacaagaacctgcactgccctactggcaacacttttagataccctctgagatcagtgtgcttgtttataccagaaaaatgtcatcaccaggccccttagtcacaaagtgtatcaagaagtcatctgcggtcattttttacagtttctaggccactttctgtttccaatcagtgtagttcctatgtggcatgactcagatacaagtttctatagacattttcttctgtggctgctagtgagaacccaaaccagctcagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggtaagcaccatagaggagctgggttagagacgagagacttaaccgtttctctgctgaaaaagacaactgaggaaaggccagccatgctgtgcacacctctgagaacctgaacctgcaaacatggacatcagctctgaaaggatgggttcatttctcttttattcactttagccatgtcctctggtgtctctgagctggtgttccttaagcttcggcttcctttggggtttgtctatcagcctatttgtaaggctgacttttatgccaatagcaaatacaagcattttttaagttaacagatattatgaagtaaaatgcaagtttttcatttataaggcaacataacttcagagaaaaaactgagtcaatcatataaaatgtgattaaaatgtgattgttattatataagagggttataggaagattagcttcttatggacaagtagaaaagtaggaatcatccaagctgattgtcacagtagatattcaacaaaggtagtgtccttccttgctttcatcagtaggatgggggcatttggatggctttatcattgcaaatatttttaatgtattccttattttgaaaatggtcctgataatagttttaattttcactcatgaactctacatgtataagtagagtttctccagcgcttaccaacatataggaaaaaacattataaggccattaacagtgatagtttagaatttattaacattgactctactgatgggggtattcaagcttccctaaaattcacaatcagttattttcagctcataaacatcttttcctgttctttggcttatttcttccactttatatgttgctgctctggaagtcattaattgctaataatgtcaaacatcttttttatgtttattggatatttgagcaaattgctcattcacatcttttgcacacttttcaaatagactgttgttttcttattgatacatggttctccatgtattccaaaagcaaaacctctattagctctctctctctctctctctctctatatatatatatatagcaggtatagccatatatatatgtgtgtgtgtgtgtgtgtgtgtgtgtgtgtgtgtgtgtattgcaggtatctgcccagtttttgccttgtataatcactttgtttagtgtgtgtgtgtgcacggatgtgtgtgtttcctacaaagaaattgagaatatgcatgcaatcacatttgacaaattttttttttctggcttgtcctttttgtgccttatttaaggaacctccttctacttcaatgtattgagaaattctgtgttttattcaacatcattactattctatttagataattaatccaaccagatatatattttgtgtatgatataagagaaaggctgaatatatcattccctgtgtattgtcatttgtctgaacactttttatagttggccattctttccttgtgatttttaatgccactttgattatataccaagctttaatttacatgtggtcctgtttccacactctatttattagttcatttttttctacgccactgccatactgatttaataattatacatttgtagtaagtattgatacctagtagtagggatagtacatcctgataaacatattcaacttgttttgcaggtttttgtctttatttttttcatttaggttttaggatcattctgataaattctatgaaaaaccctttgagattttggataggagtttatagattaatttgacaacactgctgtcttcattttatcaaatctttccatttaaaatatcagacatacacccacttaagtaggtcctttaaatctcccaataaagttttataaggttccctttaaaactcttaaatatattgtattcgatgttcttatgtactttgtagttttgttgctattggaaattactttttttatgtaatttttttctctcttggagtggtactaaaataaaggaatgcatttctgtatattaatcttatagttataaactgttgaattattatttataatgttttgtgtattattttggatactatacataaacaactatattactacaacgtgattttggcaacaagttacaaaaataggttgatggacagaataaagaatccagaaatagactcactcatatttggacaactgatttttgcaaaggtaaaaaaaaaaatcattaaaaatgacagtctttttaacatatgattctgggaaaattcatattcatatgaaaaataaatgaactttgaatcatcacttatatcatatacaaattaactcaaaacagtacatacagccaaatgtgaaatgatcaaaccgtaaaattcttacaggaagacataaaatcttctaatcttgagattggaaaagatttcttaaataagacactgaaagcatgatccatgaaagaacagattgattaattgcacttcatcaggtatatgtatatgccaaaatttatcagattgtatacttccagtgtatgcaccgtgttgtatgccagttatgcctcgataaatctattttaaaaataacaggaaaatgtatcctgtttcctttttgttgttgttgttgttgttgttttgagatgaagtttcgctcctgttgcccaggctggagtgcaatggcgcgatcttggctcactgcaacctccacctcccaggttcaaataattctcctgcctcagcctcctgagtagttgggattacaggcgcccaccaccatgctcggctaatttttgtacttttagtagagatggggttttgccatattggccagtctggtctcaaactcctgaccgcaggtgatccgcccaccttggccttccaaagtgctgggattattacaggcgtgagctaccgcgcccagctaatgtatcttgttttctgagaattccagaggtgttgtatactttctgaagatgtctttcccaggagtagtgatcaccttgcttaagaagttcttacctatgtcctactcaaatctcttttactactgcaaatattttatttttctttaaaaaatattaatagctcaccttgctttattttgaatgtagaatcacttttggtggtgtaatcttacatgttttggattccttataggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaaggtaatgtgggagttccacacctgccccgtccctttttctgccaagcctgggcctttcctttcatggcatccctgggatatgacccccagtgcacattgttggaatttgtttgctaacttagtgcacctgtctctttgcccccttttactgagaatcgcttctaggaagtgtttgttacaaattccacaaatccattccagcctttgtttgcatctcttcttccagccttagggttaccacttccatttaacatcttttctccttgcccatctttgtctccagttcagttgcagtgaatatggacgtagaatttcaaagttaacttctcccaactccatttacacagtatgtaatgctgtcacattctactgaagtcttgaaagtataaattattgcattggaaaactgtaaaccaggatattgagcaccttttttccttcacacagtctgtctattcctctccttgtccccagctttctgtggtcccagactatccttctttaggcgatgatctcctccttcttcagaagggagggagaatccaccttcagggattttctttcctctctatctccagtacaggtgacagtataaattacccacaacacaaagattttttttacattattcaataaatcactcatctccatctgaattatctacatttagtttaaattcctgattttgtttactaagaacaattgatatgtcccagctttatgtctgaagaacaaaaaggagctaacagaggagcatatcactcaaggactctccaaaatgaaagtctccaaatgcaacagttttaggattcaaagtacaaccgtagcagcaaaaattataatagcttttagtagcatttgtgggtgtacaacaagggtgacatggcttctcacacatgagttataggaaggctaaatgaagccacataagtgatactatgtacattcataattctatacagatataaactgttaggtagtttctaaggcactaaagagaaaggagtggtggttttcccaggctttaagttagaaggtgtagttcttagagatggcccttagatggcagtaactacacatgttacttccaagtaaccaaccaaaacattgccctgtgtttttcttatctgggatgagccaggaatctaggcatattggcaaacataggctgagatatttagaaatatcttttattttggtaataaatcaagaattaattcttctctttgaccaggatagaacaaaatttccccttctacaatcttctccccattttgctattctaatgattctgggattttgttattctgcttagctaaaaaagatccagtttgggactagcttggaaactcaggagtagattatccaaggactctcccaaatgagagtctccaaatgtaacagttgtaggattcaaagtatgcttttgggccaggcgcagtggctcacgcctttaatcccagcactttgggaggccaaggcgggtggatcacttgagttcaggagttcgagatcagcctggccaacatagtgaaactttgtctctactaaaaatacaaaaattagccaggcatggtggcgggcatctgtaatgccagctacttgggaggctgaggcacgagaatcacttgaacctgggagggagaggttgcagtgagctgagatcacacctctgcactcctgcctgggcaacaacagtgagaccctgtctcaaacaacaacaacaacaaaacacaaagtatgcttcttgcatgctatacaagaaggcagttaagttccttcatagctctaaaattctatccacggacatacttaggccgcttttgaatgtaggaaatttttgtgtgtccatgctatttctattattttaggaaaacagtttttgttttattttttgaacagttaatctgtcattcttggttaagtgatccttctccattgccattgcatgtctgcatgtagagtgctatatgctattctactcatgacctcacctcatggaaggtagaagatacctggagaatctttaatgaagacagaggcaataattagtagacaggagaagcttttgtatgaagcaagatgagaaaatataaggacacataagcgtagaaaaaggaagctaagagaaaatgtgatcaaagtccacaaaagtcctgcaagattaaaataaaatgctgaaaatgataaatgaaataatcagtaacaatgtgcacctgattattaaggcaaatgagagatttataattggcagacaagcttgtccacaaatattgcattggtaccacagtgtgtgaaatgaaatatggctgatgtgatgtggtagaatggtaggttgattccttccgcctcccttgatgctgttttctctccgatgctgtgaacatagaagagagactttatctgcatacctttctgaaaccaatttcatggaactaacttaccattggaaggttagtttaacttcttcctagtgcagagatcctgctacaatatccctgtcagacagtcaaccactttctgatctttgaaaggtaatgacagagtacctactacctcataagacagttcattctactcttagctctaataattaaatcgtttctctttttagtaaaatcagtgattgccttgctatttcagtccagaattgttcaaattctatcagaaataacatctaataatttcccaggccctcttctgcctgagagtgccttaagtcatcaaacatggccatcttgttacatggtctttttaaaaatcaggagtaggagttggcttttcacgataacatataacctgaccatagacgtggaggagcccagccagagtatacgactgcattttgtaggcattagtgaggagccaacatgccacccatccatccatttcttcatccattcagtaaatatccattgaattgctaataggtacaaggaaagcttttaggttcttatgataaaacaaggttttaaaaacaaatccaaattttgtacagtttatactctaaagggaaagtagatatttttcttacaggcaaattaatgaatgtaactaactgagacaaatgttctgatggaaaggaagatggttcttcagcagcatgtgtcaaaggagcattaacataagccaggagttagagttggtgttggtcaaagcgggttccatggggaagtgacttgcactaagctgtgaaaaatgcataggagttaaaggtaccttcagtcagagggaacactgtgtgaaaatccctctgacagcaggtgttgacttgcttgaggactgaaagaaggccagtatggctgcagtacagagaatcttcagagggcaggatggggtcccctcgacagaaggaaaatgcaaggccttgtagaacataattagaaatctgtggccaggcgcggtggctcacgcctgtaatcccaacactttgggaggctgaggtgggcgcatcacgaggtgaggagctcaagaccagccttaacaacatggtgaaaccccatctttactaaaaaaatacaaaaattagtcaggcgtggtggcatgagcctgtaatcccagctactcaggaggctgaggcaggagaatcacttgaacccaggaggcagaggttgcagtgagccaagattgcgccactgcactccagcttgggtgacggagtgagactccgtctcaaaaaaaaaaaaaagaaagaaatcagcccttgtttcatagcagcagtttattcattttcactactacataagattccatttaattgataattacatatacacataaactgatatacatatatatagagagagagaattggtgtatttttattgttattttagtcattggaggccattatgaataatgctgctatgaatatttatgtacattataagccttatatacttatctttgtatgtttgtatttgtatgtgtgtttctcttgactgtacacctgtgaatggtattactggatgttaaggtaagtagatattgaattttaataaatagcgtcccaaaccattttccaaagtgttataccaatttaagacgactactacttcatagtttttgtttcttgtcttttttttttttttgagacagacagggtctcactgtgtcatccaagctggagtgcagtggtgcaatcatgactcactgcagctttgaactcctgggcttaagttatccttgcctcagcctcccaagtagctgggactaaaaacatgtgccattatacctggctaattttgaaaatattttttgtaaagatagggtctccctatgttgactaagctggtctcaaacccctggcctcaagtgatcctccagccttggcctcccaaagtgctgggattactggtgtctgtgccaggtccagtttctttcattttaaaatatgatttttttttaagaaaaattagctgttcttgaagatatcttaatatggttttagtatttattcctggtgacatttgaaaatgtgcactgctcatatgtttatatgcttattggccatgtctttcattttttaatcagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaaggtaggataaggagagtggagtggtctttgtccttgtaagagcatcactgtcactgtcacttcccatattgttctctgttctttatctcacagcatgcaaataagggaagcaaggccacagcatgaaaagcattctgagtcacaaaaacaggaactacctttgattcatcagattaaacacctgttgagcttctaatctctgccaggttctggacacattaacactttgttatgttttggattctataagaagaaaactctgagatagaccgttgtttacaggaagtctattttagagcactttcagaattaatatctgtgaggaagtgaaaggagaagaagaggaagaatgtcaagtccaatgtagttgcaatagaggccttggcctaccctacagggagctcgggagctgagaatgtctttcagggctcccaagatttgtgagggagtctgtggtttgtacaggcccaggctctgggtcacatcagagatccaattcagagactctgacactcggtctggcatgcctctgtttgttttctgcttggttcttgacagcaaattgcttttttaaaagtaatgtaaaaaagccctttatacacctgcatggacaaggtgaggtggccccatttagctgagagagtagtggctggagagtgtcattggtgagaatgattactttagtcctgagggagtggcagacaacgttagaaaggcccagcacagaatccaccacacatgcagtttcatttcctatgaagcaggtattacattattttatacctgtgtgagctctaaaaactgatgatatatacttcattctctttgtctagaggaaccatttcctctgggtttggcccagaaacttctggatttttcaggaaaacaaggttcaagtataaatggtgtgattccctcatcagtaatgaaaatatgcatttttcagtctggaagacccaaataaagatacatggaccaaagagaaggacttctgtagtggacctcagtggagctgacctttccctgcattgatccaaatgcagtcagttatgctgcccatcagggccccttactggcccaagctccactgccccaagctccaggtcacatcagagacacccttcagagactcctacgcttggctttttatgcctctgtttgttttgccctgtatttccctttggttctaaatggcaagtggcttttaaaaagtagtattttctcccaaaacaaaccaaaaagaggtgtcttatctctgttaattcagaaaaataaaaaacacagagaagagaataaaattatctataattgtatcgtctaggaaaaaaatacattgatgttggtaaatatctctctagtgtgtttgtgtgtgtgctttaactgcttatttatccaataagaaacagattgtttatctgtttaggacctttccctttattgaatcagttataacagtttatcatatttctctaaagcatttttaatatttgcacagtaatctttttgtgactatacctattttatttaaccaaatctattttttaggtatttaaattatttctttttttataatttcaaataataagatgtactttttaaatataaaccttagtgcataattcattatttaagggtaaatccataaatgtagtattaattctccttttaaatttctcctttaactcactcataagatctctgaactaggtctcccccttaactcacattaaatgtaatctgcattttgttatgtacaatgctccctaggaatttggggagccctgtgctggtcactgagctccctcacttttataccagagtaaaatgaacatttaggacagtattggatagagaaacaaggacacatgcccgaatggaattgatagaagatggaatcagatttgtcagatttaccccgaggcttagcagtatttcagaaatctgatgaagtctttatatatagtacatggcaaagcaaggatttggtttcagggatcctacctccaaaacgtgttacaccgtcttatctgaatacaggagtcgaaatcttccttctgcactctctgttctatctggatcgttctaggcctcaactctcttcgtatcccctctgtatctcttcccttgattccacctatcttctgctggctttctgaggtttagcactgtaggtgaagtaaggtcctttcaatagtacctttttgactcacagctgatatctttcttctcttgtcttcagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaagttttcatatctaatttcatattgattagtaagaataacgtatttcccatctgatcttaaagaaactttggaaatggttttaatgtctttctatatagacaaaataaaaaaatacaaagttctaaagagctgcagagtaaacatgccaaaattcatacaaaaactcaaaaattgtttttattgtcaaaaatgtcacgatcctatttcaacttaccccagtagcctctgaaaaaggaattagttcattcacataatttttatttctgcattatttttgtactttgtacatattatctttattttaagtgactatagttgtgattatctttattttaagtgactattgttgtgaatgcaaagtaagtgtagttgagtaataaaccagattaatgacctgaaaaaccaatacgcaaggcaggattaaagaactgtgattaaatgaagaaaacagaagaaagagttagcctgaggagactttttttttaattaaaaagtaaactttaatgtcaaaaatgcaaactgggggaagacagaaaagatcacacacaaggctgtcacttcacacttggaaggttgcacggcggccgggcagaggcgctcctcacttcccagacagggccgcggggcagaggcgctcctccaggatacttattagaagtgagaaataataaagtatttattatgattctgagcctcagggaactagccttgtgggatgactttttctggtctagggcaggacctaaagaaccatagagagagaacctgctgcccctgcattcagagcctcagaataacctctgctgccctgggttagtttcagaaggaattgataggaagactctccagtcctcctggaaaactcaagtgtaaaatgaccttggataggaaagtcatgttctttatcccagttttcagctttcaatctggccagctatccactcatatatactgatttagtccataaaattaaacctaaaatacgatcaatctcctaaataactgaccaacctcctgttccctttggatctagacttgattgtgaattgtttcttgtctttgattacttactagactcttggctgggtcttgcatcattacctcatgtctctcctggacttgttttaaatagctctcttcaggctgggcgcggcagctcatgcctgtaatcctagcactttgggaggccaaggcgcatggatcacctgagttgaggagttccagatcatcctggccaacatggcaaaacctgtctctagtaaaaatacaaaaattagccgggtgtattggcggacacctataatcccagctactcgggaggctgaggcaagagaatcgcttgaacccagggcgttggaggttgcagtgagccaagattgcgccatcgcactccagcctgggtgaaagagcgaaactccatttcaaaaaataaacaaatagaataaatagctctcttccaacccagggtcttcttttttcccttgactaatctggctgctggccctggagaagctccatcttctctatccagcagttgttgcttctatgggccaccctggcctcctcctaaaggaagggaatttaggactggaaagataggcataggagacaacatgttctaagtaagacacgtctgcctcctctgtgtgaacttgctaacatctattagatatatacctgctagtttcaaagcagaaacattttttcaagttgtcccttgaacaatgtagggattagggcttctgaccctgagcagttgataatctgcatataatttttgactccccaaaaacttaactgcttaatagcctactcttgatcagaagacttacggacaacataagcagtcacttaacacatatttttgtgttatacatattatatactatattcttaaaaagtaagctagagaaaaatgttattaataaaattataaaaaagaaaatatactaactattcattaagtggaagtagatcatcataaagttcttcatcctcattgtcttgatgttaagtagactgaggaggaagaggagggttggtcttgccatcttggggtggcagagacagaggaaaattcccatataaatggacctgcacaggtaaaatctgtgttgttcaagaatcaactgatttctttttagagccttcttctggcatgtctgatgtgtgactgatgcggcattcattaatccgattatcagaggctgggtgttgattttcttttataggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggtgggaactgcatggaacaaagtcaactctccaagggggtgatattttttgttttctatcagaaagccggactggagccattgaacaggatatagagtggaagacattgatatttagtacacgttcatctcacagaactgaggaacctccctcttaggaaacatgtattctagatacacagttaagagaacatgggcttttcaaggcagaggcgcatattgttgtgcccacagagcccaaaaaagagctccttatttatactacaagtctaaagcagaaagcttgcccagagtcggaaaagtcattctgactaatgtctttgaaagtagacagacaataaatactttgaggacacatttccctagccagtcccaccacgtctgcacctaccatagtccagtgcagttaagtccatgtaaacccctactcttgaccttccaccacaccctcctacccgtgtcctgccactacttggtgctcttccccaggtctcagtgttggttgcactgcctgctatctctgtaagagtggaggccaagatttgagaaatatgcgtatgtgaccttgctaagtgggagtgtatttctcaggtcagatattcacttcaggagtatgatccaaggcagaccaatgtattagaagggtgggaacaaaataattttatgagaagatgatacatacacttcagaaggccatagtgactgcaaacagtggaggggccactcatcgactgcatctcagactgcatgttttttttctccatccaggttattaaggccaaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattcattacagtcccactatctcatttagtttgtcaatcccttgtctcaagcgaaaatactttatcaatgtattatatgatgtttatacaaatttaaaagtaaactatatgacaacaattgcacaaaatacaagagggaagaattaggagtacactgttagaagatcctgtacaacatgtgaagcagcgcagtattatttgaaagtagatactgaataattaaagatgtatattttgtcccatagggcaatgatttagaaatattttaaaaggtatagaaataataacacaattttgtgttattggagaaagaataagcataaagcccaatggaaaactagagagccaaaactaggcttgcacatttacagtctattgatttctacaaaagtacaacacagttcagtggagaaaagactaaaaaaaaagctacaacaacaattagatatccatacttaaaaaaatgaatctgagccattcctcactctttatacaaaaataaactccaaacagatcattggcttttcataaacagctaaaaccataaaacttctacaagaaaacatgggagaaaatctgtgtgatcttggtgtaggcaaagattaaagatttagatatcacaccaaaagcacaatctacataacataaatgcttaataatttgaacttcatcaaaatgaagaacttctgttcttcaaaaggtaccattaagagcattgaaaggcaaaccatagattggggcttaatatttgttagtcacacagctgctgaagaccctgtatccaggccaggcacggtggctcacacctgtaatcccagcactttgggaggccctggcgggtggatcacctgaggtcaggagtttgagaccagcctggccaacatggtgaaaccccatctctactaaaaaaaaaaaaaaaaaaaaaaaaaatagccgggcacggtggtgggcacctgtaatcccagctactcgggaggctgaggcaggagaatcacttgaacccaggaggcggagtttgcagtgagctgagattgcgccattgcactccagcctgggtgatagagtaagactctgtctcaaaaaacaaaaagatcctgtatccagaatttataaagaacactcaaaattcaataattgcagaacaaccaattaaatgtttaaaatgggcaaaaagatgatacatggatgtcaaataagcacataaaaatacactcaacataattcatctttaaggaaatggaaactaaaactacagtgagatgccattatatatttattagaacagctaaaatttaaattaaaatagattacccataccaagtgctgacaaagatttggaaaaactgaaactcttgtgcactgctggtgggaatgtcaaatggtataacctttatgcaaaagagtttgtccatttttaaaaacttaatatgcatctacaatgctaaggtctgagaaggatacagagcaattgaaactcttacttattgctggtgggaatgaaaagtcacattagaaaagagtttggaaatttcttataaatttaaacatatgcttaccacatgacacagcaagcttgctgtaagttttttatccacttgaaataattatgtatgttcacacaaaaatctgcatgtaaatattcatgaaagtttatttgtaattatgcaaaagtgcaaaaaactcgattatccctcacctgaaaaatgaataaacaaactttggtagatccacataattgaattgtactctgcaataaaaagaataactactgacacccacatctacatggatagatctttactctaagtgaaagaagccagactcaaaattctacatacattttaatttcattttatgacattccataaagggcaaaagtatagtaaagactagatcagtggtttctaggagcttggagttgagaggaaggccggcaacaaagcagcaggaaggaaatttttgttatgatgaaactattctctatcttaacttttgtggtagttt

SEQ ID NO: 14066 - DNA, 50186 bp, Human
  misc_feature (1)...(50186): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaatcagcaccgtgtgtctagctccagggtttgtgaatgcaccaattgacactctgtatctagctagtctggtggggccttggagaacctttgtgtccacactctgtatctagctaatctggtggggaagtggagaacatttgtgtctagctcagggattgtaaaccaccaatcagcgccctgtcaaaacagaccactccgctctaccaatcagcagggtgtgggtggggccagataagagaataaaagcaggctgccagagccagcagtggtaacactgtggaagcttccttctttccctctgcaataaatcttgctactgctcactctttgggtccacactgcctttatgagctgtaacactcaccttgaaggtctgcagcttcactcttgaagccagcgagaccacgagcccaccaggaggaaagaacaactccagacccactgccttaagagctgtaacactcactgggaaggtctgcagcttcactcctgagccagtgagaccacgaacccaccagaaggaagaaactccgaacacatccgaacatcagaaggaacaaactccagacacgccgcctttaagaactgtaacactcaccgcgagggtccgaggcttcattcttgaaggcagtgagaccaagaacccaccaattccggacacagtaccatgaaggaatgaaaatacataacaatgtgatgtatcatgttttatttcctagcactagtgacaaatgaaagctaagtgtagcaagggtgcagggacacaggcacatttgtggactaggtgtgagtgtaagctgggttcgatggtcttttggccaacatagtgaacccctgtgtctactaaaaatacaaaaattagccaggcgtggtggtgcaggcctgtagtcccagctacatgggaggctgaggtgggagtatcgcttgaacctgggagacggaagttgcagtgagccgggatcacaccaccgctcaccaatctgagccacagagagactgtctcaaaaaataaaccacaaggaagggaggtagggggagggggagggagggaggaaagagaaagagagaaaggaaggaaagagaaagcaggaaggacggaaagaagacgaaagaacgaaagaaaacgaaagaaaaaaggaaagaagagagaaggagagaacagaaggggcaggtgcccctgggaaggggagaagatcaagacgcgcctggaaagcggactctgaacctcaagaccctgttcacagccaagcgcgcgaccccgggaggcgtcaactccccaagtgcctccctcaactcatttcccccaagtttcggtgcctgtcctggcgcggacaggacccagaaacaaaccacagcccggggcgcagccgccagggcgaaggttagttccggtcccttcccctcccctccccacttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtgagtccccgccgcggtccctggctggggaagagcgtgcctggcgcctggagagggcagggagagagggggacacggcgggggtgcgtggcccgggtcgcctgcggccgggcatgtccgggcaagacgcaccagtcgtcggagtcgggggaagagatgggtccccgggttgggcaggagcgacctgggccgccagggaacagagcgcgcgctccacttggtgtaaattcccgaatccagtgggggagggcgacaaggagggaattcccgagtaagctgcgtgaagccacggagaggtcgtcggactttgattttgttttctttccttactttctgtttctttctctttttctctttcttcctttctttccctcccttccttcctcgctcagttcctgccttaatttctttttcttttgcgccttcgaatgaattcctaaaggcgctcattgcagatcgctttgaacctgcggccggcgaagaactcccctgtggtcgctgcggcccagtggttccgttccgtgcgcgggagtcgtcgcgggcgcagctggagaggccccttcccctccttagcggctgcgcccctacgcgtgcggggccgctcatcgccaatgccattgtttggggttccttgggaaaacgagatttaggagaagggagttgtggcacttggggcctgacctgcttgataatagcagctgcattttggcctgggaagagcctttcttgccacctcttggcaagtatctgtgataatggggaagggacaaagagtcggctttgtagggaacagcatggtgtgctcagcgcctggaactgcgcttggggccaggagaggttctgaatcatcacattttacagaggaagagaccgcagctcagagtggggaagtgtgtgggcctagacctaactcaagactgtacagaggggctggaagggagaggaggaacagtgaaaggaaggtcaagagaatgctggtgttgacctagaagaatgtcagtgtgaagcattggagtttcatgggatattgttacacacctcatgttttcactgtttccgccccacaccacagtatgtccttggtctcacctctgagtggagggaggaccgaactgtcctagtgaggagagtgtacaggggcctctgcctccccctcctgctgtggtttctgtgggcctaggtccccagggcatcttgcctctctttgggtggtggatctttggtctctggctgcttttaaagatttttcttagcactggtttgcagtgatttggtttgtttgctctgttgtggggtttttttttttatctctataaagaattttttggatttttggctttagactttcatgttccttctacttggaagatttttctgtaaagaaagccacaactgggttgtgttgaatttcttggatttggggttttagagtttatgttctccttggagacttttctgtaaagaaagccacaacagccgggtctggtagctcatgcctgtaatcccagcactttgggaggccgaggcgggcagatcacatgaggtcagggattcgagaccagcctgaccaacatggtgaaaccccgtctctactaaaaatacaaaattagctgggtgtggtggtgggcacctgcaatcccagctacttgggaggttgaggcaggagaatcacttgaacctgggaggcagaagttgcagtgagcagagatggcgccactgcactccagctgggagacaagagcaagactccaactcaaaaaaaagaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgtgttagccaggatggtctggctcgtgatctgcccgcctcagcctcccaaaatgctgggattacaggggtgagccaccacgcccagccgagtttatgttctacttggaagattttcagccattatttcttcaaatactctgtctcttctggtgactgagatcttattatatttacgttagaatgttagattttgtatcagagctaacttagtatctgttcttttttttcccccatcattttctatgtttcactttggacatttccctgtgagggctcttcaagttcattgatctgcttctgcagaatctaacctgctgttaatctcatctactgtatatcagatatatattttttgaactttagaagttctcttttggcatttttaatatcttccatctatttcctggtcatctttgtgtttttcttttttgagacagggtcttactctgtcacccaggctggagtgcagtggcacagtcagagttcactgcagcctcaacctcttgggctcaagtgatcctcccacctcggcctcccaagtagctgggaccacaggcacttgcaaccacacctggctaatttttgtatttttagtagagacggggtttcaccatgttgcccaggctggtctcaaactcctgcgctcaaggaatcctcccaccttgtcctcccaaagtattgggattacaggcctgagccaccgtgcgcaacctatgattttggtggtggtgttttttgtttttctgttttttaaatattcttgagtatatttgtaagctttagatgacctgttttaagttatttaatctatcaacaccattatatctgttattacggccactgtttctgttgattacattttttttcctgcccatagggactttttttttcatgcatagtaatttcttattgcttgacattgtgaattttgctttcttgggtaccgaacatcactgtgttctttcaaagtctattgggcattattctggtcacagaaaactgaggatcagtttgctcctctgatactagcttttatctacatataactatataccttgtgttcagttgccttattcaggggctcatttagttaactactaaagttatagtggttgacttctgatggtaactcgccagcaccctggcatgcgttctgtccactgtgggaaggggaacatgcagatctcccagccctgagtggtccacaatctagtctctccttccctgggtggcttcttctcaggcacctagagtcagtctcagcagacactggacatgtcttctgcaaggatccagagtcctccaggcagctgcttctcccagtctctgccctgcacttggcctctgggagttcctgcctgtggttctcaacagagactacagagctctacagggtcctctgcccctgctgtagctggaggctgtccttacgcagtgagctgaggccacagctagtctcactgcatgtgcttggcggcggggacaggagtgattcattcatcaggtagaggaggaaccctttactctgggaaaatctgtgcctgggttggggaaggacaaatgagccctgtgtgaatactgactactccctggagcccacagtctggtggagcaggtgacagcagggacctaaataactatcaggaagcatgaggtcccaccactgtcacctcccccacctccagagtggctgtgctggctccagagatgtcatccctccatatttgactgacagagggaggctgtgcagtcccaaggctccaggtcatggtagtttggccaggataatatggtttgcttaaaatcaacattgagggtaatgatcgtactaatcagagcatgtgtttaaagttctgtgttttaagcactttccatacatattaacactttcagttcacacaacaacctatgcaggaactgtgattatcctgggcagttttaaggatgtgggtgactcagagaggaaagaagaggttactcgggttaatttttgacgagaaatattagcaggttttatgctcaaacttggtgtaaagcaaggagcctgaatcacaggtgggtgagtcacaagacagggaaaccccgccaatggctcatgtccgggaggaggcagggtccctagaattcaatgggacaagaactgaaataagccaaacccctgacctcccttcttcttgttttccttctctctcttaaccatgcccatggacacccccatgagcccatttctgtggcccaacacagctgtgcatctctggccacacgcccattctccctcaatcagagaggcccacagacggcacagcctcgtcctgcacagcagaaagagtgaatggtgatgaatggatctatattatttcaactctcctacattttgtaatcatattacaatattaattcagcagtacctctcttgtttttactcccctcccccattacactggattcctgtctgtctgggattctgtctgtgtgcactctttcctctatgtccactactgtccctgccaccgatggcatttgtcacctctgcctgggcagcccctccagactctttgcaagttcatggactttggggttaatgatggctgtgcctcagctcctgtgaatggaaactgtgctaaggaaaggaagggccgtgccatgttcccgatactccacggctccttgcatatgcggtcgccaggcgcctacatgccttccatgaatgaatgaatgagtaacgtggattctaggaagctgcactaacccagacgttgtgtcctcagcctgctcatagagtgtgttaaacgtgagaggtggggagtgtggcaggcaggctgaggacagaacagaggatctgaatagagtacggaggatcacccaagtccagagtcaccaaggccattgtcaagttttccccggggacatccctcatcagatccacccattaaagatcattgttcacccagtggagagtggactaggtgggtgcactcaggtgtggcctggacagcattcgggatgggtcctagtggttagggtgagggtcaggttgcattatcgtgaaggaggcaagtggcagctgaggcagatctgagggaaatgatgataacgcaggccggtgatgcaatgggtttggtaagaagaggaaagaggtttgtggtggattctagtgtttctaatctgagacttgggtgaggtcattaccaaataagaaagagtaaatgggcataaatggctttaagaattaggaacctgaatgtgctattggagacagtatgggcacgtcattgctcatagacctgcagtacacaaaatgctaaaagatttcaatctgaatagagatgaaatgaaatggaaacatggatttttttttttttttttgagacagtttcactgttgctgcccaggctggagtgcaatggcgcaatctcggctcactgcaacctctgcctcctgggttcaagcgattctcctgcctcagcctcctgaacagctgggattacaggcgcttgccaccacacccagctaatttttgtatttttagtagagaccgggtttcaccatgttggccaggccagtctcaaactactgacctcaggagatccaccgccttggcctcccaaagtgctgggattacaggcatgagccaccttgcctggctgggaacatggatcttaaggaaagaaggaagatcatcaggaatagaaatatgaatgcacatataaagaatgattatttcctcttaatttcttgaaaatattcactatcaagtaatataacactttgtagggtttgtaacatatgaacatgcctgagacaactatagcagaaagaatgagtagtggagatgaatcaatctgtattatttcaagtctcctacattttataatattaccatattaattctgccatacaactcagtaatgaaaaggaatggagtactgatgcatatgaaaatatgaccgaatttcaaaataattatgctgagttaaagaaaccagacagaaaagcatatatagtatctgattccatctatgatatttatagccagaaatggtttaattaaaaaagaagaaggatcttaaatcaacgagctaagtttacaaatgtaggaattagaaaaagaatgaaccaaacctagagttagcattataaaggaaataattattagaagagaaataaataaaacagagaatagaaaaacagtagaggccggatgtgatggctcacgcctataatcccagcactttgcgaggccaagacaggaggattgcttgaagccaggagtttgagaccagcctggatatggcaaaaccctgtctctacaaaaaatataaaaagcagcctggcccgggggagcacacctgtgatcccagttactcgggaggctgaggtgggaggatcacttgagccccggagatgtaggttgcagtgagccaagatcacatcactgcactccagcctgggcaacagagtgagactctgtctcaaagaaagaaagaaaaagaaaaaagaaaaaccatagagaaaatccacaaaaccaacattgattcttcaatactattaattaaactgacagaattcactagtgaattctaacaagcttttaatgaagagctaataccactacttctcaaactctttcaaaaacttgaagagaagggaacctttcttgactctttctgtaaggccagcattgctctgatacccaagcagataaagatattacaagaaaataaagctatatcccagtatccctaactgatgcaaaaatcttcaacaaaatactatcagagagaattcaacagtaccttagatggattatacaccatgaccaagttggatttatttccggaatgcaagaatgtttgaacaaatgaaaattgaacaatgtaatacattgcattaatagaatgaagggggaaaaagacacatgatcatctgagttgatacagggaaagcctctgataaaattcaaagccctttcatgatgaaaacacccagcaaactaagaatagaagaaaacttccacaacatcataaaagccatgtaagaaaaccccacagctaacatcatactcagtgttgaaagacggaaagcttttcctttaagattaagaacaacataaggatatctacccacctttgccactcagcatagtactggaagttctagccaaaacaggcaagaaaaagaaataagagcatctggactgtaaaggaaaaagtaaaataatctgtgttttcagatgatatgatcttactggtaaaaaatccaaaagatttcacaaaaaattaaactgccaaaaataaaataatattaaatttttaaaattttgaaatttattgttgttcagtaaaagacagtacagattgcaatctgggagatttcaaaccaagtggtaagaaacttgccttacagcaggtatagtacaggctataaaggaggatgtattttgacaatttcatgattgacttataaatttatattctttttaaaggcaatcagagctgtttaagctgatttttctatagctgcttgatttaacttcactgaaccatattatgtcatgatgaaggtgtaaaacttatattttgtgggattttttatgattatagctaatgtttcagggatatcaggatgtcttaagttttggctacatggttatgggtaattgccgtggggtatatctaaactgtgtttttaatttttatttagtagtactaaaatgaattcatcaaagaagcggaatacaaaatcaactggaaaagtcaattgcatttctatacactaccaatgaacaattcaaaaaaagaaattaggaaaaaatccatttacaatagtatcaaaaataataaaataggagtaaactcaccaaggaggtggaagactagtacaatgaaaactataaaacattactgaaagtaattaaagaatacaaaaataaatggaaagatatgccatgattatgaattataagactaattatgtcaacatttcctaaagtgatctatacattcaatgtaatctctatcaaaatcccaaggacatttttgcagaaatgaaaaaatgtatcctaaaattcatatggaatttctagggaccagaatatccaaaacaatcttgaaaatgaataaaaatgtagtaggattcacacttcctgattttcaaaacttcctacaaagctgcagtaatcaaaacaggatggtactgacataaaagcagataaatcgatcagtggaatagaatagaggagccagaaataaacactcacatatatggccaaattatttttcacaaggatgccaagactgttgaatggaggaaagggccgtcttttcaatgaagggggctaggagaaccggatatccacattcaaaagaatgaagtgaaccttagcctaacattgtatttaaaaaatagctaaaaacaaataaaagatgtaaatgtaagtgctaaagctatagaactcttgaaagaaaatataggataaaaattctgtgacattggatttggcaataatttcttggatgtgacaccatggacataggcaacaaaagaaaaaataaacattttggacttcttgaaaatcagtaactcttgtgaatcaaaagatactattaactggataaaaaggcaaaacccacagaatgagagaaaatattttaagttatatatctgataagggcttaatatctaaaatatataaagaattcctacgatctaacaaaacaaaaacaacccagttaaaaatgggcaactgatttttataaacatttctccaaagcaaatatacaaatggtcaataagtatatgaaaagatactttaatcactaatcattagggaactgctggtcaaaacgacagagataccatcctatacccatcaggatgactattataaaaaacacacacaggccgggtgcggtggctcacgcctgtaatccccacactttgggaggccaaggcaggcggatcacgaggtcaggagattgagaccatcctggctaacatggtgagaccccgtctccactaaaaaaaaaatacaaaaaaattagcccggcgtggtggcaggcgcctgtagtcccagctacttgggaggatgaggcaggagaatggcgtgaacccaggaggcggagcttgcagtgagctgagatggcaccactgcactccagcctgggcgacagaacgagactctgtctcaaaaaacaaaaacaacacacacacacaataagcattagcaaatttgtagagaagttggaaccctcgtgccctgttaatgggaatgtaaaatggtgcagccactatggaaaacagtatgatagttcctcaaaagtaaaaacaggattagcagatgatccatcattcccacttctaggtatacgtccaaaagaattgaaagcatggtttcaaacagatatttgtacacccacgtttatagcagtattattcacaatagccaaaaagtggaagaaactcaagttggacagatcaatagataatgtggtatattcatacaatggagtattactcagccttgaaaaggaaggaaatactggcacatgctacacaatggatgaacattaaagacatgctcagtaaaatgccattcataaaaggacaaatgaaataggattccacttgaggtacctaatgtagtcaaattcataaaaaccaacagtagaatgttggatgccagcggttgtaaggagggaagaatgggaagatgaaataacttctgaggatggatagttgtgattattgcacaacaacattaataaatgtagtgtcactgaactatgtattttaaaagattaaaagataagtttcatgttatatataatttaccttagttttagatttaaaaaaacagcatttattttagtcactataacaattacacataaaatggaaatattgttgatttaaaaagccaatgcacaagctgggcacggcggctcacacctgtaatcccagcactttgggagggtgaagcgagcagatcacctgagattgggagttcaagatcaccctaaccaacacggagaaaccccatctctactaataatacaaaattagctgggcattgtgatgcatgcctgtagtcccagctactcgggaagctgaggcaggagaatcgcttgaacctgggaggcagaggttgtggtgagccgagattgtgccatggcactccagcctgggcaacaagagtgaaaatccatctgaaaaaaaaaaagccaatacacaattaaaatgggattctaaaacatactcaattaacattaaatatacaggtaagaaggaacaggtaaaaaatagaatggacaaaaattggtaaaattatagaactattttggctatagtaataattacactaactgtaaatccaccaaacactataactcaaaggtagatatggttagaaggatgaaaaagcaagacttaactacataatgtttataagagatggaatttttttttgagacagagtcttggtctattacccaggctggagtgcagtggcgagatgtcagctcactgaaacctcctcctcctgggttcaagcgattctcctgcctcagcctcccaagtagctgggattacaggcatgcatcaccatgcccggctaatttttgtatttttagtagagatggggtttcaccatgttggccagtctggtctcgaactcctgacctcaggtgatctgcccgcctcggcctccccaagtgctgggattacaggcatgaaccattgtgcccagccaagtagatggaatttaaaagcaaaatgcaggtatagtaggagcaaatggatgaaaatagatataccattcaagtaataagcctaagaaaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatagagaaacttgtctctactaaaaatacaaaaatcagccaggtgtggtgtcatacacctgtaatcccagctactggggaggctaaggtaggagaatcacttgaacccaggaggcggaggttgcagtgagccgagatcatgccacagcactctagcctgggcaacagagtgagactccaatctcaaaaaaaaaaaaaaaaaaaattacagaattcagaggaaattataatacactgttctaagcaattaatggaacggtttgacaaaaatattagtaaagtcataaaagggccaggcgcggtggctcacgcctgtaatcccagcactttgggaggccgaggcaggtggatcacaaggtcaggagattgagaccatcctggctaacacagtgaaaccccatctctactgaaaatacaaaaatgagccgggcatggtgggtggtggtgggctcctgtagtcccagctactcgggaggctgaggcaggagaatggcatgaacctgggacgcagagcttgcagtgagccaagattgcaccactgcactccatccagcctgggcaacagagtgagactccgtctcaaaaaaaaaaaaaagtcataaaagatctgaaccaccttgacttaattgacatttataagaggacacatgcatctactgaaaactcattctcttctagtgaagatggtaccctcactcattttatagcccatattctgggctataaaataagtctaagtaaagtctcttttaaaaaagagaactcatatatgttctctgatctcaatgaaattcaattggaaatagataacaatgtctagaaagacctccaaatttggatgctaagcaacacacttataaataatccatggttcaaaggagaaattaaaagctaattcaaaaatatttcaaaatataatgaaggtttaatgcatcaaaacttgtgggaagctattaatatggttctctttttttttttttttgagatggagtcttgctctgttgcccaggctagaatgcagtggcacaatctcggctcattgtaacctccacctccctggttcaagggatcctcctgcctcagcctcctgagtagctgggattacaggcatgccccaccatgcccggctaatttttgtatttttagtagagacagggtttcaccatgttggtcaggctggtctcaaactcctgccctcaaatgatcgcccgcctcggcctcccaaaatgctgggattacaggcgtgagccacacttaacttcacatttcataattcctgagtcttatcaggcaaaaacaagtcctgaaaaaacaaagtaaatctacttattatagtagggcagataatacaaagttgggcattaaggtaatatcgtatttatagttttaaagctgatgactctataaggacagtatatatgtgcttcagtgaaattataaacatgaaaactctgctttcagttcttttggatacatacccagaagtgggattgctggatcatctggtaattctacttttaattttttgaggaacaaccatactgttcctggaccaaactgagggtcgggctgctatttcttgccacccattaatgagatgccaatgaactgggaagaaagagtttttatttctgtagctggttacagggagaaggcctggaaattatcgccagaccaactcaaaattacaaagtgtttcagagcttatatcctttctaacctatatgtctacatgtaagtgtgcattcatctaaagacataagtgattaacttcttttaatctgtaactaaggtctgagtcctgaagaccttcctgtggagcctcagtaaatttacttaatctaaatgggtccaggtgctggggtgattaccctgctaaaccatggaggtttggggagttccttcaaacctccaatacccttgtttgtggaggcctggggagtttcttcaaaacccccaataaaacttgtttaatcctaaatgggtcctgttatgaattcctccattattttgtcatgctttaaggcccaggaaaggcctaagcaaaactcttgatgggcttttgttacattccagcctttgtataagggcactggcttttttttttttttttttaaagcatttaatagttaacttaagcacttgattagtactgaaacagttgtgatggaggcctgcattagtgaaacctggcctgctacaatccccactgtcaatttgcgcatgatttctatcatgcttgtgtatttatttatcatgagaatcgtagggagatggggtgtcataatctttctggctactttcagctgagagagggtcattgttatggggcaccaaatgcagtactggagtggaggaggttgatttgttcccggtagcactgtctattttaggggcttagagagagtgcctgctgaaacacctagttttcagttcacagggctttaagaaagcaaagcttaggtttcagtgatttccagttagggaaaatggagaaaaaggaaaagaaaaaggaaaaaattgaaaacattttgagacttgcagccagaaaaattagaatttaatccaaactgtagaaaataataaaaactgaaaaacatcgaggaagactagaatttaacaggtgtaactataatttttgaaacataatttttctctcttgtttcccatttttattaaaagacaaatcatggtaggactggattgctttattatacttggcctaattacttatataccgtgcagcaagaataattattttttacataggcgttttaaatgggctttgatggaactttgttccatagcaggaatctgagataagacctttttaaagccgagcccaaccatggatttataccatcaaatacctatgagttgggtgaattcctctcttcttgaggttccaagataagttggggttcctggcctgtcagaaagtgacattctttacttaccacaggtcagaaaccctgtacagggtctatgtacacaaattatgaggccagtttccaagggctttcttggcttcctaagtcaagtttgattccttaaaggagagcaaagtcaaagccttggtaaaataaccagtttttccaattgtgtcctgttacaaaagaaaacagattcttactgcacttatgcaaataactatattgccataacttaagaatactcacagtttcgaaattctggagaaaatcaggtagagagaaacaaatatgctccaaattttgttcataggagtatactgtacttaaatgttaaaaggtgttaatagctcaaaagaaaagtttccttgcctctgaaaagcaaaacaaaggattagcaacattttaagccgaaagtcaaaaagatcacttcagtctcctattagttcagttcatgcagttaattcctgtcctgtttgatattaatgaacattttaactcttcaagagtcatcaacgtttttcctctattttgatgtcacaatctccaaagttatcagaaacctgcattcaagagcacctgttagagctttacagctgattataaaaccaccttctaaagaggaccaaaacaagacagacaacaattatttatggaggacaaaaggttttagggtagccatagttaaagacacaattgatgacaagggtatctgttacctctgtggcacacaataattttaacataacaattataattattaatgataacatacactaagatatatcagaattataggagtcttccataactttggaacacataccaataatatatttatgcacatacagcccaaagaaagccaaacaccatttcatgtttgacaatgcttcctgtataattttatatcaaataagccacatttcacctttacattagtgtactattaatgttaaatccaatttttaataaaaccttatagacacatttacccaattttaatgtttgaccataaagtaagagttttatagacctttcataactctttacaatttttgttaaacagaaggttagtgctctaagagaaacccattgtgcttttattttaatgctcaatttacagaaaaactggatgatatccctttaactttagccaatacatttacacacagaattgtctttacaattacccttccacagcttgcttaaactttcattttatccaacttaaaacaatcctttaaccttttaatctagtaaaaaatatccacattctcatgcctccttataatctttttaccaaaagtatattttactttccttacacaacttgcatgtaaactgttttttcaatagtcttaaatacacattacattgttaattcttagcaaccttttcttttggtgaaaaccttggtaaatttgggattttaattatatactaggtatggagcctacgacctagacagaaatgcaggtaaggtctgacttattctagcatctagctccatgtgtcctaggccttacctagctgcaaagcaggcaagttgtacagctaagagtcatagtggcattttataaagcatttaggaggcctaatcacctttaaattgtacaacatttcttgcataaatttcctttcataaattctttcacaacttacacagacaatctctgacatgccttgactttctgacttgttctaaacatccctctctttaaacaaccagttaatttactttaggacaagaatttaccatacaggagcccttcttgtataaattctcttttctttaaaactttttgcatagctaggggacatggctaatttcacatgtccccaggccgtatctagaatttaacagtccaaaataaattgaacactttttaagtcaaagaagcattttatgacctaaagcatttagcaaacctagtatttgacctgcataatttagaccaactatttacatttttgaagatacttttaccaataatctttaaaattctccttatttttataactttctttatatctctcttatttcctggtttcttttaccttgttttatatataacctttaaataagctttgaataagacaacaattagttacccttggccaggcgtggtggctcacgcgtgtaatcccagcactttgggaggctgaggcgggcggatcacaaggtcaggagatcaagaccatcctggctgacacggtgaaaccccgtctctactaaaaagtacaaaaaattagccaggcgtggtggtgggcacctgtagtcccacctactcgggaggctgaggcaggagaatggtgtgaacctgggaggtggagcttgcagtgagcagtaattgtgccactgcactccagcctgggtgacagagcaagactctgtctcaaaaaaaaaaaaaaaaaaaaaagttaccctttaaaaaggacacaatctttagaaagaatgttttcctacgatatatttttattagaaaatacccaaataattagatatctgttgtttaatataactttagattctaaattatgagaagtttacttatgagtatgtatcccattacatttatctaattatttattttaatcatttacccagattatatatgaaaactgcgatagttgtcattaaagttaggaaaccaccattgcaaaattatgaccgagacagtgaaaatgatctgacctaactgactccatcttccttctaacctacaaggtattcttgtttattaacttagtttataatttagctttgaaacaaatgtgataacagtcctttcccagaacaaacttccttcatgtctgtggactagactgcttaaggccagaagattagaagttagggtattttggccaggcacggtggctcacgcctgtaatcctagcactttgggaggccgaggtgggcggatcagaaggtcaggagatggagaccatcctggctaacatgatgaaaccccatctctactaaaaatacaaaaaataaccaggcgcggtggtgggcgactgtagtcccagctactcgggaggctgaggcaggagaatggcgtgaacccgggaggcagagcttgcagtgagccgagatcgcgccactgcattccagcctgggcgacagagcgagactccatcttaaaaaaaaaaaaaaagagtattttactaaataattcaagatgtaactatcttcattaaaacaatattaatgtttcatttatttaaaaattacacatgcaaagattattctgtttgcactgaattatagttttgtagcctctatgccagattttgacaccttataatatttggcagagataagtatgaaattgcttgatcaataaatgcaaactaaaatgtatgctggaaactcttaagacatttctaatattactttaccaataatttttaaaaccagcttacttattaaagattttaagtcacataaacttgaaaaagcatttgactagtctttccttttttctgttattcaagtgcttttatttttctttgagccatttaattagacctcttttgtatatcttcagtagtgaaacatggtgtacacaagacaaatacataagtgtattatgcatgccaacagaaatacattttatagattcataagacctcatttttcagtctccctctactgcctaggccagagtacagtggcatgatgtctgctcactacaacctctgcctcccaggttaaagcaattctcgtgcctcagcctcccaagtagctgggattacaggtgcctgccaccatgcctggttaatttttgtatttttcttagagatggggtttcaccatgttggccaggctggtctcgaactcctgacttcaagtgatcagcccgcctcggccttccaaagtgctaggattacaggcatgagataccacgcccggccttaactggatgtttgagctctgggtggagcccatactgaatcctgggttttcaaaaagggagaattattatgaggctagaccatgtgatgcttttacagtgcacttaaacaattttttcccaaagacatttctaagtgtctaaattacactttttctttaaaaccccagagtagcttctgtttaatagctattaatgaagaaaacagaattcagtcaactgagaagaaaaaaagttttgctcaaaaagataaggccctaggagagagagaaataaaaccaaaaacacgaaggccttttaaaggccttcacgcccccgtgcgcacacacacacatatgcacatacacattttggatgttagcttttaattaagctgactctcaatcattgagcttcaaaaaatctttctccttcccagaggcctctcagcagagatggacccaatacttcccattttcaagtttacatggtatcaaaaggaacaagacagacacacaaacaaatggaaacatttcagaaaaacccaaggggaagtgcactacggcaaaacagactctcaaaactaacgcaaaacctgatatcaaccaaagggaaagtgggtgtatgagccagccctgttgcttcccttggcagtaccggataaatggcttaaccagcccaaatgggaaaacaataggctcctggcctaagatcccattgactcaccctttgagcacgtccgctccttatctctgttcttccccagtagagaaagggacgtgtagatttgcacataaacagccctctggagggtcccctggggaaacctcacctgacagctgctgggatcctcctgaagactgtctcatcgcaagctaccagccgctgaacgcggcactgtccttatcttctggctggcgacttttttgttcccagaccaaactgagggtggggctgcccaataatgagatgcaggtgaatctcgctgcccaataataagatgcaggtgaatctcgctgcccaataatgagatgcaggtgaatctcactgcccaataatgagatgcaggtgaactggggaggaagcgagtttttatttctgtaactggttacaaggagaaggcctggaaattatcaccagaccaactcaaaattacaaagcttttcagagtttatatcccttctaagctatatgcctacatgtaagtgtgcattcatctaaagacataagtgattaacttctttgaatctataactaaggtctgagtcctgaagaccttcctctggagcctcagtaaatttacttaatctaaatgggtccaggtgctggggtgattacccttatcttgtctcctgctaaatcatggaggtttggggagttccttcagccctcccacacacttgtttttggaggcctggggagtttcttcagacccccagtaaaacttgtttaatcctaaatgagtccttgttaagaatttcttcattattttgtcatgctttaaggcccaggaaaggcctaggcaaaactcttggtggggttttgttacatcccagcctttatataagggcactggctttttttagcttttaatatttaacttaaccactcagtcagtactgacacagttgtgatggagggctgagtgaaacctggcctgccacgatactgtttttcccagtgtgtgttttacattcccaccaacagggcacgaaggttccagtttcttcacacctcaccagcacttgttattttccatgctgttgtttttaatatagtagacgttagtggtggtgagcatcttttcatgtgcttatgggccatttgcttatcttctttggagaaatgtctttcaagtcctttgccctttttaaaattttttaaaaatttttattgtaaattaagaaattacggccaggcacagtggctcatgcctgtaatctcagcactttgagaggctgaggcaggaggactgcttgagcccaggcgaacgttcaagaccagcctgggcaacatggcaactcccaataaattgtatgtatttatggggatttatagggtacaaagttatgttatgatttatgaatacaatatggaataattaaatcagctaatatgtccaacacctcaaatacttaacatttttatggtgagaacatttgaaatttattcttttagcaattttgaaatgtacaatatgctgttattaactacattcattgcactgtgcaacagatctcaaaaatcttattcctcctgtctaaccaatggtttgtacctttgattatcatctccccattcccccgtgcccagactctagtaaccaccattctattctctgcttctgagttcagttgtttttttttttttttttttgacacaaaaatttcacttttgttgcccaggctgtcgtgcaatggtgccatctcagctcactgcaacctccgcctcccgggttcaagtgattctcctgccttagcctcctgagtagctgggattacagatgcccaccaccacgcccagctaatttttgtatttttaatagaaacagggtttcaccatgttggccaggctggtctcgaactcctgacctcaggtgatccacaccctaccttggcctcccaaagtgctgggattcaggcatgagccaccgtgcccagcctcgttgttttcaatttcatgtatgaaaacatacagtatttctctttttgtgcctcacttatttcacttagcatgatgtattccaattccatccatgttgtttcaagtgacaaaatttctatctttttaaaggctgaatagtattctgtattgtctacataccacattttctttatccatttatctgttggtggacacaggttgattgcataacttggctgttgtaaatagagctgcaatgaacatggaagtgcagatatctccttgatatactgatttcaaatctttttggtaaatacccagaagtgggattgctggagcatataataattctatttttagttttttgaggaagctccatactgccttctgtaatggctgtactaatttacattcccaccaacagtaagcaagggttcccttttctccatatcctcaccaacacttgttatcgtgcatctttttgataatggccattctgataggtatgagatgatatctcattgtggttttaatttgcacttccctaatgattcgtgatgttgagtttttttttttcaaatatctgttgaccatttgtgtgtcttctactgagaaatgtctactcaggtcccttgcccattttgtaatcagattattttttctctttgaatagaattatttgagttccttatatattttagatattaaccccttatcagatgtatggtatgcaaatattttctcccagtctgtagcttattgcttcactctgttgtttcctttgttgtgcagaaacttttttttttttttttttgagatgaaatttcactcttgttgcctaggctggagtgtaatggcatgatcttgactcacggcaacctccacctcctgggttcaagcgattctcctgcctcagcctcctgagtagctgggattatcggtgcatgccaccatgcccagctaattttgtatttttagtagagatggggtttctccatgttgatcaggctggtcttgaactcccgacctcaggttccgcagaaacttcttatgttgatataattccatttgtctatttttgcttttgttttttgcactttaggggtcaaattttaaaaaatgttgcccagataaatgttgtgtagttttagcccctgtgttttcttctagcagtttaatagtttaaggtcatatatttaagtctttaatccattttgagttgatttttgtatatggtgtaagataagggtccagtttcattcttgtgcatatggatatccagctttcctaacaccatttattgtggagacttttttttcccactgtgtattcttggcacttttggcaaaaatcaattgaccatagctatgtggattcatttataggctctgtattttgttccattggtcaatatgtccatttttatacccgtgccatgctgttttaattattattgctttgtagtatagtttgaaatcaggtagtgtgatgcctccagcattgtactttttgatcatgattgccttggctatttgtgttttttttttttttttatggttgcatatgaattttaggattgttttctctatttctatgaaaaatgatattggaattttgatagtgattacattgagcctatagattgctttggatagtatggacattttaacaatattagttcttccaagtcatgaacatttattttcatgcatttgtgtctctttccgttttatttgtctcttctgttttgttcattagtgttttacggtttttaacatacaagtctttcacttccttagttaaatttactaatttttttttgtcattgctcttaataggtttgttttcttaatgtctgtttcatatagttcattattaatatatagaaatgctactgattttcatatgttgattttgtatcccacaaccttactgaatttgtttacaaatttctaacagttttttggtggagtcttcagggttttctatacagaagatcatgtcatcggcaaatagacaattttacttcttccttttctatttgaatacctaataattcttttctttttcttgcctaattgctctggctaggacttccagtaccatgttgaaaagaggtggtgagagtgagcatccttgtgttgttcctgatattaaaggaaaagctttcagcttttcactgctgagtatgatattagctgtaagcttgtcatataaggctttttttgtgttgatacattccctttacacctaatttgattagagtttttatcatgaaagaatgttgtgttttgtcaaatgctttttctacatctaatgaggtgatcatattgtttttgtcctgcattttgttaatatggtatatcacatttattgattttcatatgttgaaccatctttgcatcccaggaacaaattccattttatcatggtcaatgattcttttaatgagctattgaatttggtctactggtattttattgaagatttttgcatctgtgtttattagagatattggcctataattttcttttcttacagtgttctattctggctttggtatcaaggtaatgcaagccttgtaaaataagtttggaagtagtccctcctctgtaatttatttgggaaagtttagaaaggattggttttagttcttgtttaaatgttttgctgaattcagcagtgaagccttctgggtcctgggtgtttctttgataggagacttttcattactgattcaatatccttaatcattattggtctgttcggattttccatttcttcatgattcagtattggtaggttgtatgtgtctagaaatttatccatttcttccgggtggttcaatcctttggcatataattgttcataatattttcatatgatcctttgcatttctgtggtatgcattgtaatgtgtctcatttttttttttatttgagacagagtctccctctgttgcccaggctggagtgcagtgtgacgatctcagcttactgccactttcacctcccaggttcaagcgatttttgtgccccagccacccaagtagctgggattacagatgcacacctccatgcctggcttttttttttttttttttttttgtattttattagggacgaggttttgccatgttggccaggctggtctccaactcctggcctcaagtgatccatccgtctcggcctcccaaaatgctgggattataggcatgagccactgcacctggcctcctcattcatttttgatttaatttatttgtcttctttcttttttcttagttagtctagttaaagtttagtgatttcatttattttttcaaaaaactaacagaattttgataatcttttgtatttttttcagtctctatttatttttgctctgatttttattatttcttttgttctgctaactgtgggcttagtgtatcttttcttctatttccttgaggtacaacattaagtcttgtatgtgagatctttcttcttttttgatgtaggcgtttattgccatttcctcttaaaactgcttttgctgcatcccatacatttggttatgttatgtttccatttcattttctaatatactcttaaaattcccttttgatttcctctttgacacattggctattcaggagcttgttaccattcaagttctttgttcatttcttaatcacattgttggctttttgttgttgttgttgagttggagttttttatatattttagatattaaccttttatcagatatacaactagcaaatgttttcctcttcctgtgggttgccccttcactgttgatcatcactggatgcacaaaagtttttaatttttacatagtgcaatttatctactttttttcctatattgcttgtgttttggggatcacattcaagaaatcattgccaaatccaaggtcaggaagaatagttcctatgttttcttctaagttttagggttttcacttttatgttagattttggatccattttgagttaatttttgtatacgtgtaagttaaaggtccgaggtcattgttttgtgatgagtcaatgtctagatttcccaagaccatttttaaaaagattgtcctctcaattaaatggtcttgatacctttgccaaaaattacttgatcatatacagtcatgcaccacataacaacatttctgtcaacaacagactgcatatgtgatggtggctccatgcaattatgtaacatgctacacaggtttgtagcctaggagcaaaaggctataccatataggccaggtgtgtcataggatacaccatctaggtttgtgtaagcacactcttctgatgttcacacaacacaattgcctaatgaccctttgctcagaacaatgttgagcaatacatggttgtacgtgcaagttcatttctgggctctctggtctatatgtcaggcaccttttaaatcagaagttcactatttaatgtttgatcctgtatcccaattttttaagtttgctatattataacccccatttataaaaatgtgtgtctgtgtgtatgtctgtgtgagagagaataagagaaagagagaaagagagaataggcatacctatggaaaaatagtggaactaaatgagacaaaatattaatggatgctatctttagctgagaatatcacgtgtggtctgtgtattcttgtaaaaactttccttgcccacattttctggaatgaacatgtttagaagagttttgcaagtgtatgttacttggccttccctgaaatatgaagggacaaacaaacactaaaggatgtttgagaggtgagagctgcaagaaagatgagggttctgtttagcttgggtgcctgggctcaagagaatgtgagtggatcctgggaggggtgaggtctggaagccactcatgcccatccctgctttgtccccacaggtctcagctgagtctgctctgatcacccaacaagacctagctccccagcagagagcggccccacaacaaaagaggtccagcccctcagagggattgtgtccacctggtatgttcaagatgggtctctaatccttgcccctcctccccttgtctccatgagcttccagtctgtttcctttgcacttccttgttctttattccacagagaggcattgggtgcctccagttcaaggctctgtccttctggagccttcctgctaggatggtatcaagacacacaaatgaatgagacagccaaagaaactgataggaaccttgagagagaattgagtgggacagagatggggctggtgaggcctccaggcaatggtgactttgggctgacatccggaggagggcagggccagaggttcagagagccaggaagagtgctcctaggagggttccactggaacaattgccagggggcaagagttggagaagatggagcaacagcagggggctgctgtggggagtggagggttaggaagttagagagacacgtggggtcagatcccacacagatgaagctggattttatttcatgagtgatggatgtccctgagaagttttcagcagagggccaccagcatcggatgtacatcttgagtgcccactcctggactgaaccggagcaagacaggaagcaggtggagggccttgagtgtgaggcgctcccctgggatgttatgtggtgtcccgtaaggtcatttgagcccccagagatgcagcaggaacctggcctgaagtgtgcttgactgttgtgttcgcctcgcacttcttcccccttttcccccatgtgtatgagttaggaattgattgctgcatgaaggtttccagggcaggcaagtgtggcaagcagtggcttttaaaatccatttacaaagttgcatttcttttccatgactaagggccacaggaaaggcttgcctgagggcaaaccctcacattgcacatgtgggcttgccaggagcagagcatggagaaggaagaacccagcgtgaagcagacacaaactcatctgtaaatgctcctattgctgtggtccagggtcaagaccaggaagcaggacgggaataggaaggactcaagacatatttggggtgtggatggatgacgtgtggggaatgaggacaatcgaggcaccaaattcaactgctcagggtaacttggcctctgaggggacagtgtgtggcagggctagcagtacacatttggggaccctagcacataggtgatgcttgaagccgctgtcttgagtgtgtccacctggaagaagttgtaaatactgaggaggggcacaactgagcccatgaggatttgaagttggagacgataggccagggagacaggactgcaatgggctgagcaggagcagttggagaacttccatcctagaggagagatggcccttccagccacagggagcaggccatagcaagtgtcaaggactgagatgtggaaactcctcgaaatgtgcatttctcttcctgtgaatgaggtcaagaatctgttcatgacacagacactgtttgtacactggttctcctaggttttcttcactcctagtaagaggttaggttttttttttttttttttttaaatcattgagtcacatgaattcttacagattagggaaattatacattgattgattgattgattgactgattgagataggatttcactctgttgcccaggctggagtgcggtggcaggatcatagctcactgtagcctcaaccacttgggctcaagcgatcctctcacctcggccttccaaagtgttgggattacaggcgtgagccactgcgctgggtccaaaattctaataaaaattcccatataacgccgggcgcagtgactcacacctgtaatcccagcacttcgagaggccaaggtgggcaaatcacttgaggccaggagtttgacaccagcctgaccaacatggcgaaaccctgtttctactaaaaatacaaacattagctgggtatagtggcgtgcctgtagtcccagctacttgggaggctgaggcaggagaatcgcttgaacccgggaggcagaggttgcagtgagctgagatcacgccattgcacttcagcctgggtgacagagtgagaccctgtctcaaaaaaaaaaaaacaaaaaaaaaattatcatatatctttgcagtcattttgtggtttcctattttgtaattaagtcattgagccacatggacttcattttgtagtaagaggagagtgaggaagacacattattatttgacagccacctttttggttgccccaacactattattaaataatcacgtttttatcagtgacatgaatcactatgattatgtatgatacttacattattaagtaaggtttgtgtaatttggattttttagaatgtctttcaatattaataaaaataattcaggaatcttgtggctagcatataggtgattatggtctattttttgcgtttgtttttactcattctgccaatctctgccttttaattgcagagtttaaactattttcaattaacatagttattgacaagaaaagatttgtttctgctcttcagttatttgttttctttatgtcttatatatattttgttcctcccttatcaccttttgaaaaaactttagtttatttcttggcatgtaccattttcactcacttcttttcttttctgcatattttaaaatgtattttctgtttttcttaaatatatattttgtatatatatttaataaatatattttgtatacatatatttaaatacatattttgtacatatataataaatatatattttgtatatatatatttaataaatatatattttatatatagttaataaatatatatttaaatatatacttagtatatatcttaaagatacatatcttaaatatatatatagatatatatatattttttgagacagggtctgctctgtcacccaggctggagtgcagtggtgcgatctcagctcactgcagcctatggctgctgggtttaagcgattttcctgcctcagcctcctgagtacagggagtagccaccatgcctggataattcttgatttttagcagagacagggttttaccatgttggtcaggctgtctcaaactcctgacctcaagtgatccacctgcctcggcctcccaaagtgttgggattacaggtatgagccacgcacctagcctaaaacttattttcttactggtttccttgaagattacaattaccttcttaagtatctaaacaggtagttttataataccggcagaatttcattgcaatccaaatactgtgctcctgtaccactccatctctccagctttctattgttgctgtcatagatcacatccttgcacgttgtgtgaccactgacgtcgatcttaaggacatgtatgtgtatggagcaaggttgacttgtgatggttgattttatgtgtcaacttggttacccagatacttggccaaatattatcctagatgtttctgtgaaggtgtgtttgttgttgttgttttgttgttggttttagatgggattaacatttaaatcagtgggctttgagtcaagcagattacccccttaatgttggcaggtcccatctaatcagttgaaagcctcaatagaaaaaagactgacctccaccaagaaagagggtgttctgccagcaggcagccttcagacctgagctgtgactcttctctgctggcctatcctgtaccttttgaatttgccagcctccacagttatgtgaaccaattccttaagataaatctttatctctctagagcaggggcccctgacccccaggccatggaccagtactggtccgtggcctgttaggaaccaggccacacagcaggaggtgggctgtagatgagtgagcattactgcccgagctctgcatgccgtcaaatcagcggcagcattagacttcataggagcgtgaaccctattgtgaactccacatttgagagatctaggttgcgcactccttatgagaatctaatgcctgatgatctgtcactgtctcccatcacccccagataggaccatctagttgcaggaaaataaactcagggcttccactgattctacgttatagtgagttgtataattatttcattatatgttaccatataatagtgatagaaataaagtgcacaataaatgtaacatgcttgaatcatcctgaaaccatccccatgcccccaactccagtccgtggaaaaattgtctttcaggaaaccagtccctggtggcaaaaatgttggagacccctgctctagagagccctgactaatacagaatttttaaagatttgaaattcttttaaaccatacttgatctccaagtaatggaaataataagattatatttccacctaacataatacagctatcctgtatacaactgaaaacgcactaaccctttctccagaagaggatgcaaagttcttgagtggtgtttactcctttccttgataccctggaacataaatactataaagtgaacaatacttaaatactatgatataaattcaaaatatcttgtgtcacataacaaggggataagagaaggaagaaaacacagatattcgcttaacatatatttacacataaacacacacacataacacaataaggaagaaatacttataatgattacagtccttatttccatagctggtcatgtcattgtagctggtatttataagaagcttctttcgctgtgcattctgtattccctgtgccctcactaagcacctcagctggtcatggctctgtgcctggtagagtgaactaacctttattcctgaagggtctgagctattagtggtcctgctttaatagggtcgtggtagttttccattgactttactcacagggcatggtaatactaagagatgccctaaggaatctcctgtattctagacatcctcttccttacgtccattgtggaataacagtccaattttcccttcaatttcccctttgtgttcagaatcagtcaatccagccagcagggtttgtgtaactggttttcgcctgttgattcagaggcatgaggaacccaaagtggccaagtggcagtcttcaagttacacagaatcactgttgtgtctcctcatggaatcattcctccctctgaaactcagagctctagcaaagcataaagcagcaaaaattttgataacaggccactaagggtaatgtggagtggggccattcctgcttccacccctagattcctggacacatgaatcctagcaatggaagaagcaaccgcatgtattggaggataattcagagcatagacagtctcctggagaaccttgttgcagcccttcaaggtactgccacccagctgacattgtaaatgagttttcaaaaagccatatcccaccatcttaccaagccagcagttttgagatggtggggaacatggtaagaccagtaattccatgagcacaggcccattatagtgggcgcttcatttgccatcaagtgagtccctcaatcagaagcaatgctgtgtgaataccatgactgtggataaggcattctgtgagtccacagaggatagttttgacagaagcattgcatgcagggaaggcaagtctatgtgcaaaataagcttctcttccagtaaaaatgctgccccctccatgatagaaatggttcagtgtaataatcaacctgccaccaggtagctggcagactgaccctctgaatggtgctatatcagagactcagtgttggactctgctgcctatagattgggcactcagtagcagctgtagccaggttggccttggtgagggaagtctgtattgttaagcccatacataacctccatccctgccaccatgcacactttgttcatgagcccattgagtgatgacaaggatggctgggaaagaagctgactggtagccacagaacaggtcatcctatccacctgattattaaaatccttccctgctaagatcactttttgtgaagatatttgtgtcacatggggcacaaatatcttcatggtttttttacccattgagaaaggtctatccacacacctcttccccagacttccttgttatcagttttccttcagagcctctgaccctccagccaaatcattgaccacagctcatgaatcagtatataactacatgtctagccattcttccctcaagcaaaatgaacaaccaggtgtactgctcagagttctgcccagtggcaggatctcttttttttgagacggagtttcgctattgttgcccgggctagagtgcaatggggcgacctcggctcactacaacctctgcctcccgggttcaagtgattcccctgcctcagcctcccaagtaactgggattacaggcatgtgccaccatgctcggtaattttgtatttttagtagagacgaggtttcaccatgttggtcaggccagtctcgaactcctgacctcaggtgatccactcacctcggcctcccaaagtgctgggattacaggtgtgagccaccacacccggcctagcggatttcttttcaccactgtccttcagggacgtcccagacagtggatgtgatgctgcaaacatccacttctaagggttacctgtatgtggtgcagaaccatctgtaaaccttcttctggcaactgaccatagggaattcctcatgaggccataagtgcaggccaggcaaaagaaagtaatattgcaggagtggggatcatgggcacttgggccacttcttcatgtaactttcttgtgccttcagggcctatttaagcccaattttgtatatataccaattacatttgaaaatggaaatggaaactttaggctgtatgtgcccaaacttatggcttggtaggcaaaataacactcagttcacgatgagcagtcaggtcgtagagtaatttggtggcctatggttaaccattcagtctgcactaaggcccagaaacaagccaagagctgtttctcaaaaggagagtagttatctgcagagttatctggcaagtctttgctccaaaacctaagggcctgtgctgtggttgacctagagtgggctactaaaggttcaaaacagcattgctgtctgccaccaatacttcaagcaccgttgggtctgctgggtcgtatggcccaagtgacagaaaaatgtctacggcagcctggacctgttgcagagccttttcttgttctgagcaccactcaaaactagcacatttttaggtgacttgataaataggccagagaaacacacccaaatgaggaatatgttgccaccaaaatcaaaataagcacactaggcattgtgtcattttcttggttgtagggaggtgggggtggcagatacaacaatttatcttttatcttagaatatcttagaagagaaggaatatcttatgtgccacatcattcaacaactaggaatttgtttcccagttgttgtccttctactgaggtaaaaggcccttgaaattttgtcagatttatttcccaccccctgacatgcaaatgtcttaccattaagtctagaatagttgctacttcttgctcgtgaggtttaatcagtataatgtcatcagtataatggatcgtcttgtgtgttatcttgtggaagggaaaggccatcaatatccctgcaggccagatgtggtggctcgcgcctgtaatcccagcagtttgagaggccaaggtggctgggtcacttgagaccaggagttctagaccagcctggccaacatggtgaaacctcatctctactaaaaatacaaaaattagttggatgtggtggcacacatgggtaatcccagctacttgggaggctgaggcatgagaatcgcttgaacccaggaggtgcaggttgcagtgagctgagatcatgccactgcactccagcctgagagacagagcaagactctgtttaattaaaaaaaaaaaaatacctgcaaactaaattatgacatagggctgcgagttgatgcatcccggagacaggatagtgagggtatattgctggccttgccaactgaaagcaaactgcttctgggagtctttattgacaggtatgaccaacaaagcatttgccagttcaacacctgcataccagggtaccagggatgtggcgatttgctcaaacaatgaaaccatatctgggacagttataactggaatcaccacctggttaagcgtatgataatccactgtcattcaccaagatccatctgtctttggcacaggccaaatagtcaagttcaatgggcatgtgatgggaatcaccacagatgcatcctggatggtggtaatgatctctgcaatccctccgggaatgttgtattgcttttgtttttttgtgctttacaggcagggtatcactctgtcacccaggctggagtgcagtggcacaatcatagcacactgcagcttgaactcctgggctcaagcaatcctcctgcctcagcttcttgagcagctaagactacaggcatgtactgtcatacctggataattttgtatgtgtgtgtacagatggagtctcactgtgttgcccaggctggtcttaaacccctggcctcaagtaatcctcctgccctgacctcccaatgtgctggaattacagacatgagccaccatgcccatctggtattgcttttgatttactattttttttaagtaaatgcaaatctggtggcttccacctggtcttttccaccataatagtcttcacttcacatgtcagggaatgaaggtggggattgtgccagctgctgagtatgtctattccaattacacatactaaaatgaggaaatcagacaggatgggtgtggggacccactggcccctttctgagatggacttgagcttagtttgagtaatgacaacataacttcaatggtatgcaaacactgtgctcctgtacttctccgtctttcctcctccatcttgttgttatagatcacatccttgtacattgtgtgcccattaacatcaatttgtaattattgttttctgcatttgctctttaaatcatataagtaaataagaggatttacaaaccaaatgtaccataatactgtgctatagactgaattgtgtccccaaaatcatatgttgaagcattaccatccaatgagatggtatttggagatggtgcctttgggaagtaattgggtttagatgaggtcatgagggtggggccctcatgatgggattagtgcctttttaagaaaagacccagacaacttgctctctctcgcttgctcgctctctctctccccccctcttctggtgtgtgcaaggaagaggttacgcaaatgcacagcaagatggtggccatctctagaactatgataaataaatgtctattgtttaagccacttggtctatggtattttattatagcagcctaagtagctgcgtaccagcatttatatttacctaaatagttaccttttccagggttctttttttttttttttttttgagacggagtctcgctgtcgcccaggctggagtgcagtggcgtaatctcggctcactgcaggctccggcccctgggtttcacgccattctcctgcctcagcctcccgagtagctgggactacaggcgcccgccacctcgcccggctaatttttttttgtatttttagtagagatggggtttcaccgtgttagccaggatggtctcgatctcctgacctcgtgatccgcccgcctcggcctcccagagtgctgggattacaggcgtgagccaccgcacccggcctccagtgttctttatctcttcgtatgcctttgagctattatctaatgtcattacattacctcctaaaggattccttttagcatttcacagggcagatctactagtaatgtgctccattacctttcatttatctaagaaggtcttaatttcttcttcattcttgaatgataatgttcctggatatcaaattcttggttgcaggattttgtatgcttgtgtttttgtttcttggcactttaaatatgttacccactcccttctgggctctatggttcctggtgagaaattagctaataaccttattgaggttcccttgtacatactgagtgggccacttgctactttcaggattttctgttggtgttgggcttttgtccatttgactataatgtgtctcagtgtagttctcttttaacttatcctgcttggagatcattgagtttcttggatgtgcagacaaatgttttttaaaagtcttgcacctccttgttaaatatcattcctaaatgttttattcatttttatgtcattgtcaatgaaattgttttcttaatttcctttttggattgttctttgctactgcaaaacttttacgctgaaaactatcaaacattgctgtaagaaattttaaaaaagcaaaataaacaggaagatattccatgttcatagatcaaaatggtgttaaattacccaaagcaatatacagattcaatgaaatccctaccaaaatctcagtggtgttattttaaaaatggaagaacttatattcaaagtcgtatggaattaaaaagacttattgaccaaaaacaatctggtaaaagaaaagcagagttggcgggactcacactttccaattttgaaacatatcctcattccagggcagctttagtccccttttctttggatcattctttgactctatagagattcctcccgttttcttcccatggctgatggtgtgagctttaattttgaaggcttttcccattgttgtatgacttctgctcctggtgtatcttccactggctaggagctcattcagaacaggtattaggacattcttctgtgcattttaaaggtctaagatggcactgtctaatatagtagtccctaggcccatgtgattgccaatcacttgaaatatgtgaggcaggtggatcacgaggtctggagttcgagaacagcctggccaagatggtgaaaccccgtctctactaaaaacacaaaaattagccgggtgcggtggtgggtgcctgtaatcccagttactcgggaggctgaggcaggagaatcacttgaacccaggaggcagaggttgcagtgagccgagatcgctgcactctagcctgggcaacagagcaagactccgtctcaaaaaaaaaaaaaaaatatgctactgcaaattgagatgtgccatgagttaaaatatacgcaggatttgaagacgtactgtgaaaaaaatgctgtaaaatatctcaatgttttatgtggattacatatttaagtgatattatctggggtacattaaattaaaatgcattattaacattaatttcaccccttctcaccttttttaatgtgctgagtgtggatttaaatttcatatgtgggctgggcacagtggctgacacctgtattcctagcaccttgggagtccaaggagagtgaatcacttgagcccaggagtttgagaccagcctaggcaacatggtgaaacctcgtctctacaaaaaaaaagtacactaaaaattaacccggcatggtggtgtgcacctgtagtcccagctatttgtgggtcggggggagagggagggtccgggaggtcgagggtgcagtgagctgagatcacaccactgcactccagcctgggctatagagcaagaccctgtctaaataaataaataaataaataaataaataaataaataggccgggtgcagtggctcacgcctgtaatcccagcactttgggaggcctaggcaggcagatcatgaggtcaggagatcgagactagcctggccaatacggtgaaaccctgtctctactaaaaaaatacaaaaattagccaggtgtggtagtgtgtgcctgtaatcccagctactcaggaggctgagccaggagaatctcttgaacccaggaggcggaggttgcagtgagccgagatcacgccactgcactccagcctgggtgacagagtgagactacgtctcaaaaataaaaaataaaataaataaatgtgtggcttatatttcttttggcagtgctggtttaaggtgtgtaaatgcagaattgatgaactgaccaagctaggtagaggagatttccctcttttggttccacacatccctgaaagaggagtcccccagccaccactgccagcttctgggaatcctgtggcatttcattcactggcttttctctcccctcccaggacaccatatctcagaagacggtagagattgcatctcctgcaaatatggacaggactatagcactcactggaatgacctccttttctgcttgcgctgcaccaggtgtgattcaggtacagaacatatggaccccatgcctaaaggtggaatgcggggtgatgacataaaagttgtagctaaaatgggatcaggagacctagattctggtccaccttggtcttcatcataccatgttccatgattttgtctttgagctttttaataaataaaacaggcccggcacagtggctcatgcctgtaatctcaacactttgggaggcatcacttgagcccaggagtttgaaaccatcctgggcaacatgagaaaccccgtctctacaaaaatataaacattagccgggcatggtggcgcgtgcctgtatttccagctacttaggaagctgaggcagaaggatctcttgagcccaggaggccgaggttgcagggagccgagattgtgccactgcattccagcccaggcaacagagcaaaaccctgtctcaataattaattaaaataataataatacagaaattatttgtataatgtatgctacatggtaaggaaatcttttaaactgtcagctgcaagggggtggggccatgagccaggccaagtggacagggctggatctcagcagtggcacaggtctgctttggggccaggctctctcccctgggctctgtgctcctggcaggtgctcggcctcactcacccttcaggttctcaggcctctccctcctccccagcaggctgggccttggggaagtcccccaagggctcctctccttgcagtctctcaggtgatcccttgcacttcccttgctactggccatgcaatctaaacgatgcttgtcccctaaacggtgctttcccctaatctaatgtaataaataatgaactgtggtccttttgtatgactcaacgagtgttagtgacagctgaagggtgggtatcctgaatgagccatgagtgtgctggtgcagaaactggccctcagaactccttggcaaactgagttgagctgagtagcagggtcttggggtggggaggaagggtcaagggacacatcaggaaaacacattcccaaaaccttatgctctgtcgtcaggtgaagtggagctaagtccctgcaccacgaccagaaaacacagtgtgtcagtgcgaagaaggcaccttccgggaagaagattctcctgagatgtgccggaagtgccgcacagggtgagacaggagccgggggctcccagtagctccatggaaccccaaaagacccaagtctccttgtacccctgtctctcccctgacagcacccgcaaggggcatccttgagcctgtggctgcccctcctggtccctctgcgtgtcaccacccctgccccctgcagcagcctctttccacccctccccagcacgagtccccttgaccaggctgacttgttcactgaccacagaaggccatgacttggggcccatgataattttaggggcccatgaaatgatttaatttctcttgaaataagaagaataagtagaatgcagccaggcatatattcatctttataccaattcagcaataaaatgtattttttaatatttttatgcatgcaggggcccataaagacaaaagtgcccatggcccacaaaaggcataataaggccatgggtggagctccttcaagttcccatgaggacctgagcccacccagccggcctcacccctggcccctgatccctcagtaagacctgtcttttccctatttgggttttaggggccaagagtaatttgctcttctctggcccccctagtatttgctgtgattgggggaaatgggcagacagctggggacaagagctcacttttgtggttgactggaagaccggactcatcttgtggccacacgggcttgtgaccttcccctggagtgtgattgctcctaacgcaggcctcccctgcagcccagggaagctcagtgtgtgcccagcacagaaggctcctggaactgcagctctgaccccagagcagggaggccgaggggctgaagtgcgcatgctcagacccttccccagcctcaagaagggagcacagggggacccactgctgacacgaggagactatccttcccctgacaccttctcagggacactggggagggagggtggctcctctttcatcccacctggccagctttccatcaagagtcccccctctccctccgtgtgtgtacccaggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtaggtgctggctgagggcgggggcacagggcactctctgccctgccccctcccaccctattcccacagacagaaacgcctgcccctgccccaagtctaagtgcctccagcctggctctatcctcctcctcgtggtcacccccatccccacatcccgtgcaccccccaggaccctggtctcttcagtccctctcccaggtctgggggtccccatatctcccagccaagtccaggagggcagggccagttcctcccatcttcaggcccagccaggcagggggcagtcggctcctcaactgggtgacaagggtgaggatgagaagtggtcgtgggattttttcagccttggtcagagcagaaccagagattttccaagtgtttgtttttactctagttccccttctcatcccccttcctcagggtgtctctgagttgtaaggccccattctgtccccagccccagggctccttgtccagtgtcccagcccccagcccagccctgcgccccactgtcctctgggaggggggtgcttcatgggcccctcccttcctgctaaggagactgcttcttttttaggtggtggtggggaccctgagcgtgtggacagagtgagttgatttctccaggagctgggggctcaggggttcaggaactgcttcctgggacagcagaacctgggtgggtgggttcccattgtcctcatggctgccctgactctctgaagtggcctgggcgctctgggctgactgtgggggacacatggccattttgagcaccacataggctggtgagccctgctgcagcccaggtgacatcctcaccccacagcctgcaccctagggatggggtgtctgcctgagcacagcactgggggcctggccccagcagcgggtcctggatgtgctgagtctgggctgcctgcggtgacctcactgagagggggtggggatgtcaggtgcagctgcatactgaggaccctgcagcgagccctaggtgtggactcctgagtcggctttttgccttcccaatgtctttttccagagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggtgagtgggggacagatcattttgtttcctggcatgctgctcacctgggatttcgtagacagtgggagagggcagtgccttagctctcctggcccaggggaaatggaacctgaaggagccaggggactgcaggggatggagcagctgcactgaggtggtgaccgtgccagtctgcaggacatctgcttcttactccctgtcctgtccttgctgtgtcccccgagcctggagctccacaggcatagagtgggggtcacagggttcattgatgagtgaataaggctgcacagtctccatcgtatgctcctaacagaagtcagtgagcccttgcttgtaacagcaggagttttaaatttactctgaaattgttattacattgaacatatttcaaagttcgtagggcagcttccaaaaagtaggattccaagtcgatgcacaaagggcttttgtattggacacacgcacacaatcagttcatatcaatccatcagttttgatgtgatattgagtaggcaggaaatctgtatatacatttattgttcattgctcgtaagcactgaaagtccttccctcgaacataagatgagactatccagtttcctgcagtgttttatttttaatgatttgatttttaacatacagcaatataatctaaacagaattgaatttttgattcaatataagctgagaaactccctgaattattctgagtctctgtttccttcttccaagcccatttagcaaccaattcttcctttttcccttgcctttgcccttttgccacctcctttgctacatgtcaaatgtttacttttttctctcttcctcttcactcttttttaaaaaaacaaacaaacaaaaaaaactagatcttatccttgaaaatgtcaaatgtttatatgggcagagatctcttccacctagactgtttctgtttcttccttgcatctgtaccactttctttttaaataaagagaagagattttaaaaggaaacaaatgaacaatgccaatacttcctccatgcttattaatgactttgaagatttttttttttgagacaggatcttgctctatcacctgggctggagtgcagtggcaccatcttggctcattgcaacccctgcctcctgggctcatgtcatcctctcacctcagcttcctgagtagctggaactataggcatgtgccaccgtgcccagctaagttttgtattttttgtagagacgaggtttggtcatgttgcctaggctggtctcgaactcctgaactcaggcaatccaccctccttggcctcccaaaatgctgggattacaagcatgagccaccatgcctggcctgatcattttttgaaagcaggtcacccatagccacacatccaccagagtatgaaaaaacttgatcataccaagagccttctttactctttcccagccttttggcccttcttatttcaggtaactacagtggataatttcttgtgattctttgctaaactctttatgcatataccatctaggtacataaatgcatatgtatttatgtggtattgacatgaaaaggattatatcatgtacaacaccaaacaaaactgtctaatatgttttaatatcttagacagcaaatatgttttcaaaattatttttacacatcttataatttagaattagataaaatttagaattataagattttctctagtacccctcccgcccacatagtcactagactttacaaatattaatttaaattaatacatggttctaggaatgattgacatcctttcaacattcaattttattatcaaagaagataatatttcaagtcaagtgttctattatgactcaatcgagatttgggagtttatttcagataaatttttcctattcctcatcaaagctgtttctttgcattttgggtcttcttgtaagtccattttctaatttattatgtctgctgctacttttcttttctttctttctgagatgggtctcactcttgtcacccaggctggagtgcagtggtacaatcatggctcactgcagccttgaccttctaaggccaagtaagctcggacttaccggcttctgagtagctcggacgacagttttgtgccactacacccagcttattttattttattttattttatttttagaaacaggatctcgctatgtcgcctaggctggtctcaaactcctgggctcaagcagtcttcacacctcagcctcccagagtggctgggattacaggtgtgagccaccatgcctggcctctgctatgtggtttaacattcatcagggctaggtgcagtggctcacgcctgtaatnnnnnnnnnnnnnnnnnnnnttgggaggccgaggcggatggatcatctgaggtaaggagtttgagactagcctggccaacatggtgaaaccctgtctctactaaaaatataaaaatacgataaaataattagctgggcatggtggtgcacacctgtaatcccagctacttgggaggctgaggcaggagaatctcttgaacccagaggtggaggttgcagtgagccaagatcgcactattgcactccagcctgggagacggagtgagactctgtctcgaaaaaaaaaaaaatcatcaagacatattcacttttgagtattacaaattaaaccttggggttttaaaaatatacactcctaatctaaaatattgactgctgtatcggcctccttccgagagtcttgcccctttgtctcctgtcttgttgccagacctttcagaacaatgttctggaagtgacgtgctgcaggtctcagggctggctggtggtcggggtcagtactggactgtaggactcctggctctgaccaggacattccccactatgtgttacaggaaccggcagaagctgaaaggtctcagaggaggaggctgctggttccagcaaatgaaggtgatcccactgagagtaagtgttttgctcctggagatgcagcaggaatggagggaatagggacagggtcctaactgctgtccccagaggtcagagggctcttccagagtattccatgctggaagccgtgggtcctgtgctatagaccatctggaccctaaactgtcttctcccatctcttctccccactctacctcatcctctctgcaccctatcattgaccctaatgactctgtccgtcccctcatcctctctcctcctttgttcagggcctgatgtagcccccgcctgcccccgaggacctcctgaggggctggcctgtcctgcacagcaccactaaccccagtgggctaaggagctcttgacctgtgcctcagcccaatttgcagagctgttgtgtaaactacatacgaatgccaaagacttaatgcaaaaaagagtggaaaatatttcactcataatttttgtatattgattgtatattaaattatattttaaatatattcagtaccatacattaaaatgaatgtcacttgtttctgatgttctttaaaataaggctgttggaaaacatagcctcgtgttcctgaccctgtctatctctgaggacggcgaggtgcatcatgttgcacacacgtctcatttaatccctcatcgtcccgagatctgggcagcattgctcggtctttgggttcacttcttgctcagagtctgtttgcctccacctagctctgccccagccccaggaagtgaggccgagctgggtgaaaacagaggtcccctgtcccaggccctgtgctttccacagatgcagaagtggccgccctgggacctgctcccatgacaagcgcagcccaggcagcctcctccctcctctaagctcccgctgcagccactgtctctccctccctcggactctcacgcactttactttctgcctctgtaacgtccatccatactcccctggtgggttctcagccctgtatgagggctgattctctgacgactttgactccccgcagtgccttgcgtgtgggggaggccaggcagtgtgggcgcgctctctgtggatgggaagcgggtgggcactggagcggcaggtttgcccgcacacggggctctccaggttccccgccttgggttctgggcctgatgtggaatcctctgccctttctgagtcccaactcacctggctgtctctgtggctttctccaccagctctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctc

SEQ ID NO: 14067 - DNA, 7653 bp, Human
cagcaacctaagttggcgacaacatcaggcaatgttggcctggcctctctgctgctccttgtttctgacattcctttgttacctgatggtctaacttaagacacctaggcaggattggtcatctccagttcctatggaggagaccagagatagaaatctcaataatataatgggacctgctggcacaagcaagtactctctgcctaagataaaactcatgaagactagctagaaccagtccactttccatagagccagaaataatttccaattaataatatattcccctttcaagtatgtctatatttttgccagggaaaatatcaatcttcctggttcccttgcaagggcaaagttatctgtagcaaagccttttgtattaggaagtcttcctgtactattacccccaactcttcagaagggccagaccagaccctcatctgcacagtccaggatccactcatccacaatggtcaagaggtctgtctttaggatttactgtcacataccctctctacctccatcatacctccagccaagctgtcctcaaattaataccagccatgcacaaaatgtgaacaattacacaagacacacagaaggtctaagtggtaaatggcagctgactcactgactaacctgtatattccatgaactgatgagcagggatttactaggtataacagaagaatcagcagctaaaagaagtgctaacaatgcaggactctgagagggctttttggaaacacaacatttattgtgaaattacacagacaagaatgaaacaaaggtggtgagaattatagcttattacttagaagattaaataaaggaaatcttaccaaattcctggggaaaaaagccagatatataaagaaaattacacaaaatgagcttgactcagaaaataaaatatgaacaaagaagtaccagaaagaacgtcagggaggaatgcatatcagaatattgtagaaaaaatactctttgtggaagaacaatctgagaaaacaggtaacacaaatactgactaaaccaagaaaaccaatacaatgcaattgaggctttaatgagggtatctgattaccttatttgaatgtagaattgtagccacttaattatcagaggtaggaattcaatacaattcttaaaagaaatgaagcagagggtgaattttgtagaatattctagagaaagggaagagcatgaaggaagttttggcaacatgatattgcatggttcctgcaaggaactatatattcagttttctcaggtctagaaatttcctcgtggtttgtgtgtccattttgcattcataacccctaaagatactttaaaatacacaattttggccttcctgtgttgcacaacaagaagcctttcctgacttgagtgagatccacagaagcatgaacaatagctgtagcctgagtaggctgtgaggcagccttctgtcatctgtgtgcccaggagtgtgctgtcctcaaacatctcccagatagcagaaactatctctatcgcatcaaaagttaagctaaatgtgatactctctgtacacacacatcacgagagatggaaataggctataaaaacagccagagatattgatcatcatcaccgctggctgtagcttcactgcccacacacacatacacagaaataaatagcaaagttgaaagtggacaatagtcttaccaaaaagattgaaactctaatgacgtctgaagttcaattatgacaccgtgctgattgcttggacacagttcctttaaaacctttgttcaagtcatagttgtaccttttagaaataaggtacaaacaacatccaacccaacctgttcctctgggctagagtcccagacagaaataagggatacacctgacctgcagtaaggaaagcagaacccagtctctggggtggtgaggcccacccagtgtggagctcaaaggtgccactgttctgctcctctttataaagggagctgccatggttctcccagcacagagttgggagtgactccagagcctccagcaagatgctactgattctgctgtcggtggccctgctggccctgagctcagctcagagcttaaatgaaggtaagacagaaggaggagaagatgtggtgactctgcttggggcttaggaggtgatagttgtaattatggggaagagaggagaatgaaaacacagatggggctgcagaggtttcatgcctaggatcaggagacctgttgtgccctcattccacaccaagggcttctaatttatttaatgtacaatgaaaatccaataaagaatttgtaccaggggaatgagaaggtaagatttgcatttatagagagatagaactgtgctgtgaaggatgcagtggtgaatgcaaggcagattcaggaaagtccagctgtgaagatcctaaactgatctcagtaagtacacagggatgatggtggccttgctctacctagtggatcagcattgatgatggagataaacacacattagagatactgcagagacagaactggataaaacacttgcctgtgtctaactacagatatagaaatatcagattcaatcattgtgatttttctttcccctacacacagtatttcaatgtgctgggagtggtataggtaagattgtattgaaacaattacttctggttaccgaaattgagaaagcttgtgaatataagcaatgtatttataggagatggagggcataagaataccaaaatatcacattgaagtacctggcatgtgtaaactaaattagcattaagtcttgaaggatgctagggaagaaaaaaaggggctcttctatattgagttcatggctgttgctctgtgtggtaacaaccctgcctccccttacaccttcctccccttccagcagcttcacagatggtagctgacgagctaacctaggggatgcatggggtgtggtgagaagtcccctttccctgtagaacacctgtgaatcttgcaaaattcgagatgtaacctttcccatcatcctgtgcttctcttctagatgtcagccaggaagaatctccctccgtaatatcaggtaaatcccaattcactctcaatctgttttaactatcttcttctgcttatgaatggatcagttctccagtgtcttctcaccaacattttcctttagaaattgattaatattagtccccctaataatgcaggcaatcttcatgcaaccttgattttggggaccatgagcagggccaccaaattgaatggcagagatgcttggcttagatgaaaacgggagtgggttgacttccctcctgccaggagtgcctgctgggagatgacagacaaatggccagtgtccttattctgactcctccttagactgagagcccctcaactgcttccttcttctccagcattccactccagagttctagagcttcactgaaaatgcaaagaaattagtgtctgggtcttatttttgtgcatttccccatttagctgcgttactgtaaaaatttgcggcaactattcagtgaatgccgtgtgtcccccacctcctccaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccgcctcatccgggaaagccagaaggaccacccccacaaggaggaaaccagtcccaaggtcccccacctcgtccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggatcaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggtatgattccagtttattcttcaccaagtgctctaagtgttacagttctccaactttattgtgccaatgaatcaactaaaaacccattgacattgtattgtcctagaacccatttctaaagatttgtattcagatactctggaatagggtaagaagaccctgtatttctaacaaactctttaaggaactctgatgttgagaaacaacataccatacaatctgtcttaaattgtgttggcaatgaggaagtagtaccatgtccattcttggtgctctgctttcggtccacaaactcagagatattgcatttaaatttttcacctgagcactgtttgctcattcctgcctcacgccagcctctcgagtccagtattcctgccaaatggtccctgatctttcagcagctaaatggtgtctcattttttacatacttagttttcagtaagtacatgattaagctaacaaaagatatctaatggaatggaaaaatatgaagttaattttaaaggcgtagctcatcctactcaccttccttccttcaaaaagctaccactgttgactttatgggatcttctctttgaaatatttatgtgtgcatagacatacagcattcttttaccctaccactaataccataacttatatgcaggtatatatggtagtcatttaaaaatacacttcttgaaaatttccacatcagtttatgaagctaaatacatctcttcagtggttttctgtttgcttttacaattttatgctactccattgtgtggctgcaccatgatttctttaatcaatccctgtcactggatactgagggtggtttcatcttatcactattataaaataggttctgattatcatatgtgtaaatatatccctgaacaaattcaacagcaatgagtcataacaacctaaggatgatcttttctcttcatcttctcagcaacaatttggagcacattgtgtgcaagggcatcaaaagagtgaacacagaaaaaatcaggaaagaatcacaggaggttgaagggattggggagagaggatgggatctcatgtactctactgcagtaacaccagtgaggaattcgacatttcctgccatgtcaagtctgctctatgaaattccttgtttgtttgtttcaggaagtgaacaagaagatgacagtgattcaaatgattcaaatgccatgacattggaagaaggtggtcatagctctacctttaatataccaataaaataaacagcttacaatttctgattgtggtgtctctttctcagtgtttgtgaatgtggagtgtgaggaccaagaacacattataagaacatctaggaccccttctctttgatgcttccagggagattccctcctctttaatcctaatttagccagctgccatgaaaaatattttactgtttatctccttccctgacttctatttttttctttttctgaaatggagtcttgctctatcacctaggttggagtgcagtggcataatcttggctcactacaacctgcatctcctggattcaagctattctcctacctcacccttcacagtagctgggattacaggatcccaccatcattcctgggtaatttttgtaattttatgtgagatggggtttcactctgttggccagactaggctagaacttctgacttcaggtcatctgcttgcctcggcctccaaatatgttgggattacaggagtcagccaccatgcctggcccttctctggcttctacagcacaaattgaaattttaaaattattttcagattgtttactgatattccagtaattttaaggacaaaaaacacaacaaatggaaaataagtcatagaaactaaaagaaatccctataatttctaagaaactgagtttggtttcaagtgaatgaatatgggtctgtgcttcttatccctagaaccctctctatcccattgaccctattttaacagtgatcacttctctccctccctatgttcctcacctttctttaatgaaacctgaatggatttcatcaagaagtcagcatgacttttaggagcaaagaactgggacactctcagattttagttaagacataactctttcttgctagctctgaactcttaaaaagctacttggtctctcagagcgtcaatttccttatctacaatgagaagaatcataacaactaccttagagtatggagactattcagataacatacataccaaaaaccttgcagagattggcatgtctgcttctcaagcaaggaaggttcaatattagaaaactgcccctgtgcccaccgatagcccagataattcactatgaatttcagaaaaattggaatagaaggatcttgccataatcaccaccaagttgagcaacccacattcagttcaatcccagttctctggcttctctcctattactgtagttgaagcctccctacccctatctcttacctaccctcatgactctgaaccacattacccaatcaaggattttgcttctgcatgtgacccttttgtctcctgattcttacatctatgctctatgggattacttcaatcagcaaaaacctgctgaaacatcacccatttctacagaggttttgctaagactcttagtgcttctttcctaccatattatttgtctgccatttgtattgcaaaagttcttgaaacgtatgtatgtgattatttccccatcccctcccttccatttttttttaaaacacacattaaagatgcttttgttctttccactccaagtctgtcaaggtcatctactgcctccattctactcatttcaggaatcaattctcagtcatccatctcctgtgacccctcagcagtttaacaccattgatcctacccttctttggggaacactctatcagtctttcctggaacctcctgttctcttccctgttttcttctacctctgtctctccctcctacaactacagaattactcctcttccaactctatttgctcttggtaaattattctctaattaattaaggaaactaggatttattctagactcttttcctcttacatcacattacatctagtcaaatcaactatgttatcattgtgaagttcaagcttcaaaataatttctgactgcagccagtttcatcactttcatatctatcagcccatctaagcaagcctcacctgcagtttacaccaaatagttctatttatttcccaacaatcaattacccaccttggccatttaa

SEQ ID NO: 14068 - DNA, 24639 bp, Human
gattctctaggggcagttagctgcatccaggccgtttatgagaagtgtttagtagagctgaggtcagcacagtgcaagtatcagaaaggctcctggatatcaattccagttctggccctgatgttctttgtagttttaagtcaaacaggaaaatttatctgcatattagttctcctatttaacagtagagaagatactatttctctgtcaaatatcttaaaacatgaatacaaagaaactttagacacaaggggttattaatagtttgttgtgtttctgttcatggggaggaggggatgtaaatttcagttctgattcacaaaggagattttgcagagaatctttacaatcatactttgggcttcctttctccagtctcctctgttcttcggataatcttattacctttttggtcattctaagcactacatggattagttcagtatatagattatggccgtataaacctcattctcgctcttggcagataacctaactctggttttactgaaaagattaaagctaatttggaagaattgaactcgcccattcctctcagttttgtgttgatgtatcttcatctctgtggctgcctcccagttgcaggcagaggcagccatctttcttcctcctccagagctaaccctttccctcgtgcccttgatgccccctccacctcttcctattaccactacttggcaccagccacatattagggctcccttgcaaccactttcaaacaaggccaggctttattccatttcaaaaagcacacaagaaaaccaaaatgcttttgcctgaccttgctgtctcttctagtctatttattgctttccttttgcagcaagacatctcaatttcctctttcctcatagccccttagttttgcagtctagcttcctttctctgtcactctattgaaattgtgtcctcaaatgtcacagtggttcccttgtaacttaatctgaagagggtggtgttttagcctcattcttcttattttctcagcagcatcgattttctttctgcctttttctttcatcttccactctgacatagttctctggtttatatttttctgtttatctcctaattgggttttctagaccagtccagtgcatagcatcatggctgagtccaagctcttacattagcctgcctgtagctgaattttaactgccacaaattaactgcatgacctttgtcaaggtaatctccctgtgcctcagtttctccagccttaaaatggagactatagtaggagtattaacctttggtttgatgtaacaattgaatgagatagtctatgtaatatttatcacaacatttggcacacagaagttttaattgaatgttatctattagcataacaataagtgcctctgtctttgaaaatataactgttcttttttcctttcaggacatattttctccctttatgacccaatgcagagcgagacgataactaattattgttaaatagatttatgcacgtgtttggagagtcagggaaggagggctgatgagagagagaggctcctaaattctgcaggtgctgtaattccccggttttaattttgctttgctttttaccaataaatcattttgagagcttaaatcgctcctttcgggacatacggtgtttcttgagcaggaagggacgtcaacggttaaagctcttgttgttggtgcaacaatcagccacgatgaggctgcttggcatggaacacagtgtcccatccttagattaaatgcgctctaacaggattatgtaaggaaggaggcagccacggcggcggctctgtgcaggggtcgcctggaacccgtccattgagtcatgccgccatctcgcggccgcatggggaacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggtagcaagtcatgcttgtgccaccctacaatattcttgtcggtttcattccagaacaattccctcccctgcccaaatactctataaactttgactttcccctcttatttgattctcactttccaacactctgtgccgacccgttatcctggacagaccctgcgtcacctcctaatttcccttcttgtatgttaggaattcagggctgggaaaatttagccgagtcatcacatttggctactacccgggaaagcagccctcccgagtcaggaacgggctccggttcatcacgtggcagccgcctgcaggagccgcaggtaagggacactgttggccggggcagccagatgcagcgggaggcgtcctggctgcacttgggttcccaaaacctttctggaatgtcactctggtcaccagtatgggagctcgacctctagggggtaggatttggtaatgttctctttgtaaaactgaagtgggcaatgttgaccaggaagctgattttgtttgcttttcacaaactatgttaatcgatcaatagttgggttatagatcattctattgtcagcaatataatagaatggcagggactcagggaagatattgacactttaaactgaaatgtctatgcggtctgtcttccctcgttcagctcacaggacattgcctgggagctgaacctaggcttatagcacagtgactgaaaggatatctttcagagtcctaaaatctgctctgccagtatttgactttgagttaattgttcaacattactttaagcccagtttcttcttttctaaaatgaagacgatttttttaatattaattttttttttcatttttttgagacagggtcttgttgtgttgcccaagctggggtgcggtggcccgatctcggctcactgcaacctctgtctcctgggttcaagtgattcttctgcctcagcctcctgagtagctgggactacaggtgtgcaccaccatgtctggctaatttttgtatttttagtagaggcggggtttcaccatgttgctcaggctggtcttgatctcctgacctcaagcaatctgcctgcctcagcctcccaaaatgctgggatttataggcatgagccaccacacgcagcctactattgtcatttataagttcagtgttggaaggatttttaagcaatctaacagtttcttctgctcattttacagatgagataaaatcaaagtgttttataattttggcctcataatataccttttggcttcaataaataaaaggattattgaccaaaaatctaatattttgagtcagaatcattcaagtttgcaaaagcagatgggagtcagtgtaaagcataaaacagtcttctaagttaccccaaatccatgtatcttcagtaagatcaggtagagcacaacctggcaatgaacacaagccccagccggggtcttggggttcgtgaaaaccaaggggtctgcacatagctcactcaggagtatgttccagaggaagaagaattcgttgaagaacgtgtgcagagatgagtaaaactataagcagagctgtgtctttggcttccaaatggccaggtgacctcctggtcttggtcatacaaggctaggcatatgtggtgaccatagaaacccaccagaaaatgtaattctcctaggaaagaatgcctgtcttacgggtgagagggcttggagaaggagttagaacatcctaagaaatcttggaatctgtatactacgttcattcacagtgtgtttaaaacgatcctctctgagatcctgtgttgcaacagatgagaatgatccttttgtttttgttggattgggtgtaaaggacttcatgttttagaaaggagggaggcactgcaggcaggaaggagggcatgggcggggggtgggagttctttaagaagctgcaagtacaagaaacacaaggctccagcgaggggccttgtgaccttgatttaactcctaatttgttttattttttaatgaaacttttaactgaagaatagcatcctagaaaagttgcataaatcatagacaaacagctgctgtgattttaattttatttttaaagtgaaattcaaagtgcttcacaaacatatggtatcaatctcttgttctctgcaaagacactgacctctttctctttctcatccctcggccccagctccctccctgacttccatggtttctgctactgcatgggctcggattagctttatttaatttccaggatagaggttcttctataccaacaggcgtgtagcatcaccaggcaccacatacaaaaagtgcaatgctcaggcccgacactccctgagattcagatccaataattctggggcaggcctggagtttattgttattattattatttatttttattttttagagacaggatcttgctctgtcaacccagctggagtgcagtggcgcaatcatggcttacggcagcctcagactcctgggctcaagggatgctcagcctcccaaagtgctgggattacaggtgtgagccactgcacccacctctggcttggagtttgtaacacgtaccccggggaattctgatatagaaggtgcaaccaacactgagaaatgctctacttttcctgcacccaagattgagatgatccctgacaacctgtaagattaaaccacatcacagtttttctcttgtgatggggaggtagggtttgctagaagaggtagtgagctcaagatgtaactctgtgagtttctctaatcacagatcgaatcttccaggtggagccactcagttctcatttactttgccgtgcatgggagcatgaccttgagttctacttacgcctatgaaggcgatgctggctgcttggtttctgaagcctggggaagttgccttggctggctaaagcccttagctgttatgctaatcttgcaagagaagtcaagcagaaagaacagggtagcaggtttgttttctttaccaatggaaaggagcttcaggcatgattttcttatgccttggaacagagataccagctgttttataatgaggcccacaccctccttggtgagtgggccctcagcttgagggagttttgcttcttttattttgattttgaaatttgagattttttcatttgaaggtaatcttaatgctattaaattcataaatatgctaatttaaatacccaatcctatttatttaaaatagacgttgcaagcgtacaaatattctctccacatgtcagcacccatttagatcatggtttggaaatggggagaatagaattcccttaaactgcaagtcagctggtgtttctttacagctaacgttagcaaaatttatgcaaagcagtaattcacaatgatcttctttatttgttaacccacaaggaaacaccctcaaaactattctgttaaagtgtctgttcagaaatgtggaaaaactgaactatataaatattgaaaagttaaaaattccttaattttttattcttggaaccactaccacaatttacagggcaatatacctgatgtaatgaaaagaaaaagaaaaagaaaaagctatagcagataaaagaccatagggatgttcatctagccaatgctacattgcattatcaatagctgcactttttgcaaactgtggctatgacagtcctgaacaagaaaggttttctgtttaagctgcagtaacttttctaactatgtatcatcgtttcttccgtggcagatttttagttcctaatgcatttgggacaactgtttcaaggtaacttgctgctttcccaaaacttcttgttctttctcctgctaagaactgtatcccttttctgctgtttttatttttttattttttttggagacagagtctcactctaccccccatgctggagtgcaggggcatgatcttggctcattgcaacctctgcctcccgggttcaagcgattctcgtgcctcagcctcccaagtagctgggattacaggcacccgccaccatgcccagctaatttttgtatttttagtagagacggggtttcaccatgttgaccagactggtctcgaactcctgacctcaggtgatctgctcacctcggcttcccaaagtgctgggattacaggtgtgagccaccgtgcccagccttcttttctgctgtttttagaaccttctgttaccatatccaccatttccactaccagatccataacggtcaccacagggactgcctgaacttcttccaccaaaactgccccctttcatgcattcataatttgatcgctgtttccaagatcattatagtttccaccaccaccatagttaccaccaccaaaatttcaatgtaaccatcatatcatccaccactgccaccatatccactaccttggtttccatatcctggtccaccaccaccacggccccctctactattacgaccaggatcaccacccatagtggctaccatcacctccaaatccattctatccactgtcatctcctgcataactgtctctgctaccatcaccttcaccaccatagcctcctttccaccaaagttcccaccacggcaaaaattatctccaccacctccaaagtttcctccatgaccagccaagttgccagatccacttccatgacctctttatgacctggtagactccatctcatttagaaaggacactttttacttcacaattatgcccattaatggcgtggtatatctgaataacaatttcatcatttgtttcatgatcatcaaaagttacaagagcaaatcctctctgttttccactctgcctggcttccataacttttttattttttattattattttttgagacgaagtcttgctctatcacccagctggagaacagtggcatgatctcagctcactgcaacctctgcctcctgggttcaagcaattctcctgccttaacctcccaagtagctgggattacaggcacgtgccaccatgcccagctaatttttgtatttgtagtagagaccggggtttcaccatgttggtcaggctggtctcgaactcctgagctcaagtcatctgcccacctcagcctcccaaagtgctgaaattacacgcgtgagccaccgtgactggttcataacttctgtggtttcaatcttgtcactcttttcaaaggagtctctcaaattatattcttctgtctcttccttattacttcccgacaaacattttctttactgttggatgggcaccaggctttacagaaccctctctagagacagctgtctttggttccgctatatgcccatcaaccttatgtggttgagcacactttgctgcatgagcgtaagtcacaaaaccaaggcccccgagatgttttgtttgggagtttctccttaccacacagtctgtgggtgtgccccattcctcaaaatggtctcttaaacgggcctctgtagtttcaaagctcaggccaccaagaacagttttctcaactgccctgattcccgtgggtcatggctctcctccccgcccccaccttcactggctgcaggggcagatggtgatggcccgagtcgggctgggggcaatcgggtgacagctttgcctccactttgagtttttttttttttgaaggtaatcttaatgctattaaaattcacaagtatgctaatataaataaccaatcctatttgtctaaagtaagattgtgttcaacccctcgttcaacatgggacaggagttttacgtcttttagtctccctgtacccattgtcaggcacctgtcggctctgatctggagcatctgacctgagaatcattaggttctattgaaacatgaagttgttaaaagaaaagccccagaaagaaacaaccaagcatgttttttgactctatgtgaatttaaaatttttaaattttattttagtttcaggggtacatgtgtgggtttgttataaaggcaaattgtgtgttgtgggtgtttgaagtacagattgttttgtcactcaggtaataagcatggtacccaacaggtagtttttccatcttcaccctcctcccaccctccaaccctcaagtaggccctggtgtctgtggccttctttgtgtccacaagtactcaacatttagctcccacttataagtgagaacatgagaacatgcggtacttggttttctgttcctgtgttagtttgcttaggataatgacctccagctccatccttaatgtgaattttaaaatccctttattctggagagaagctacactgtactgctgtggtttctttctgttaatgcagtggttctccaagtgtggtcaccaaaccagccacatcccagtgtcccctgggagcttgttagaaatagaaattattaggccctgctgccgatgcacagaatcagaaactctggggcctaggcctgggaatgtgtgttttaacaagtcttccgggtgattctgatgcacactgaagtgtgagaaccactggtttaatgaggaagcctgtgggaataccttcaatcaaacagagagaatctcagttcagccaggtaactgatggaaagagaaactcttgctaattggtgggggtgcagttttctggggttttattttggtgccccattgcagtggtgagaagattcctgttggccagatatgaaggagatataggtcctggaagttaggcggtgagggagtgttttcatggacctctccagaatggagcaaatccacctggggtttcatggaccaaatccacccagggagcaaggatggcagagaaaccgagtccccatgcacctccagatcaagtgagtcaaatgttccaaagtacagctgttgaaaagggtcaggttgcatcagagaggagtgtgtcttggtttggccaggacttttccagctttagcaatgaaagtcccatgtccctggaagctccccagccctgggtaaaccaaggcagtttgtcactggtcactgtagttcagtgactgcctgctggaattacttggtgggctttaaaaaatactgatgcctgggtctccctccagagataatggcagacttagtctggaggtttagaagttcctcaggtgatcctaatgtagccagggttaagaatggctgcagctgcttgcctgccatctctcctattaaaaaaaataaaacacaaaacacatacaagtcaatggttctaatgcagttgaacccctaccatgtattatatacaaatattaactcaaaatggatcaatgacctaaatagaaatgtgaaaactataaaacgcttaaaagaacatataggggtaaatcttcatgaccttagatgtggcaatagattcatagatttaacactaaaagcatgagtaagaacaacaaaaatagacaaattggacttcattaaaaataaaaacttttctgcacaacagacgttatccagaaagtgaaaagacagcccacagaatgggagaaaatatttgtaaatcatacgtctggtaatagtctagtattcagaatatataaagaattcttacaactcagaaaaagacaaacaacccaactgacaatgagcaaaggatttgaatggaaatttctccaaagaagacatagaaatcaccaacaagcacacgaaaagatgcttagcctcattagtcattaggggaatgcaaataaaaaccacaaaggatagaccacttcatacctactaacatggatctagtaataataacaataataatggaaaataaatgttggtaaggatgtggagaaattggaaccctcatacgttgctggtgggtatgtaaaatggtgtaaccactgtggaaaacagtttggtggttcttcaaaaagttaaacatagaattaccatatgatggccaggctaggtggctaacgcctgtaatcctgacacttgggaggctgaggtaggcagatcacttgaggtcaggaattcaagaccagcctggccaacatgctgaaaccccgtgtctactaaaaatacaaaaattatccaggcatggtggcgtacgcctgtaatcccagcaactcaggaggctgaggcaagagaatcccttgaacccagggtcagaagttgcagtgagctactgcattccagcctgggagacagagtaagactctgtctcaaaaaaaaaaaaaaaaaaaaaaaagaattaccacatgactcagcaattctactcctaagtatatgccccaaataaatgaaagcagatacaaatagttgtgcacagatattcatagtagcattattcaaaatagccaaaacagggaaacagcccaagtgcctatcaacaggtgaatggataaacaaattgtggtataaccatacaattgaatactattcagccataaaaaagaatgaaatactgatacatgctacaacatggatgaaccttgaaaacaatatactaagaaaaagaagccagttataaatgatcacaataatgtatgattctatatatgtgaaatattcagaataggtaaatccatagagacagaaggcagattaacattgcctgaggctgggggaggatggaatatggaatgaatgcctaatgggtgcagggctttcttttggggtgatgaaaaagttttgatattagaggtggtggttgcagaacattgtttgaatgactaattgtatgttacatggatttcacctaaattaaaagaaaatcatcaggttactcatatctacaaagtacaattgaaatcaagctctttagaagtcagagtcctccacagctggcctttagctagcctctgtagcctatcttctacctctctcctactattttaattgttactgctaccatcaccatgatactgcatgggatcccgttgactcccaatgtgtcatatacgctctgcctctgcttccaagctcaccagtgtgctttgggaagtctccaccagctgttccagcccacggtcctctctcgacttcagtggctcttaactttatgcccctcacatgtatacatatgcaacaaacctgcacgttgtgcgcatgtaccctagaacttaaagtataataataattaaaaaaacaaactttatgcccttgccactcaaagcatagtccctgtttggaatcccctgggagcttggaagaaaggcagaatctcgagttcccgctgcagacacactgaacaagatcttcaaattattttagtgcatattaaagtttgagaagtgctggtttgtactagttggacccaagtcaagctgtgatcagaatcacttggtaagctacatttatgtatattatattctttcaataatacatgcgcatggtaaaattacaagctgtacatatacaaaaaaggtgaaaaaagtaagtttccctccaatttcagttcctcggatttccagcccagaggccatctctcttaatgtttcttgtgtatttttccttctcctatgcatatgcaagcatatacgtacatatgtatttcctgccctcattctgattttacacgagtagtaacatactgtacacatggatttgcacttttcactcaacagtatatcgtggagattattttagcacatgttgatctgcccaatattcttcttagtgactgcatagcagtcgttgtaaagttgtatagttgtaatatatgtaatttatttatgttcaaaccattggctggggacagtggctcaagcctataatcccaacactttgggaggctgaggcagaaggattgcatgagcccaggagtttgagacaagactggacaacgtaaaaaaaaataaaaattaattgggcgtggtggcatgcacctgtggccccagccactcagaggctgaggcagggggactgcttaagcctgggaggtagaagctgcaatgagctgtgttcctgccactgcactccagcctgggagacagagcaaaaccctgtctcaaacccctgccccactctcccttcccctgcccaaaccattaaagaacacaatattgtttattacagtgctatggtggctatcctttgtgtatatctttgaacatatgatgtgttcatatctataggattaaagaattgcctattacgtgtgctttaaagtggtaagagatagtgccaaatcctctctaaaaagaggtaccgatttacattctcagagaacttttaaaaacacaaaatttgaggctactctgtatttcaattcatgagaactctgtgggcagagcctgggaatctgcgttttacttctttggtgacagtgataaaagaaatctgcagaatggagtggggaactagagggcagatcccccttgacccccaagctgctattcctcttgggctgccttgggttgctattcatctgtgtgactgttctatctcaccacagtggaaggttcctaaagacaggcctcaggattgctgcctctttatattcttaccccagcacaatgcattgtacaacaatgtttgttgatgatgagtgtctgtggcgcatgtgattttgttttgttttgtttttagttccatggaccaaagacagaggagaatcctgggccagcccctttccatccctacttcccagcccaagcagaaaaggacatcaatgatatctttcttttccaaggtctgacacaaaatattatgaacaaatttctcctcccagcagctgttttgtaagatgtatgtttgcttggtctgtggttagttaggcctgctccactgaagttccttctgaaaaaactttgatgacagttttttttttttttttttttttttttttttttttttgacgtagtctcgctctgtcgcccaggctggactgcggactgcagtggcgcaatctgggctcactgcaagctccacttcccgggttcacgccattctcctgcctcagcctcccgagtagctgggactacaggcgcccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccgacagttcttttaacatggataggatgtttacaggatgacaggaagataagttgagaataatttaacttgctgctaactcaataatacaaatatggaatgaggccgggtgtggtggctcacctctgtaatcccagcactttgggaggctgaggcaggcggatcacttgagctgaggagttctagaccagccggcaacgtggcaaaaccctgtctctaccaaaaacacaaaaattagctgggcatggtggcatgcacctgtagtcccagctactcagggctgaggtgggaggatcgcttgagcccaggaagtaggggctgcagtgagttgagatcatgccactgcactgcagcctgggcgacagagcgagacgctgtcttaaattaaaaaaaaaaaaaaagataagataaaaaaggaatgaactgtaatgaaaatccaggaatactaatgaagctttgaaatcaccaaatctcatccatagcaccactgagatagctgaatctcaagccagtctgcccctctaggcccctttctaaggatggtagggaggtggcttttgtcttctttgatcttgtctggatatttcgtcatcttgattctgactctagcacatgttgctgtcttctgggtcctgctgcacaccagggtcttcctgcatgagagctcataggcttgccacaaaggctcagagactagcctatctcttgccccatccctggccctgcaattacttagagtttggtgtttgtgtttgtttgtttgtttgtttttgagacagagtctcgctctgttgcccaggctggagtgcaatggcgtgatctcagctcactgcaactttcgcctcccagattcaagcaattctccctgcctcagcctcccaagtagctgggatcacaggcattcgccaccatgcccagctaattttttgtatttttatagagacggggtttcagggtttcgccatgttggccaggctagtctcgaactcctgacctcaggcgatccgcctgcctcggcctcccaaagtgctgggattacaggcatgatagagtttagttcttaaagtacaggtgtctgcatcagacacacagtgttccccaatttgcattattcatgcatttctcttcctgttcttaactgcatgctcagatgcatgcattctggagttgggacatcctttaagtgccctgaaatgtttgtagatgtgtactacatcagtgctgaaatgtttgtagatgtgtactagatcagtgctgaaatgtttgtagatgtgtactagattaatcctgaaatgtttgtagatgtgtactagattaatcctgaaatgtttgtagatgtgtactagatcagtgctgaaatgtttgtagatgtgtactagatgtttgcagatatgctttgctaattgtgtcaagtgctattgagaggttgagtaagatgactactgagaactgacccttggaattagtcatttggcagggtaggggtgaggggacattagcctgattgcagagggttcaagaggcaatgggaggagacaaacgggagaaaacaagtatagatgtctttcaaggcatttggctacaaaggagagcagaaaaatgggaaagagctggagaagaaggggtaaagggagctctttgaggagtaacggcacacctttccctgtgaaacagatccctattcccacatcacatcaacactgatcaagtcctctttttttcaacttctatcacacccatagctgctctagagcctctccccttaatctcctaaacctacctcaacaccagcctgcactatctttattgccctctttctccatcaatttcttcgttatgtagaccaaatgagtacatttccaacaaaacccagccgtctttagtaggagaaagaaggggtaaaattgagcaggcaatcacgggattttctttagagggagagattggggttgggattggtatgactctgaacactcccaaattaatacatttttgacccatcacccaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtagggaaggagagtggggctcagccagctccccaagcctctccaaccaccttggtgtggagactcccagggctggagtatggtgtctgttgtattagttatctatcaccccggaacaaaccaccgcacacttagcagcttacagcaacacgtgttgattatctcgggttttcgcgggtcaggagtccaggtgcagctcagctgggtcatctgcttaggatctcacgaggctgcaatcaagcgtctgccagactgcattccttcctgaagctcagggttcgcttacatcgttgttggcagaattcagttacttcccattgtgggacagaggtttctgtttttttgcctgctgtatgccgggggccactttcgatgcctacaggccactctgtcacagcaggcagctcacttcctccaggccagcaggagggtgtcgcctcctcctgtctgctaagatagagtcttatgggctgggccgtagtggttcacgcctgcagttccagcactttgggaggccaaggcgggtggaccacttgaagtcaggagttcaagactagcctggccaacatggtgaaaccccatttcttttatatttttgtaaaaatacaaaaaattgcccaggcatggtggcatgtgcctgcaatctcagctactcgggaggctgaggcttgagcagagatcacaccaggcactccagcctgagcgacagagcgagactccatttcaaaaaaaaaaaaaaagatagagtcttatgcaatgtaaagtcatgtccgtaggctggaagcgagtcacaggttccttctgcactcaaggggaggagactcattcagggtgtcactcattcagggtcatcttaggctcatgacacctcagcaatatcagctgtgagagacagagctgcaggaaggataaactcacagctgttacccttcctggtgaatttaagtgatttttttttctagtaatttaatgtttgtttcataaaagatgtttttcccacctcctcctttaccatccgccaacttcagtgtccattttgtctcctccccactataaaggtacctagttctccccaggccctgagatcacccaggtctgctgccctatttgaagagccccactgagcctcacccacccacatgccacactccagattgctctttctgttttccttcctaggctgagttgggctcttgggttgggttaatggaagcatttgtattttaatgagagttgtgcagatcttgaaaaaagccctggtgtgttagttcaagtcctaggttattagtagcttagatgtggggttgcttttcaacctatggggagcagttcctgtgctattactgcttttcaaaccttggtgacaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgatgtaagtaaatcagaaaaattctgggttattgaaatcaaaatgggcttagaaatatgactgtggggccgggtgcggtggctcatgcctgtaatctcagcactttgggaggccgaggcgggtggatcacgaggtcaggagatcgagaccatcctggccaacatggtgaaaccctatctttactaaaatacaaagaactagctgggcatggtggtgcacgcctgtagtcccagctagtcgggaggctgaggcaggagaatcgcttgaacttgggaggtggaggttgcagtgagccgagatcacgccactgcactccagcctggcaatagagcaagactccctctcaaataaaaaaagaaagaaagaaatgtgagctgcgggtggtttgttgctgtgggaacaaggtctctagtattcacttatttattaccacatcttgttgagagactagtactgtgctaggggttgggaggacatgtaaagatgtatagaattttatctctaaccctcaagggtttttttgtctgtttgagacagggtctcactctgtcacccaggctggagtgcaatggtgtgatctcggctcactgcaacctccaccttctgggctcaattgatcctcccacctcagcctcccaagtagctgggactataggcacatgccaccgcagctggctaatttttgtatttttggtaaagatgggttttcactatattgcccaggctagtctcaaactcctgggctcaaatgacccacctgccttggcctcccaaagtgttaggattacaggtgtaagccactgtgcctggtgagttttcatcttaacagagaagtgggtatatttacactgatgatgatgtacactgattgactaacatgtagtcaatgctgtcttataaatgtggcaatagcaatgattagtgtctagtgagccctcactgtgtgccaggcacagtgctaggcaatttacatgaatcatctcatataatcttcccaataaccctgtgagatgggcactgtaattatcttcactttgtagacaaggaaaccaaagcacagaaaggttagaacttgcccaaattcacagagccaggaagtggacatgccaccagctcctctgactatagggctacactcaactaccagatgacaaatcaggctaagcaaaaagtgcaccggcacatcgttcagcccgaaactgagaagagtcagagaccctgactgcaagctaacaagttagcctgccagttattctgtccctgaaagacaagacctacagaacagcgaacagaccgtttatttactcccagagagatttgcatctccccacgccctaattctctccggagccacgtggcgagagccagatgtgtcagcaggacagaaggggagaagaggccttgaccttatgtaacttggagctcatatgggagctgggcacatgtgtctcacctgctccagagacacagagggatttttgctcttgaatgtaagccagtcctctctggggagggagcgggcgaaggtccctacttaccaccctgaagtgtaagcagatgtctccggggagatggctctaaatctcttggaggagccatctgaacttcgaggacttgtttgtcattcaaccacttttatttttttttttgagacagggtctcgctgtattgcccaggctggagtacagtggcaggaacacagctcactgcagcctcaacctcccaggctcaactgatcctcccacctcagcctcctgagtggctgggaccacaagtgcatgccactgtgcctggctaattttcgtagtttttgtagagatagggtcttgttatgttgcccaggctggtctctgaccgggctcaagcgattctcctgtctcggcctcccaaagggctgggatttcaggcatgagacatgtgtctggccttcaaccatttttttaaaccctggttgcctggaatttttgagcagaaatccccggccatgtagaaacacagaaattcttatgcagagctgtttgctgatagtttacatctccattacagatagcactcttcactatctgaggccatgaagctcacccgtgcgtgtgttcccagttagatggttgtcagactcctagcggggcgagcatctgtcttacgtgtctgtacatcttaaagcattagggtatggctttgaatggggtacattctccattaaaatttgttaaacacacacacacacacacacacacactacacacacacatacacaaacactcactaatagagccatgaagataatacaaccctaagccaggcatggtggtgtgtgcctgtaatcccagctacttaggaggctgaggcatgagggtcatttgagcacaggagttggaggccagcctgggcaatgtagcaagatgttgtctctaaaacaaaaacaaaaacaaaaacaaaaaaagacaaaaaccctaagacaatttctgtatgcatcatgtgctaaattttttaaagatacttcacaatatgattagtgttcctcagtcttgctgggtctctgtgaccctcagttctttgtgcttcttccccgctgtgaaggcccaccccagccctcctccctctggtttacctggaggaggacttagactacaaaacactgatataaaaacccgtgcaccatgagtcaggtgtttaggttactatactggctctgttacctgacagtgtgattttgggcaagttccttaagtgccttgggccttggtctcctcacctggaaatgtaatacttggaccaaacagctcaccttggaaagaaagagagggcggagtccactgaaatgcactcagggacaaaccaaccaatcagactggaagcagggagaggtgggagggtgttgggggaagaaacatgattattatatccactgcagataggagaaactcaaaccaaaagcaaagagaagagacttggcaaaaatgctggagtaataaacagggaactggttgaatgaattttggtgcagaaaagaaaaagagaaaaaagaaaagaaaaagaaaaatgaaaactcttttatgtattgatgtagaaagagctctcagactgatgaaaactcaaggtgcacaacaacagtggcatgtgcttccattatgtaaaaaagagggaaaggattatgtgatatacatctttcttctttattttttggagagatacacacaaaacataactttattagcttgtggggaggaaaatttggtggctgatggagaggagtaggaagtagacctacttttcctgtaaagctttttggttattttgaattttgggaagtttataaatgtattctatctccaaaacatgaaataacgaacaaaaaatctgggaaggtgggagtagcactagtgatttcccaggctagtcctctcgtctgctggagaagaggttcattgaagcctttgggccctcttcaagccacccccacccacccagctaagtgctttagaccagatctcaccacccaccctgtaatgtacagtcaagatcgatggctgtgatgtgttctgattgacggctgtgatgtgttctgaccgatggctgtgatgtgttcagatgcagttgccttttggtaatgatctggctttcttattgttttgttgatggggaccgcaggagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggtaagaccttgactctgcaaccaacagagtgacatctccatgctattcataaagggagttgcgagttgagacgccagaccctagggttcctgccagcactgctgtagatacttagcagcgtttctgtgtgcatccttgacaaggtgcctctttggtgtgtaatctctctttgagcaagagtgttggtttccatctgccccacctgcccaagcccagcacctgtcaatgcaagataagctcagggtaatggggttgagggcagagaggcacaggtttaatcaatggtgcagcagcccacataatgaggatatttattcatgcccacttagcttttgtcattgtgcctggtatagatttccacccatggcttcttttcttttctgttcttttctcttttctttccttccttccttctttccttccttcctttcttccttcgttctttctttctttttttttttttgagacagttttgctcttgttgcccaggctggagtgcagtggtgtgatctcggctcactacaacttccgcctctggggttcaagcaattctcctgcctcaacctcctgagtagctgggattacaggtgcccaccaccacgccctgctaattttttgtattttaagtagagatgggatttcaccatgctggccaggctggtctcgaactcctgacctcaggtgatccacccacctcagcctcccaaggtgttgggattataggcgtgagccatcttgctgggctccacccatgacttattaatttcttctggtagttttgttttattcttggagaaaattgtatcccaacaaggttggatcaacttcaggcctgctttggagtgggacttggtgaacgtttcaaaacaattgggagcaaagctttctaccaaaccacttgccttctttaagttactgagagagagattaaatttaggaatccagtactacttttgatgggataataacaaaggctgtgctaaactgtaaagctacgcccttcccaccagtccccaaattatagacatggccattttataagcatacatcctttaagattcaaattttgaaactacctggaagttactttcacactttcagtgggcccctgaccacagattgggtgcaatcctctaggatacttttccttgcttgggattatggaactctctaataaataaaatagtaatattatttttctcaggcttgcaaaacaacatttcaagcctgttctccatatctgaaactaaaggaggaatacagcttccagagtgaagaagatcaaaggaacactaagctctaccagcagctggtgagtgagccagggtaggagagaattattttccggtccctgccctcctggtggttaacacggaaggtggccaagcacaagaaagagttacccccttaaaatgactcaggccaactatgtttatttttttattttttctttttttctgagaagagcaagtgcagtggcaccatcttggctcactgcagccttcacctcccaagttcaagtgattctcgtgcctcagcttcttgagtagctgagattacaggcgtgcaccaccacacccggctaatttttgtatttttagtagagatggggtttcaccacgttgcccaggctggtcttgaactcctgatctcaagtgatctgcctgcctcagcctcccaaagtactgggattacaggcatgagtcagcatgcccggccaagccaactgtgttttgattgtaattgacccatcatacaatgtaaatggcaaaacgcctagaggatcaagcacgagatatatcggcagttccaattcaggtcactagctggatacagatgatgcctccacctctcctgcttatccacatgccctgcactgatcactgcctactagttacattgtcaaggaagtttgttgaatcctgccctcacgcgtacctttgctaatttctttcagagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgttttttttttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatcctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccaggtaactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtccttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaa

SEQ ID NO: 14069 - DNA, 25333 bp, Human
ttattttttctcaatattattttatacttgtctgtttggagattacatattttacactaggtttattctcacatatttggcattcaattgtgctaacgtaagtagcatgattaattttttctaaatatttgggactgttacataaaaataaagttaatttttcttttttcagaaaagctgaacttattttttatttttaataagtgatctgtattctctaaggccttattttgcaccaaatcacacctccacaagtaatgtcagcttctttttctcttatttaaaatcttcattatcgttttctatatttattgctttgttgcattggataagatctccagtgcattttggggagaagggataaaaattgttttcttttctttttgcagatatcacaggtgtggttaacaacattttaccattaagtatgtttgctaagattttttgtacctgcttttatccgagaatgttgtcatcttctattgttcatgtgataagggattttgtcaaaaatagatgctgaatttcataaaattattttgggtttattgaaattcatgcttttatgatacatattatttttctttaatatcatgttaatgtgattaattatattgattgattttcaaatatcaacttgtctttctggaataaactcaagtttggaatgccattttcttttctttatttattgccagatttggtttgcaaatatttcgtttagaattttgacatcgatgttcatcagtaagcacggcctgaaattttccttactgtaatgtctttgtcatgttttgttatgagattgagattacacaaagctctaaaatacctgaagaaatattctttctcttctccccgggaagattttgcatatgctggtatgttgttttttaattaaatggccatcccagggtagttttaattataggctttctagttaatccttacggacaattcaggttttctctttgtcagttttaaaactagttgtggagagatgtaattaaggattacattatccaacatttataggaccatttagatcttctatttattcttttaccaatttttataaattgtatttatctaggaatacatagtttggatatacattttgatatttattggttataagttattcttaagtactttcataatttttcaagatctgcagtagtcacacggtatctgcttttctcattactcatgttgttttgatatgcattttcttttttatactactagtgtcacagtagattgacagtttcattggcttttcaaatagtcaacttcagaggttaggttctccagaagcaaatacaaagggagagtttgagatgcaaaggacttgttaggaattgagtgttgattcagctgccctgaacttaactttgtttaagttacttgacttaaccaaagtttcatagctaataactagataagccattaaaccaattggtctccataactggcatattcaatacagcatagaaaataacattccttaaactctacctgtgtaggaaaatgcaaaggtctattcctaatcttatgctttcttttcttgcagtcccgtggccatctctgccagagttctccactgttgtgtacacttctttcttgttctgatcacagtggttgaacatagcaaatgctgagacatatcaaattatgaggacaaaatattactctttaaaacaatctttattgtgactcagtagcgttttgagtgtcggttcagctaacctgactaggttgcattctttagggcttcatcctagcagtccccaaggctgctctagtgctttcagttctttgatcctccaataaactccctgaaaggacaggttgaataagtcctctgtgctaacattaaggtatgtcagatgaacatttttctcctatggaaacagaaaaaaaaaaacaacagtaaatttcaggtgaaattttcctgcccagatctcccttctcttccttaagcagcacagaccatacaaatgctggatcctttggatatcatcggcactgagctggaaggttctagggtcgtgataccagtaagtggggtacattatggagctctgattcccagagtgctgcaggcccaaagaatgcccaatctcatgagttgcaaccaggaacagattatatcctgaaaaattatagaaaaaaaaaagataaaattaactatgcatagggaatgctgaaagtgtgtgaaataggacaaagaaaaaggagagaacagaaaacgaggaaagggcaaatgttacagggtaaaggaaaaggtaggcaaggagggaaagaaagtaagtagaaaacagaatggcaagatatttggacagataaacttgaagtgaaaaagacacatggaaagaaagagggactggcaaatagaagcaaagagataaggagaaaaaaacacaatctgacaatgtgtttattatgggatcacctgtgttcagaaatgatcccacatctcctcacttataaagaagacctgattcctcagccaaatcttccacctcaccctgaccactctggatccctaaatggaaaccatcaacactgaaccccaggttcccagagagttctagcgatcccaccaaacaaggcatttaccagtgtctgaagctgaccagtgttcattcttgtcaaaatggacaactccaggatttccagaatttggtaaaaaggcatggcctaagataccacctggcccatcaaagggccaaccatcttcatgggctgtggacgacagaagctatgatcacaatgagggtggaggtagaaacaaaggccagaatagtcttaagtaagcctcagagacttaggatactgtgcaacagtctaccactgggggatgtgagagagctaaggcattatctatgcagagaaataaggtggggcccaaaatcttcctactctcttatctagggtaaaaagaaagacagacagatggcagacactgagtaaagcttacaagttagacaacaataataatgataacctcttttcaaaatggtaggggaaaagggaaagagaatttaaactcagaaagtttttataagtaagttggttcaactttgaatagcatttcaatagatttcggagctatgcatcgtctttttggaaggaaaatgtgcagtacccccaccatattcacactgcagccaacacctcttctttatttattgcttcattttactaaaaatgtcttccctattacaggatttgctttgcagtagggttttgtcagactttttttctcagaaactttaataggggggctaggtttttgtttaaggatggaaaccctttgtcctttacacagggcatatacatatccttcttcccatgtcaatttcttaccccactgccagaaagaaaccttgatgtctgcatctccattctgcacttgctggaatatcaaaggggtcacattgctccagatggaaactgcattatatatactgtctttcactgcggatggcttcatatcatgtgggtaattgataatcctgaggaaagcaatctctaaatgaaatagttcagaggaatgggaattatcctagctctaaacatgaataattctactttggggagaatcatttaatagttttaggactcattttggttatttataaagttgagctaatttcagactaattaaatcagaaacttaaggaattaaacatgcaaatatagatttctaagaattttaacaatatcccaaattattcttaggtcagctaaagtctaagaatgacagtcctatctggtggttggggaaaaataagtaaataaaacaatgtgaacaaaattaaattaaattaaatatacagcattctacataaattaaaatgtatagcattctacataatttagtactgcttgctttagatatctcaagtatatttagaatccccaacagaaagagtaacctaggcagaaattaagttttcaaaattgtaccttagaaccatccacacactcacgcattaaaattaaaaagaaaagatttaacaaagggaaaggatagtggttatgctctctactttctaaagagatggttagaggaagctagaaaaggatctggtagtattaccttctctgagggagattttgggctttgagcgggctgccaatgaaagcagaagagagtagaggtacctccaggagagacctggtagaaagccctttgaggtcatcaccccacacattatcctctaggccttagtaacaagcacctgtaagttagagtgtgcttattccacttgcatcttcctggcgagatggaggtgtcggacccatcaggcaccccacagtggggctggtgtagcagagcatgcatctgcatgtcaagtaggtctgtcccattccgatggaattgttgcaggagctgtgtttgtgtctcctgggtaaggagtggcgactccttcttggtcaggaaaaattgatggaaatagccctgaatcagatcaagaaggatgagtactaagagtcaatagggaagacccatatatcagttaccctgggcatagccttctttgagggtctcagaaggacggtacttagtctggccttcctaagtctcctgttctcagtcagatgatggcagccatccctgattctttatgccacagtgaaatgatatgaatgagaagtgacagaataaaaataacatggataaactataacatttttttaaaagaaaaagcttccaagttttaggatggagaaacccaagtataaacgacaggaagatattacctgggaattccccggggaagatggcctctggtctttctgactgatggaggttttcttaatcaggatacaatcaatcactccaggacataaaatttggctggttctgcattccccatttcatttgcatttacttccatttcattaagttacttttaaagagcccgttgtttacctattccttgtctccactgatttttctgccagtctagtgtattaaatgtaaacttctaaatacaaaaaaagcacattgtattgtaattaggctttctctgtctgtatttgaatgctagctggactcaaaatactttaagggcaatgctcatgtctgatacagcttgatctattattccacagttcttatgagtacttgacgtaaacctattgactgttttttttaaattatatgactgcatttttatgcctttgttttattatcagctgagctgggcactaagaggcaaatgacttattgtattgttctggactaaacattagcaggaaatttgactaggttcctatacaattacaaaatacatgactgcaaccagttataacattttttaggtattttggatgcttaaaagtttggagcaaattcataatttttttagaaattgaaagtgtgtggtagaccgactgggagattactcagtcaatgtgaaggtcccattaatttatttgaatgatttcccttgatctctcactccagtatatagatcagagacctatatactggagtgttcactctatgccatatagaagactaagaaagtgagagatgagcaatggggctgaattaggcacagaaggcacagtgcctagggcccaaaaacacttttaggggctacaaaaaattaatttttttcttaaaattagaagagaaaaatgaacacatagatagaataaaatgttttcatgtgtaatattaatgtgtgtatttatcattataccatgcagtcacacatacacacacacacgaaataagagcccacaatggtcaccatgtaataatgtggtcctgagtcgttcacctacctcaacaaagtcccatcctttatggtctgcagcagggggcactggaacggcgaaacaccagggcaagaagatagtaactcttaagatgacgagctgcatgccaaaccctcatttgtcccactgcttgaattcaggtacacaacttgggccactggatctttatagctgtgccagcaacatccaatgactcactctgccagtttgccctttctttgaatctgtgagtggcgtcatcatccatacctgctgagggcagagtgaccagcatgcaagggtgacaaaagcagccatggaatttatttttaagctcagttcacacctgatggtcctcagcatcccgggccacaggcctggttaaggaaatacaggtcagtctcagaatatagggggcatcattttttaaaataggggggaaaacaagaaacaggaggtgtgtcgaaactcattacagctttatctatagaataattaccagtcagagacattcaatcttgctccagaagctaaaaagagaaaaaagaataaaatcaagggaaataaataatgtctgctgtaataaagatccagatcagagtatgaaaatctccaagacctggcctggcacgatggctcacgcctgtaatcccagcactttgggaggccgaggagggcagatcacaagtcaggagatcgagaccatcctggctaacacggtgaaaccccgtctctactaaaaacacacaaaattagccgggtgtggtggtgggcgcctgtagtcccagctactcgggaggctgaggcaggagaatggcgtgaacccgggaggcggagcttgcagtgagccgagatcgcgccactacactccagcctgggcgacagagggagactccgtctcaaaaacaaaaaacaaaaaacaaaaaaaaaccacaaaaaacaaaacaaaaaaaatctccaagacctatgtaaaagagatctagaaaaacacagaaagaggtagttaatagctatatgttgaagaaaacaaagcattgataataagttgacacgcacacgtctatagatgtacatgtttatgtatatgtatagatacatatacatatatatctcacagcaaaatatttcagctattaccttagaaatcacacgactcggctgggtgcagtggctcacacctgtaatcccagcactttgggaggctgaggaggatggatcacctgaggtcaggagtttgagaccagcctgaccaacgtggtgaaactccatgtctactaaaaatacaaaaaagtagccgagcatgtggcacgtgcactccagcctgggcaacaagagcgaaactccatctaagaaagaaagaaagagagagagagagagggagagagagagagagagagagagagaggggagagagagagagagagagagagagaaaggaaggaaggaaggaagtcacagaactctggaaatgagtcctaactctgctacttaaaagctgttcaactaggccaggcgcagtggctcactcctgtaatccctgcactttgggaggctgaggtgggcggatcacctgaggtcaggagttcaagaccagcccggccaacatagtgaaaccccgtctctactaaaaatacaaaaaaattagcccagcatggtgacaggcccctgtaatcccagctacttgggaggctgaggcaggagaatcacttgaacccagaaggcggaggttgcagtgagccgagatcatgccactgcactccagcctgggaaacagagtgagattctgtctcaaaaaaaaaaaaaaaaaaaaaaaaaaaaaaaaaaaaatcgactgggcatggtggtgctcacttgtcccagctactcaggaggctgaggtgggaggatcatttgagcctgggaggtcttggctgtagtgatccatgatcatgccactgcattctagccttgacaacagagtgagatcctatctccaagaaaaaataaaaaaataaaaataaaagaattaaaatggaagataatgaaagaatttgttaaaaatacacaattattgagggcttattataaggcaattctgtgttttaaacctttggtatagattaaaatatagtataaaaattttataggttaaaaaaaatgagactcaaagaggtgaaagaacatgccaaagtcacactattaatgaatagagaaaattcgcttcaaatctattaacgaaatacttcatcaacaggattaaacaacatgatatatatgtggagggaggtcaacagatagatgagagatagatagatggttactactcaacagcagcaggcaacagaatagacaacattaaaaacatgttgaattaaagacatgggaaaccaaatggtaatcctatttgaggctcaagaacaaggaaagctaattttgcagaaagcaatgagtatagtggttgcctctgtcatggaggggattgttggtaaaggagcacaatagaaatttatccaggaatgaaatgtctatttcttgactgatatctgggtaatacaaatatattcactttttgaaactcactaagctgtacacttaagattcatatatcataccattaaacctctacaaaaataaatacaatttcaatgaattaagaaaataaaaatatagattaataaggtaccaaaagcggcacccatttcaccatgaggaatatagaactgtaatataaatggtaatgtatgtggtcaaatgagcatataaataatcattttgtggatgatattgtaatgcgagtgctatatcccagttaatgttctaaaagaagaacgttatgtgctaaagacatgggtaaataatggaatgtcaaccagaggaattaataaaataagatatatgtgatatacttggaaaagagaatatggttaatctgaaaaaggcaagatggatttaagactgcctatggaaacaatgatgtttgttgttagacaaatatggtatagagattgttattcctgataacctctatcaactttgtaaattatgagtttgttcactaaaatctcatggtgatatagaccttattatattctcatttcaaagattaataaactagggtttggggaatataaaactctttccatggaaatgataaaatattgatatttacatctatatctaagttttaagtcagattatgtattaaatgaggcatgctgcttatcactgctggcagatctccatcaataatatcatcgacatatctttgatgtttctatggcctgactacattcaaaaacctaagctcagtggaatcacaatgaaagaaacaaggtgaaaatgactaaaacttattcaaaatctatagcagttttgaaagaagcaaaaataaaaaaaaatcctctaagtctctcacactttctccggtgttctgaacatagacttctctaggatggttaaaaatcaggttaaatctctctatcccattgaaagaaggtgaccagagaacccccatagagcatggttcctcaatcactctgatgtattcttgaaattctgttgcagaaatgttaataaatgaaaccctcctgaaatttcaaaatattctgttgtacacaataactatacacaatttatatttgtcaattgacaaatttactaacaaattgaaaaaaatgaaatataaagaagccctcatattttccaggcccataaatgacactgtaggctcattaatgacagcgacgtcaagttgcattaatatctgtagcacagactttggaacttggaaggaacccattattcattaaattaataaaagtgttcagtaaaaaaaatctcatagctggtaatgaaatcagaagtgagtgaatacttaacaaactattgatacatacgagcatataattcagatcgctcaacacaggacaagtgatcattataacaacttattgagcgcatacgctgtgccaagaatgcactttcttcatcaacacaactacctgtgaagtaggtgttttatagtattcatcttatagttaaggaaatgaggctttgaggtcatttaattgtcattttggggggtcacaatgctcaaagttatgtatagaagttataaataaagagtattttattctgaaggcagaatctttgatcactggcctggattgccacttttgatgagactgccccgtctttcatcttgacacgcacctctctaatgctgctcctggaactcccagtatgccccatgcaatccgatagggccggcacagatgagcagccatctgtaagcctgacccagcactcaaatacatgagtgctgactgctgagagccagcttaactaagaaagcaaatgagtgacttattaacgattcagctgctgataagggaagtaatgtgttgaaagcacaacagtgtttctcaaaatgtaatatgcatagaatcgcctgtggatattaataaaaatgcagattctaattcaacaggtcttgaataagcctaatattctaaatttctaacaagatcctaggtgatgccaatgctgctgatccaaaatcaaactttttaagtagttatgaggcagaagatattggcaatgtaaggaacaaaagacctgtgaatttaaccagaaagttttaataatggataccagattttatatattatttttaaaatcagaactatggaaacaggcccctatctctcctctcacccccatctatgctttcatctttctcattatggctatagtatttgatctgctgggtataaacatctggcctgtgcctaggacctctcctagcagattttgaattgtttcccatctccttctggaagaaatgagaaaacgtaattttgaagatatcagactgcacggccactttttctgttactcaggtaaagagtgggtgcagggagagtttgtggggcattggaaaattgatgccattgtcatgacactggcagctcttctggagaagattcaatatctaattcattttgacagagaacaaatgctttcaccgcaataccatagtttgagctaatgctaagagaaggattaccaatagagagcatagagggtaatgagataagaaccatggggctgggcaggctgcaaggagccatcgatgccccagtacagcacagaaccacacagtcatttagtgatcatcatagaaagtgtatattttctctcctgaaactattttgcatttgcaatttatttattcaactgagagaatggcatattactggtgtgcaaaggctattaagacacaaagcctgctttaagttagtttaccgtctcatagaatggtctattaaataaacatagaattgtgagacagtaataagcctcagaataaaaacctatacaagctttgctagtggctaattggagtgagatcttaacccacatggatttctatgaggaggtaaatagaggaggtgatgtaacctggaccttacacatttcaacaatgttgtaggaacgctgggaaaaagcctagaacctcaggtcatttcttttgattagagtataggttttgcctgagcaaacctctttcatacagataagaacagagagtgaagtaagaaatggatcccgtagggatttaaaagtcatgtaaatattttataccctttacctcttgtaaatatgtatttatactggtgtttattcagataagtatactacttatcaaaatagtaattataagagtaaccaacttttactgattgttaagtgctatttgtatgaattatgtcatttaattacatgaacaacttttattttacaaattagggaattaagactcagggagttgagtaatttgtcgaaatttagagactttacaattgccagagcctgcaatttttaactttcatacaggcagacgtaaacatgtatagtcatgtgccacataacagtgttattcaataatggaccacattagcatggtgctcccataagattgtaatgaagctggaaattcctatcatgtagtgacattgtagctgtcgtaacgtcataacacattgcatttctgataatgctgatataaagaaactgacttcaccaccaatcctacagaagtatagcacatacaattatatacagtatataattcctgataaagataataaacaactgttattggtgtatgtatttactacactaaaattttatcattcagagtgtactcaatatatatgtatatgtttatatgtgtatgtatattgtatatatgtatgtatgtatattgtgtgtatatatatatatacatacatacatatatatgtaaagttaactgcaaaacaacttcaggcaggtcagtcaggaggtatttcagaagaaggaattgttgttataggagatgacaactccatgcaccctgaagaccttccagtgggacaagatatggaggtgtaagacaatgatattgatgatcctgagcctgtgtaggcctaggcaatgtagtgtttatgtattagtttctaacaaaaagtttaaaaaagaaaaaaaagaaaaaaacttaaaagtataaaaagcttatagaataaggatataaagaaaaaattttttacagttatacaatgtggttgtgtttaagctaagtgctgttacaaaagattcaaaagtttaaaaaattgaagtttgtaaataaaaaagttataagaagataggttaatttattattaaataagaaagttttaagctaaatttagggtagcctaagtgtacagtagtgtacattcactcaccaatcactccctgactcacccagagcaacctctaggcccacatgctccttttatagtaagtgccctaccaaagtgtagcatttttaatcttttatgttgtgtttttaccatacattatttatgtttggatatacagatatttactattgtgttacaattgtctatagtatttagtacaatagcatgctgcatgggtttgtaacctaggaacaataggctatagcatatactttagctatgccatctcggtttgtgtaaatacactctacgatgttctcatgacaatgcatttctcagaatgagtatctctatcattaagcgttgtatgacatacacacaggtatgcacacaaacacacctatatgttttataaaaattatacatgcttatatttttaaaaatcaaacagtacaaaaatgtgagaaaagaaacaacagttccttgactctcctttgccatcttcagtacactctctaaaggaagcaattttgagttgtttaaatttcttcttttataagtttttccagtaataacattcagctacttaactaatatgtttatattgttatttattgatttgcagttttagataatatctattgtcatataaataagaattcaccttaactgaaagccccttaagtcctgtccttcttaatatgtttatgttatgattttattttcttcattgtgtatgctaagcttctaaacaatattatcattgtacttctcattaaaacagatacaaataatatttcttcacccttcacttaggaaaatgaggatattaatgtccacaaatacttccttcaatgaactatatttttacttaaaaattgtttatattattttgtcaccacaaagtaatctttcatatttttcttcaaataatttcttcatattttcaagaaataacatgtataattctatgactatgggaatataaatagcacagaatttttgcatatccattttatttgcacaactttcactatttcgttgggtttttcattagtttacttttccttttgcattatcttgtcttagtaatctccttaaatttaaattttttcatattttatgttttattttgttttccatccctatattttgttctttgcttgcagtcaagtgttcaatatatacattgtataaaagaccttcatgtaatgttaccccaaaagaaaacatacatgggtcatggaagatgtggtgtcttctgccctcacaactgtggactcttgttatgttaaattcactggtttcgaaaggaggtacactttttccataaataaactacagctatcatctggaaactttggtgtctttatactcagaaaccaaatggccggaagaggactactcatattttcaagggtaactgaccctgatactcaggaaaaagaaaaactgtcataaaacatgcaaaaaagccaggtaatggagctggaataatcctctctggggattattctactgggcaatactcagtccacagctttagcctggattggccaaagttttatcagtcctgtattatacttttacttttctttctgtgaaattctgctttttccccttccctttcacaaatattgaactcttaatacattaagtctatatcatgacagagggtatgagaattaacataacaccggggcaaaactgtaaatgtgaattgctctctgttccatataaacatgaattatttctgattttttaaattattgttttctgcgtgggatagaataaaagtatttatcaaatgaatgcctgtcatgtacctaaggctaatgaatctaagaaatctgtccagtggttgtaactactagttggttgaacttccagcagtctacagtcattttccaaggtatagctggagtctgcagagaccacacaagtgcattaaaaggagataagttagggactgtgatgctaagtttcatcagccaccctggggtatggtatttgttttggaattaacttattagccccagacatttggaggcaatttcatagaactctgtttggtctttctcactataaaagctctgactcattaaactaaggattgagccactaccaaatacatcagtctcaattatacattagaggtatcagtgccaattcagatcctgcatccaacagtcctaaaaatgacacgatgttcatttttcaccagtgtagttactcaaacaagtgactgtcaatccctttggaggaccagggaaatcagtataatgtgtataatggtgttaaaataaccaacctggggatttattcaatcattggtttgcagtctgaacgaattcagatctggaatcttggcaagggctcgcaaattctctgtgaagcaactgctctcagcttcatggttatccatctttgatttcctgtgtggatgcaagccaagtatcactgttgttgctgcccattattttgctcctatggatgcccctttctacatgcttctgggagcaatttccacaaaatgtttgtttcatgtctgaaggttttagctggatattaaattctatattttgtgacaggactcacaagtcatatactctttcctatataatttcattttctaacctcttggactaagcaagctcaatgtatcatgcttactttgtcatatcttgctggtagattctatcttattctcgtaacttctttagggtatagtccttttcttctcttatcagacccaacacctcaccatctgtttatgctgcaaattattcctaatttatgacctggcgttgggaaaataggagaaggtaggaccctaacaacgtaatccttttgttctttctgaaactgctgctagtctgacaaagtaatgaaattacactaatctgaagtgtcagttaagtgatgatacgtgagacaatgtggccatatcttccaggacacagtatgcaaactaaatcaatatccattgtgttaatttttttaatatgaggaaaacatttttattatgaaggaaaaaacagtgttgtcattactaaacatcgcttccatttacccactctgagaacctgtgttttattcccactgtgctgggcactgttggtttagagatcctgattctagaggtaaaaatattgtaccaaaagacataattttattaaactattagagatggcatcatgtcattctaagataccagtaagcaaagaaaataattactttaataatcagaatgagttagaagtgctgacacttgatgtggccaagtaagaatatgcttactgttaggtgatccctgggcatcccttgacacttcttgccctgttttgatgctaaatggatgtctttgtccatttttgcactactgtaaagagatacctgggactgattaatttataaacgaaagaggtttaattgactcactattctgcatggctggggaggccttgggaaacttacaataatggcagaaggcaacaaagaagcaaaggcacatcctacatggtggcaggcaagagtaagtgaagaaagtgaaggcggaagagctccttataaaaccatgagatctcatgagaactcactcactatcataaaaacaacatgggggaaccatccccatgatccagtcacctcccaccaggtctttccctggacacctggacacctggacacctcaatttaagatgagatttgggtggggacacaaagcctaccatatcaatgcacaaatacaaaagccacagtttgagaagtttatggtggccaaggatgaagttctagctaagggtacaggaatctaagctagatagtagaggagagggatagtatataacagttggagcctcaagacagctgcagtgtaggggactttgagtcatcccactaacagttcacctgtcgcttctgaatggacaaaaaaggcctatatgaattctgaaaaagctgcttccagaatttattactgaagttttttggtgaaagtgtgcaacggttgaactgcagctgatgctcagtgaatctcctggatgttcttattctgccagaactgaagcactcattcctctagtgagagtgttatagctgacaggtcacatttgagtccttcttgagaatttctttcttctgaatggaaccactttatccaaagtcatgacccctcccatttaaagactacatccaatggcccgtcaataggttgttaaaaaggcccagacctttcctccaattcaggacaattctgaagtgggatcattttagccctagagatctcttcaagattaaatatagcttttctaacaattgaatggaatttaatttctctttccactagttccatttccttttttccctcatagctgtttaacatagaaacactcccaataaacttctgcacacaaatgtttagctcaatgtttatttcaaagggatttcaacgtgcaacaacatcattatcaaagacaaatatgagtaacacaagagcaagaaatctttaagtaacagtaaaaatacatttatttaatataggaagtactcagactaatagataaaatttaaaaaatgaacaaagggtatatagactggcctctaaaaataaattcaggtgctcttaaacatgagcagaataacgactttcattttataagataaaaattgcatgtataagcaagtagcaaaagtgaatctgaaaactcacagtggcacaaacataatgacttaggaaaataaattgtgaacacttctccagaagaacctataactgcaggcgaaagagcaatcaattctgttgaataaagaagaataggtctcataggatgttaaccttcaatggctaatttacatgcagtatagcaattcagctgattctgtttgagtccactcttatttaaggtctcatctgtgtaaagaaaagacctgtgggctttttaatccctctgggtcttgcttcctgaggtgtcatcctcagaggcctttgttccactaaaaaggcaccaaggtagaagggctagagtcagaccatcaagatcaatacatgggcctaatagccgggatttgagtggctttatcctgggttcagctccttcttaccttgaagtatggactaagcatgatcttggtaagtacctgaaaatcctgatgttctaattgcaagtctcattaatcaagagcattaagatgggtattttatccttaataagctgttatgattttaccatttaatacttgcttccatgtcaacatatactcaaggtttgacaatctgcataacaccatcctgacaacattattatacaaacatcattatcctattaatataaagaacatgataaccttatttaacaactttcatataaatactgaactttattttaacttcattttaaaaagacattctgtatctgttacttcaacttttttgcatttttataaactagacaatttagttgagtaggcatttctgagccaaagacagaatactggacaatcctatctgtgcaatgttctagttcctctagagtctctaaaagtaacatcttttaaagcaaaataaaataatcttccagaaagccatagcattttctaaagaaagagatttttataccctacttttcctcactgattacgaagtactttttaatcctattaagagggctggtataagctcaaagttattagctgggttgaatatggagggatttaaaactcagattttaaaaagtgtacgttgattaaatgatgcagagctattaaagcagttactgtatgtcaaaaacaataccaacatcttggcaacacaaagttttgggagaatgttcgctagagaacatttgggaggaaatcaaaagaggaaccgtatctccatacatccacaggaggaacagcatggaggggagatgaagtcagtgacagagaaggttgaggcagtgaagcctgaactggctgtgtttcatacaaaagccatgcagaatgatctcaagcagcgaaaggtgcacattcttctcaaacgattcacttaccttaacaattttaacattaaatacactttgaacctccgtcctggcaggaaagaacttccaataactctattcagccatatggaataaataagcaaataacaatcttacaagccctgatagaataaatcttcagttttccactgaagacttaatctcactcttttcagattaatatcagaagcaagacttgggagttggaggacactaggcctaacaggcacaaaaagccttcagttggtagttggaccacttgacacacctggattagtgtttaaagcagacagccatcatactggtattagccacagtaataaaaatttatacattgccctcctctgattttgcgtgaggatcttccaaactctaggtaaatattatcttaacacttgcctgatttttttcttgtgttttgtttgtttgtttgcatgtaatttcttattaaatccagaacgtcctaggcatttttaaaaaatgttatttcattttaagttctggggtacatgtgcaggacatgcaggtttgtcacataggtaaacttgtgccagggtggtttgctgcacctatcaacccatcacctaggtattaagcccagcatgcattagctatttctcctaatactctccctccccccacctcaacccctgacaggccccagtgtgtgttgttcctctccctgtgtccatgtgttctctttgttcagctcccacttataagtgagaacatgcggtgtttggttttctgttcctgtgtcagtttgctgaggataatggcttccagccccatccatgtccctgcaaaggacatgatgtcgttccttttatggctgtataatattctgtggcgtacatgtaccacataaaaatccttcctaggatttctttacaaaggtgtatacagagttaagaagatgatgcaaaggcactccgaaatctatggtagtgaggaaacagacaaaaagagaaagaacagcatgggatggtagattttgacaacaaaattttatattgttcctctaagcaatcagtaatcactaagaaaaacagaaaataatagaggatgaatgattctgtaaagaatagcaataaaatcataatgatctaaaaataaattttgtaaaatcctctataaagaatgacaacgtatttttgagagatataaaagattcgaggaaaggaaaagaaaatccatgtttacaacgaagacactatatacatatatttttttttgaattttatgtaaatgttttgaacttttaaaaaatcttacaaatttttaacaaaattttagaccttttttttcagctgaatttttatgacagaaattttaaacaaatttataagcaggacatatattgcaacgttatattaaaaagcaaaagtttcaagtctttgagttggataatgttcgcctgtataattatctcagttgatcagtagtccttgtataggacttgtacctgttataatctgtatctattttaagattagattttgatatcaatttgcattattttttctcggttttttgtttctagttgagtctacctatctatttctccttttaggtttgtgtctaagaattatgtctatatacctggtgttgtaagacctcaatgagttcaataggatagagccaggcatttgagccgatctacttatacctctacagaaaacctcttatgagcttctcatcttttccctcaaatactgggatgtccattctcaatacctctgaaatggaaatctctattttctacttggttgggatcccaggtttggagcatgccaatatttggatctctatccccatatgtctcatgtacactgttgctatcctagggaattgtaccattctgtttttcataaaaacagagccttctttgcatgagcccatgtactattttctctccatgttggctctctctgacctgggactatccctctcctctctccctaccatgttaaggattttcctgttcaatgctccaggaatttcccctgatgcctgtattgctcaagagtttttcatccatggattctcagctatggagtcatctgtacttcttataatgtcctttgatcgctttattgccatctgcaaccccctgagatacacttccatcctcaccagtgccagagtcattcaaattgggcttgctttttctctcaaaaatgttttgttgatcctcccatttcctttcactctaaaacatctaaaatattgtaagaagaacctcctgtcccaatcctactgcctccatcaagatgtcatgaaactggcctgcactgacaacaaggtcaacatcatctatggcttatttgtggctctcacaggcatcctagacttgacatttattttcatgtcctacatgttgatactgaaagcagtgttgagcatagcatcatgaaagaaaaggctcaaggtcctcaatacatgtgtttcccacatctgtgctgtgctcatcttctatgtgcccattatctccctagctgtcatctaccggtttgccaaacacagtttcccaatcactaggatcctcatagctgatgcttttctgctggtgcctccattgatgaaccccattgtatactgtgtgaagagccagcagataagaaatcttgtcttagaaaaactgtgccagaagcaaagctgaagcggatgcttaaccacatgatgcttaacccaaagtcaagaaaacaagcagaatagatcaataagaaaacatactatgttaatcactttacaatataatttctcaatctgttcattaggattaaagaatcaaacttgcaaatctgttggttcagtattcaggcttgggactcttatgtaaataaaatgtattcccaggtttcactcttatgcagtttcccttaccactcctatgaacacaatgtattcttgtcattttcataatgattaaaataatattgtctatgttaatttgaaaattaatggtatacacttacatgataactgggcagtgatcagaggtgaccaaagactacctctttatttaaagtacttattttcagcacatatttttgacatctttgagatatgtgcttgttctcaggaattgaaattaagatgggcaataacactcttgaacatgaaactattcaaaaaaactaacatgcatacatgaaaaatataaaaataaaataaacaatgctttatttactcattttatttaattcaatatctccttccttaacatgaaatgtcattttctaaggtgacagattcctgtctttgacatttcaatgggaattctacctaatgacaaagactatctcctctacccaggttcctctgaactgtgttctcaacttggccttgattttcatatttatctccatattgttcgattttagcaagagtcatgctaggtcagtttaaccaaagccccttcccctccatatctggttactctagatgtttaattgatttcctcatattctaccattcccacttgatatgtgataattctggcttgctgatagcaagaatcctgttaggtcaattacgtgctttagacatttgtcccctcctgatctcatattaaaatttaatccccaatgttggagatggggcctagtgtggagttgtttgtgtcatgtgggtgaatccctcatgaagggcgtggtaccattcttgcaggattgagtgagttctcactctatgttcctgtgagatctggctgttaaaaaaagagcctggctacttcttcctctttcgttttatcttgcttccttcctcttgcctgtgataccttctccctttccccttccaccaatgagtagaggctttctgaggatctcgccagaaccagatattggtgtcatgtttcttgtacagtctgcagaactgtgagccaaataaacccattttgctataaagtacctagactgagacattttcctttacagcaacacaaaacagactaagccaaaatcttccctactcttgatgtttccttttaataattttctacttagtaacctatgtccccaaccttactccttttccatacattcttacttttcactgttcatttagagttgagcccaatccctctccctacaacaagctcctatacatatcacgttactctctgttaataaagtttttcttactgttctttaagcatcataagtaattttttctttaatgtttgaggtgccatgactcaggatcacatgtatcactggacccccagacttttcacttaggaccctgtgtacacacttttgacagcctgttgaatgatagtaaggacagatttgattcttaaggttttgtgtgtactcaagaagctgtgctacaatcccaggtaagcagaaactgagttagaggcccaagttcaggcttctctctttgacaggtaactgctgggctggaagtctttcttcctggctctgtcttgagtggggattattcctcaacttttggggtatgtgttcttcctggatccttattttgattaaaatttatttcctgatttgtgagctggaatttttttcatgatggtttgtgagaacgttttattacttccatttgattcttcttttcctaatgggaatttctcagtcaattgaaattcccttcttgaatatttgccgactgtgtgctccaccaggtctattcactcccttcaccccaggccgcatgctgttgcatcatggcaccattttgaaagcagggtggcaccagcaccataagcccctgcggggcctgagaatcagcccatctagggcctttgctgatatcaccaccactggcaccggtgcacaatgcctgatgacctgaggacaatctttcctgggtctgccactgccatagccaccaccagaaatgcactcccaagggttcaaggacagaccatttggtctcaccagcaccactaaaaacaaccttacttaataccaagaaggaactgctgtgcactagcacttgcccctaaggagactgatgactggcccacctggcacctccatccccagaatagcctcaccacagcctccacaataaacctcagcttaagtggctcacctctctatactcacttgaactccctgtacacatcaagagctttcaaggtgctcaggaaccccaaacagcaatcatctgaggcagaaagagggggaaagggttaactgaaaatagactggatattttatccactcagaggagctttggaaacagccagattgctgcttgatgtttcctcaggcacttgcctaaaaggtagcccacagcttctgtcagattatatatcagaacaaaagaaaatcataagaattccccataaatactggtttaaaaaaagatttagaccttattgagtcagtaacctcaatttattccatttttgtcaaaaatactgtttggacagaaatataaattgtattaaagataagaactactttatataaaccagtgagttttttgtattactatgctttactaactcatagctaagaattttaaaatgaaacgtataagatctctgtggctcgtctgtgtgtttatgcattcatgtaaacatgttatgtagatgcaatatttttctacttctgaatagtattaccaaattagtttataaaataccttaaaggagctttattcaaattggcatgcagattagtgagtgcctgtaaatgaaatattcctaaaattcctaggaaaaaactaaacaaaattattttcaaatttacttgacataggcgtatctttggcaagtgagcctagtttaataacgtttgcttaataaaaacccttgtatcttctgagttatcagcattaaacataataaaaagcatattttactttacttgggtttaaaagttgagtaaggtaatagtatatctactggatgtttaaaattatgaaaattattcaacctaggaacatgtgcatgagtaaagatgcagttaaaattaattgtttaatataaatactttatgtatgtcaagcacagcagtaaaacaaacaaacaaaaataaacaaaaatgtatctaactttttaggtttctacttttgtaatgtttacctaacatgcctgtcatataaaaagggttaacaggtaaattacttgagatatgagataatggctagctttgtttggtgttatgtttaccttgaaataatttccagaatattttagtaacttgcaaccttaatgttaggctaagtttcattaataatagatatttgttaagtatctaggtcatttctaataagataaactagtacaatattcattactaagcataagtttaagtttacactcttttggcatcttattgttatatgttttatatgagttacttatacttgagttcattaataaacgtttttgtcacattgaaaaattgttctatgagtaagtatatgcctctagaaattgtgaaattatgtattaataaatttgcaatcctgttaccgaatctgggcttatgacaattcacatttgtctattttctgttatagttttctctgtaaagaaagaaactgatggttaaaagttataatcaatgtatgtggacaaaactacttaaataataaggaaaacaactctgtttaaaaaacatttaaggaaagtccagtgtgttttcaagaagaaaaagtatgaagtatgaaagatatgatgttgtttaggaaagaaaaaggtaattgtattctaaagtaatttcattctaaagtatgactgggtattcctgaatgaggaaatgaaaactcacatggatatttttcaaaggtatagattgcttgtaaagaggaattttatgtgtggtcaagttgactaaa

SEQ ID NO: 14070 - DNA, 25010 bp, Human
  misc_feature (1)...(25010): n = A,T,C or G
gaggcagaggcagccccccaaccccacttcttcgtagccagcagagacctccgagcaccggcgccctctaaagccgaggtcaggggccaaatggacctaaagtgggaatcctcctttctccttttcaaactttttattctcttctacttaaaaggagctttgagtgacagggaatgaaaaccattaccgtggagacgctggggacagactctagacctgcaacctacacagatgtagaatcttccagaggtggggcagggccgggcaacccacccacagactgatgccaggtggcccagctgaccagaggcccccatcccaccacaccagcagcccgtttcacccacagtgcaaacctcctgcctgtctgggcttttatggttgagtagttgtaaaggattatgttttcccttcttccagcacaattgtcacctttgctcttcaagctgtcctctgtcttgaggcagaaaaaaaaggcaccaaggggctctataactgacatgtccataagaggaggaggcagagttcagccgcgacaaagagacagaaaacgcatcggaaaccaaccagcccacaaggactcccgtgtgccccccaaccacgaagcctggggcacgaggtgctggcaggagtcccaggtggggctgaagccctcgccctaccctcctacctccgagcggacgccaccccatgctctcccacccccacatctctgcactggcttcactccacagccaagcagattgcgtggcctgagcctcatgataatgggtccacctcccggattttcctgtcacagccactgaccacggcctgcagttgggaggtgtgtgccctcccccacctctgtcctctctctcggtcctctccagctcctcccacagccagcatggccggcacacctctcccatggtgggggtcagggcactgacaggccacacagccggctgttggtgtggttatgacagcccccattgccacagcttcagccccgcccagctgctgtgcttcaacctccaggagaaagttccatcaatactctcattttacagatgaggaaaccaagggcggggagctttgtgatgagtgcgaggccacacagtgggaattagaacgcatgtccttctcactgtacactccgcccaagctacaaaatggcccacgcaggcccttcagagttcaatgagctccgtaaccctgagtcgaaggcaagctgggaggcctgggggctcagttcaactcaagcactgaccaaactcctcctgcaaatcagccccaggggtcccgttgagaggagccaggcatgtgagaaaatgggccatagggcagtgctgcaagagccatctcggagaagggccacattgggacctggctgggccacagctggcaatctgaggggtcaggtgaccacaagaacactgtggacataacaatgcatgactctcaagtctggctccttaatggcgtggcagcttctgccttggcctgctggatcacttgcactgggggaagccagcctccatgttgagaggatgctcaagcagcactgtggaggcaagcagcgtgccagcctcgtggtgtgccaccttggaagtggctcctccagccctggccgacattcagatgacgcagctctggccaacatctggccgcagcctcttgggaaaccccaaggcagaaccacccattgactaagccatttccaaagtcctgatccacagaaactgtgagtgatgatgaatgattactgctattttaagccactaagttgtggggtggtttgttacatagtaacagagaactaagaggcagaccctgcacagcccttcttggcctaaagaaagaaggtggaagattttcaccaggacgcaaacctcgggcatgtgtggcacctttcactcatgtgtcttttcccattcagccccccatgggcacatggctggagccccctcccaatgtggggctcttggagtaagagtggggtcttgctgtcctctcaggaactccgaggaccctgtgacaggatgatgtacacaaaggatgaagtagcaggtccacagccctctagagaggctcagagcagccaggtcaggagacagcaccagcagagggagggggagaaggcccccaaccatggagccacaggccttcctttaccgccctgcccagcccacagcaccccgcctccccacaggcagagggataggcaatgaagtgtgggcagactgtctcataaaagtcacctacctgctgacagccacacccatccaggactaggctgaacagccctctaacgagcaggacagggcttctctgagctcagggagctgctctgtccagctaaggagctccagagcctgtggtcccgtctcctgcaaccacccgtcatgccctggtcacctattgtctcagcttctccagggagggcctgaggcagttgtttgtttggcaaaagtgcttgacaccttccagaagggggcagagaccccaacacagctccccacataggtgactcctgctgggtgaaggcttccaacaggccccagggtgcccttcacaattcctcttcagagaaccaaagccccactgaggtcccatagaattttagaatgtaaaaggggcatgccccttggacccagcaacgtcgcttctgaactccatccaggagagcacctgccgaatgctggacaggagtgttcatgacagcaccagctggtgacagccccacagggaaaacaagcaaaatgcccagcaaagtggcgtccagcagggcccaggagcaccattagaaagaatagcagctccatgcacagcctccaggaaggagggcccgatgcttgcacgtgaaggagagccatcggcagaagcgcatactggagtgttggaaaccgagtgtatcgtgggaggggtaggtgctggaacattccagaagaatgagccccaacagcagaaaggccagctgagcgagggcatcatcaactttaaccgagccctcctccggaagtttccttctcatgcacacgcttctcagtgcagataccaagaacagagctcatcctggctgataatcagggcgctgggtttgagtctggactctgccccaacctgctgcatgaccctcagctgacatcttcccttttctgggcctcagtgtcccatctgtcacccagaaagtctcctggagacaggaccccagaggattcagtgagcatcacgctccatcctagggagtgggtggtggagtcccttccgaggaactcatgcctgcatggagggcacacgggaggggcagagaggcatgtggcatcgggcctccccatccccaagggccgcagttaggccacagcttcagactcaggctcgattttggtcacaggggcctagaggtcaagcatcctccagcatctgggaaatgtcctccgtgggtaacgggagaggtgcacaggggctgaccccgaatgaccaccagggccagtgaagtgctgtgagagccccgctaggcccacggtgcacacagggcagagccttgaggggcgaggcctccagcgatgagggccacagagccagcaggagggaggcccagccaggacaggcccaagagataagatttgtgttccctgaaagcctagaggacatggcagtcaggtgtggacgacaggcaggatccacagaggtaggagctcagactggcagggctggctcagacgggcttcctggaggaggggttggggttgggatggtcacgaagccgcccctgtgagtccccaggtccctttcgtaaagctctcttggagaaaattcaccttgggcccttcctagctgcacccatacccagcctcatgactcatgacccatgaggttgtcctatctgccattctccctgacctcaccctgcccccgccacatgctgcagggagaagagggaagggaggtccccagcttggccgcagacttctgctttcccagttgacactgacccacgtttgaccacggcagatcctgccccacagcccaggcccacctccagtgcacggccttgagctccagagccgccatcctggtctcccatagggagggatgaggccttcgaggggttcagggcaggcttctgactgacctgtttatggccagtgtcgcccagcgaagaactagctgggggtcacacaggccaggtgggtgcctcccccaccagctgttgggtcagagaccagggcaacccctgagcaagttttcagggtggcttctcctaaattcagcagcacctgcaaattcccaaaagatgtgccaatttcgcctggatttctgcaggctccgggaggatgatgcgcgccactccctccatatcccgccccacctttcccttaaagagttaacagagacctggagcccagcgtcccatcacagcccagtccttgccattcagcgtctagcctcacccagagccctcaccctggcagaaggcaaaactcaggctcagaggacaggcacttgcaggctgggactgggtccagagtctggctgtccggtccctgcctggagctctcggcccatccaggccagtggaaagtccagcaaagaagtgaagcagcccccaccaaaccctcagcaggcagtgggaggggacagagagctccccggtaagcagagagccagcagctactttccatggaaaaaatgtcttaaggtccccccagaggccaggaggccccagccatgactcaagtctctgctgctgaagaatcgctcccgaccagacagcccctcggcccaggcaggctccaccccacccccagctcccatcacaccaaggccccattccaggcagggccccagtgtcaaaccccagggccccaccgcaggctccgtggccctctgaatctcaccctggccatggcgggagccatggggcctcgacaagcacaggccctgctgctcaggcctgtctgcagaggcctcagcggcccacctgcagagtgggaagggggtctgtgggggggttccccgtgggccttaaaagtccaccagaggcttgaccaaggtgagcccagagggagggtgcaggccttggcccctggtagactgagtgccagagggcagggcctgggtctcagggcacagcaccagtcagctgtcaataaacaccggtggatgcgactccgaggcctccggcagacacgctcgtccacaccatggaactgggcttccccttcaggcttcatttcaaggcgtttctgagactacacctggagatgacaggacactacaccacagtccagagaccctgtctgtgacggcctcaaggcagaagtacttgccacgtggcaggcaaacccttcctgccctgggggtccccttgcactaaaaagcctcaggggtctggggcaggtctgggagaggctgtgtccttcgcccagaggcctgggctccatcagggtgcagcactgtccctgggaagcccttggactcttgggcagagaagcagcagagagaaccaccccagctcctgagatttcattgcaggcaggacccagctcaggatgaccccagggcaggagggacagagatagtgaccagaagctggggacactgtgagagacacagaccccggccccaccccacaggacacagagggacacagaccccggccccaccccacaggacacagggggacacagacactggccccaccccacaggacacagagggacacagaccccagctccacccgacaggacacagggggacacagaccccagccccaccacacaggacacagggggacacagaccccggccccaccccacaggacccagagggacacagaccccggcccaccccacaggacacagatggacacagaccccggccccaccacacaggacacaggaggacacagaccccggcccaccccacaggacacagatgggcacagaccccggctttacccgacaggacacagggggacacagacactggccccaccacacaggacacagagggacacagaccccagctccaccagacaggacacagggggacacagaccccggccccaccacacaggacacagagggacacagaccccagccccagctgacaggacacagggggacacagaccacggccccaccccacaggacatagagggacacagaccccagctccacccaacaggacacagaggtactcagaccccagccataccctacaggacacagggggacacagacccggggtccaccccacgggacatagagggacacagaccctcggcccaccccacaggatgctgggacgatggagacacccagccgcatgctacaggacactgtggaaaccgctgatcctggggccattggaaagcagggagccctgagggcctggccatggcccccctgccagcccggacccccatagctctgccttggagtggaagcttagctctaggcaaggccgggccatttctgtccaggagcctgtggggtcagatggggtagatgcaggctgagcaggggaaggcacagctggagctcggagggcgattggggacaacccagcatgtccaaagttagggaccccctctcccagctacagcttccctccttctgggagagacccctgttggtgggctgtcgggctggagcatggccggcagctggcccgagccatgtttcgtggggtgtgtgtcaccacgcagtccgcgagcttcatagtttcccactgacgtcaccgcatggctagaatgtgaagtgactgcaaaccctcagaggcataattgcagttgtctttgcaaagtgaaatcagatggcttttgcaaacctcccccagccctgccttctccccgcggctctcccttttttttttattatgttccttgggccacatccagatgtttcctgcaactacaaccctccaaaagttacacaaagagagcgagagcgtgcagcttcctgcctgcagggtggaagtggcgacgtggcagggtgggggcggccacgtctacagggtgggcgggggcgaccacgtcagcagctggggcagcaggctccaggcaggtcccagccccctgcctccttgtgcctggggtctgggcgctgagagacaaggccggagggccacggtgcatgagggacagccccttccggccgctgcggccctggcccagcagtgggccgagtggagaccgcggccgggaaggagcagggcaccgcggtcaagatcagcctttgggttcgggctgctccgggcgccactcccagctgcgctacttacacgtgtggcctgggagccacgtctccaccggaacctctgtttccacggcgataggggtggttgctgggagctttaattaaaaccagtctctgtccactgctggcagcagggagcgcctcacctggacccaggcacctaggacaggtgtggtctcggaagacacagcagagcccgacacggaggggcttacaggggaagggccttgaaggaggcccagggtttcctgaggcacaggcagggaaggggggccgaggcgaggaagcggctttatcagaggcctggcagctgggcacaaacgccgtgggggcccaaggcgtccctgagagagacgcacgtgagggtctctggagaaggaggtccgccatttccagggaaaggggacacctgtaggtttcccctgcggcatccctctgtcctgtctgcctccctcgcccagaggattcccaactgtagggggcaggcagggctggctcacgcctgacctcagtccacagcctgtccctctctgacctaggccatccctgggtgtaggcacagtccctggtgggcagagctgggaacgtggacaggtggagacaggtgtcaaggccaggcaaaggctcagcaaaatgtctagagggggtaaaatggcccccgaaccttccaagggctgtttcagaaataggacttgaaagttcgtagtcaacccaggctgacacctcctcatcacctgccttcagaacccatccatggaaatgctgacactgcagttcagggtccccaaaccaccctcaggctcagggacgtgctggactggctcacagaactcagccaggcagcgatacccgaggtcagggtttagcgccgtgaaaggacatagcctcgaaccagcaaactgggcatctctagagggcagggtttaggggagaccagactccagcacccaggggtcttctctcagtagagtcgggcagacgatgctcaattctcccagaatggtgtgcaccagccaggggggcccagccacgcctcggggctcagggttcctactgggggtccatcgcaaagacatgcctcactgcccgtgtgcttggccttggtctcatccccaggatgatgagccgatacagcacagcccaaggtcccactgtaaatgacatcattagcgcggtcactagggtggcccaagacccccaagcaaacacagacacttatcacgcagtatatttcaagtggctagaggtcagaggtcacctcccaggagctaggccagagccagacctttctttggaatgtgcagggtgtggacaactcaggcctgctgagttaaccctttcctgcacagtgaccagaacccaccagcaccccactgggaggtgatcagcttgaatgagtcccgactgaggcaggagaggggaggaggcggagaaaaccacagacaaaattacagtccagtgggagccagggcagctggcgtcacctccattttacagatgatgtgggatggaggcaggaagaggggttatgacgtgcccaggtcacagagccagcctgggatggtgccagaaccccaccctgatctcatgcagcttgctcctgtcacccctggccccgcctcttcagcagtggaggagacaaatggggcctggcccatgccttgacgggggccctagaactgggggcctggtggtggctgcctcctgggaagtatcggcgtctctcttgaactaaggtggagcttgggttttgagagcaagcgctctttgcagtggccacgtgctgggccctgctcaaacctcttcggactcccagaaagaatgaggtcgggccctttccaccctgaaatgtgcagcaagcatctgagaaaggggagggcagtgctaaaccctcaggacggagcccagcggctgtgatcccgggcagcagggaggcagtgttaggggagggggaggcctccttgctgcccccaccaaatcacacggaccatagggtgtggattccagaacaactccctctttccacaaaagggaaagccgagacctcgagtgagcagaaaggatgagcctgtggtcacacggagcttgtcccaggccggccgctcccatgctgctgctcccatgccgccgctcccaggctgcccatccagctaaggatgtccctgacacgggttcctttggattcttcatagaaacattttggaagattcatgtctaagggttttaatgaaaatggcagctttccaggctggtcttggatagcaatcgtgagcagccccgccggccagtgctcacctggggccccaaccactcgggagggggagggggcatgttgagtcagcagcaagagagattgcagttagacctaagaaagtccacccaagtgagagccagatggccatgcctggttatagacaagtttcaggagcccctccacagccccccaccccagcacttcctcctataacatgcaggtacagggcctggaagttcacaggcacacgcacagtagcctaaaagcctcagtgatctcgggaagtcctcataaacagtggttggaccaggtgataccgtccaatggtctggccagcatagctcaacgtttatggactcttcggcacgcaggcaccattctgccctcccaggccgataaccagaaaggcatgccatgattcttccaattagcttaattgggaaattggttccatgtggtctcaagggccaccatctatgggagaaggcaggtcagcgggacagcgagtctcccagcaccaacccacagagcccccacccagagggagcttacgggctcagagcaaggagctttattccacacctccttttctccttgtacttccaaccccaccatctggggtggagctctagctcatggtagatgctctgaaaaccgtggctgtaagcagctggacctccaggccccagtgttcgtcactataagatggggaaacgtcaacactggcccagggggcaggaataagatgatttgaaccatgggtctataaggagcacctggtggggaggtcattaaaggcccttggtttcttcaagctgacctggaccttcatgagccctacttggggcaccagggaattgggagattttcttttccctatttcgcacctgaagaactcctgttcatccgtcagtgccctgctccagtgctgcctcctctgggaagccattcagcctcctctacccatggttgcctctcctccatattcccatcgcaccttgattatggcctcctcatggcacagatcagcccacatttgctgcccacatgcaacaccatgagaatattctagacctgcactgtccaatgcacaagccacttgccacatgtggtttcgagagcctgaaatgtgacctgtacaaattgagatgtgctataaggctaagataaacaccaaatctcaaagacttgccaccaaaatatgaatgtaaaatatctcaataattgttatattgattgcatgtggaaattataatattgtttatgtatcgggttaaataaaatattacacttatttcacctggttttagtgtggctactaggaaattttaaattaattacatatatggctcacattggatttctgttgaacagactctgcaaactctgctctctcctggagccaagtacaggacctaaaccatgcaatttnnnnnnnnnnnnnnnnnnnngggctaacaccatgagcctgcctggagctctgattcaccatggtacacctgtgcactgtgaaatgcagacaacttgtgaatttacaaaaccacagttcccacctcttggaactacacccaatttattcatgtgatcagccccagtgggtgcctgccttggagtctcaggggacctggttaagaagatgggaagctctagccagcaaggagtgaagaggtttgcaaacacactcttgaccaagcctaaagactaaatccagaccgtgctcaggctggattgggcctgagggaggggaagactgggaagactgggagctggccttcttctcagggaggagtctataaggcagaggaagggatggagggagagagggaagggaaggagggagcaaagacacaggccaggcaagcctcctgagcaggaggaaacgtttgtgaaaggtgaaagaggcattcgaagggggattgagaagaagcactggaattgctggatgtctgggcgatacatccagcaattccagcacatgtctgcctgggcaacatggagaaccctcagccccaatggtccccgcctcatcaccagcctctctccccatgtgtctctgtgttactctttgcacacctcagttctctcctgcctctgagccttcgtatatgctgttcccccagcctgggatgcctttccctgtattgctgtgtagttgtgctatagacagaatatctgtgtctcaacaaaagtcatgcattgaaatcctaacctccaagatgatgatgttgggaggtgggacctctgggaggctctgccctcatgagtgggatgagcacccttataaaagaagtctctgagaactgccttgctcacttctgccatgtgaggatgcagacagaagcagccagctctgaaccagcaatgggcccttgccagataccaaatccgcaggtgccttgatcttggacttccagcctccaggaccatgagcaataagctgctgtctgtgagccacccagcccaagtggactaggacaggtcggcttcccgtggaggccccacctgccatgctgtccaaatcggcaaccccaccaccacctcccacactcactgccttccccatgacttgattcctcacatgcttatctgggaccaagggctccagctccagatgcaggcatccaccagcctcaaggccaggcaccacaagcaggccccaggcatgccactttctcccctctgtcttcctttgacctcagaaggcaccctcctgaggcttcctgcagtctctggggacaacttagttgtgtcccagtggggttcaactcattagaattcatagtcgctttgtagttgacaaggtctgctccagaaggaccaccacaaatctcccctgggactaatcagggcagatgtcccaggcaccacacttccatgcttctgaaccacagtgttctgcatcccctccctcccctcagcagcaagcaggggaagggcactctccccagcccatgagatgggcagcaggcaaggaggggtgcaggggctctgcctggggaatcgcagaagcatcacacagttctctgccttcactcctggccctgaaagccccttctctgtattttgctcttcatttccagagcaggatgtgggaaacacaagcactggaggaaaaggaggacccttcagctaagacggaatcagggatgttcatatgcgggtccgtccctgcttctacagcccgccacggtccattctggggcagcatcttggcccctaagcatggggacagagagcaaaaaggcagcatctgcaaatcaaactaagcagcatgttccagggctgggcaaatgggagagggaggagccgggaggtggttgccagggaaacatcagagcttagccagtcagcaggggccaccagtttggttgccgggtgcactctgcagggtgacactgccctcaggtggtggatagggatgctgacagccacggcaccagggaccgctatgtcctgagccgatggaggcaccttaggatgttttcccctcgctctgtgtatactaaagatacccaagtagggctgaccctgcatacagctcccatggcctctctgggggagcaagctgaggatattccgttgtgatgaggtttcataagcatcctgacctctggggaagttgcttttgccacagttcccatcaagtgttgccctgcatgccaaggaaacagagccccttgcagggaagacaaagggtccatgagatgcctccttccttgaacatgacaaaattcagtgctgtcatccacataattcagcggcaaagataggttttactgaatttcttcagtaaggtattttcgttttctaaaccctaaaacttggaataattagaggttgccacccagtggggactcagaaaattgcaacccagctttatcagctgttgtaactctccaaacaaaaccaaggtctctgcctatgtgtcgggggtggggtggggtagggtgggtgttcagggactggtggagtttctagagccccaagaggggtgacatgtccaacagaaagaaaccaccaaattccaaattcaggaggacagtggaacaaagtctgctggccttggacctttaagctgtctgccttcccacaccctcgctttccaactcacccaatgaagaacacagctgcacagtgacagtcccatcaagcctgtgtctgctgcacccagacaaagcctcagagtccttctcatcacagtgctgtcagcagcccctgctaccaactagaatggtcaaatggctgtatggccccctcaatccatgttccatttgctcctagttcacttggggttttttggcaaattgtttgcttttctctaaagtatattgtttgtaactcaagtagcttgtttgttgcacccaaagttcactaggtttgtacttactggaaaattcctgggtcctgcccttttgacgtgtccccacccagggccccctgccaccacatgccctccagtgacactgacaccttggctctctattccctggacagtctgcagttggctggccccaggcacctgcagtccaggtgaccccaccttccactctcactaccagccctgtgacattctgccccacagctgggttagactccctgagcacatgcacctccggttctcccaggcccttcactgcagctgggtcctcagtagacccacacacttgtcatggcttctgtgcaagccacccacgtccctgggcacccagagaaaggaccttagtagaaaaggccaatgaggctgcaaagcccggcacctggaaggtctctcgctctcagtctcgcccagctgcccctcactgagtgttggagtgatgccagaggggagccactgcaggtcttggctcaggcagcaccacaagcaaggtgctaggattagccccattccacaggggcagaaactgaggctctgggtgagcgagcagggagctgacgtgagtgactccagagcccacacttatatctcgcaggggcagagcagaagagaccgaggactggattccaggccagcaccaccagcagggcccttggctcctggccactacctgagatacagagggtctgcagagcccatgtcctcctgctcccctcccccaccccatccaacctccaacaaaggaaaaatcttccccaaaccctgcctgtctgttaggaaagctcccctacttcagtcccctggccctggggccactaacccaggtcttactgaccaagaacttgggggatttttatgcaacagcaagagtctgaaccagagaggggtgagatactccccgggtgtcaagctgaggccctggtccaaccacaactcctggcgtgttcactggcactgggcctggaagccaggccatggcttctccaggtgggcagtgtctgggagctgggaccccacttctgcttccccctaccccaatgcacacaggctgctcccaaacaggctgagcctgggggacctttcagactgaaatgcaagagctgaactgtggaggcagacttgccacaagcagccctgtgatggtctcatgcccatcccacagacagtgggcacaccaaacaggggaaaccgagtcacaggcatgtgcaacagtgatcaccagctcagcaggtccagggccaggactccagagaaacccctgcccaccgccaccccactcagcctggaggaagccccacagctgggcccaagcaccctggtgccccaccagccgcatcctcctccctctgggtgatagggcactgagtctccgcacctgactcgctcagggtgctgctccagattctacgtgttcctcctgctcccaggtgagagcagcactcctgaccactgctggtcatgcaccagcctcagcttccccagctgtgacagctaccagggaacaggcctgcggtggcaaatgtgccgtgtgtgctggagggtggacatgctgcttccgacagctgcaccccagtgagtgccgggcgagaggagcccagcgagaagcttcccaaaagcgcctccctccttccaggacgggcagcaggagagcagggaagtgctacaggcccacctggcttccctttgaagcccttaaggaaagcccctctctgatcactctgtgggaacaaggccaccgctgaccagcaaagacaatcttcctgagagtcctgacactgttgtgtaggttgtgagacccgtctctctccagccctgcttcctttgtgaacctgggcttgtcacccctgcccctcctccttcacggagctgctgggaggacaacatgaagcccctggagatgaaggacgttgctacgccggtaagggccaggcagatgtgagaagggcgtgagggccgcgttcagcagccgtgcagtggtgcaaagaagatgctgctgggcaggtgggtgttgggcctgctcaggtggaatccagcagccccccagccccccaggaagaacctgggctacggttcttccacagttacctgccgtgagcgagcactgtgggaagcagcgtccccctccacacctgggccaggatcctcaagtgactcgcaccccaaccttagaagtgtaggagggggcgagggggaaggagttgggggggcagtcagcctcaaaagtcacttcactgggccgggcgtggtggctcacgcctgtaatcccagcactttgggaggccaagtctggcagatcatttgaagtcaggagttcaagaccagcctaaccaacatggtgaaatcctgtctatattaacaatacaaaaaaaaaaaaaaaaagctgggcatggtggcatgcgcctgtaatcccagctactcaggagactgaggcaggagaatcacttgaaccctggaagtggaggttacagtaagccaagatcgtgccactgcactccagcctgggtggcagagcaaaactctgtttaaaaaaaaaaaaaaagtcaccccattggcctcctcccatcaccaaccccgttcccccattctgtgtgtctccactagcacatctgactgtggggattagcaaaggcgtggaatcgctctggaaaagctaggtccttatttctaactgctggaatgtctcacgataggtcttcagtaagcaggttggtttccataaggacttaggcaacagtctgtgacttttttatttttgagacagtgtcttgctctgttgcccaggctggagtgcatcagggcgaccatagctcactgctgccttgacctcccaggctcaagtgatcttcctgtctcagccttgagtagctgggactacaggcatgtaccactgtgcccagctaatttttgtgggggtttttggtggagacggggtttctccgtggagatggggtttctccacattgcccaggctgatctcaaactcctgggctcaagcaatctgcccacctcggcttctcaaagtgcagggattacagggacctcagccaactttttcatatatataaatgctgctttcagtttttaaaattagctttttaaattttagaatagcttttagatgtaccgaacagttgcaaagatactacagttcccatatgccccacgcctagctctgctcacactaacatctcacgttagtctagcacctttgttgcaatcatgagccagcactgatacacctttatctatgtcgcgacaggacattcagtcatcgtgtctcctgaggctccttttggctgtcacagtttctcagactttccttgtctttgatgaccttgactgtcctaagggctgatcaggtgctgtttcagtccgttctcactccgctacaaagaacagtctgagactgggtaatttataaagaaaagaggtttaactggctcacggttctgcaggctgtccaggaggcatggctggggaggcctcaggaaacttagaatcgtggtggaagacgaatggaaagcaggcacgtcctacatggcagcaggagagagagagagagtgaacagccagatctcgtgagaactcactcactattacgagaacagcaaggggcaagtcactcccatgatccagtcccctcccatcaggcccctcctccaacatggaagatcataattcaacatgagttttgggtggggacacagagccaaaccctggcccctcccaaatctcatgtccttctcacatttttgtttgtttgtggtttttgtttttgttttgttttgttttgttttttgagatggagtctcactctgtctcccaggctagagtgcagtggcaagatcttggctcactgcaacctctgcttcccaggttcaagagattctcgtgcctcagcctcctgagtagctagaattacaggcacctgccaccagagggaaggagggaggaaggagggagggagggggaaggagagaggggggagggaaggagaaaagaaggagggaggtaggaaagaaggaaggagaagggggaaggaaggagggaggggaaggagggagcaagtaggtagggaggagggaaggaaggaggtagggaggaaaagaaagagaagagggaaggaaggagggagggggaaggagggagggggaaggagggagagggaaggaaggagggagggggaaagcaggagggaaggggaaggagggagggaggggggaaggagtgagaaagaaggaagaccactgagcctcctctctgtgcttcccaaatgcccccactgacccacacaggggtctctgccctgcccttggacctcaaaggctccgttgctcaccttggagggcaccatggtacctgaccttccccatcccccataatgggcaaaagccatgatgccacctcctggatcccaggccctggaacctgggcctacagtcctgtgcttgtccagaggtggaccccggctcaaatctccaaggattcctgctcaccaccctttgctcagggagcaaagtcggcctggcctcctccacccatgccctgcattagagcctcttcacaccaaaagaaaggaggaagtggctgcttcctcctaaagcattttctgggtgaccaaggccctggtcacaacagccctggaaagtggggagtttgtcctcactttggaggtggggagatggggaaactgaggctcagagagggcaggacccgcccccctccctccttggcgctctgtcctcaccttccctgaccctgctcctgctgcaggccaagcccacctggcacccagtagggctgtgtgcccagcttcccgaacagctgactgctgaggcatcttggtgaaactgggatgaagctggctcctgactggaccgcttgctgcagtgagcaggggtatggctgggtggcggagcgcccaggtgattctgactcacagtaatcaaccccactgccggaagccactgtggcacccacaggcctggaggagcaagaagggactggaggacccgcgctgtcccagcgtcgccagcagggggcagggctgcttcacgccgcagcaggcgccggggcatctgtccttggggacactcgggttcctaatcagctccataaccgaggtggtgggatgggacctggtcctgccttggcctccctttgggcaaactccttcctcgcagggcctctgcgaagtgtggggacacagctctgcaggggctgcgggctccctccgggcatctttacagagggggctcgctgcagaaaggcaggtagaaaatgccagactcaatggcctgcccgccccgatgctgtctgagtccctgccagggggcggctgtgcccatctgagaatccaggggactgggctgaaggctctatgtggcccttcccgatgtctccacgccccagccccttcctcctgaggcccctgagacttccctggcctcctctggtcacccaggtgcagctgtccttgggcacagcgatgacccctcctccgccctgagtgtgcactgcctgcacaaagtgcaggggctgccccgttctctcaggatgtgctctcaggatgcgccccattccccacgtgcgcccttcctcccatcatgctgtctgctggctgatggcagggacggaagcacagggagctcagcggtgcccatccaggagccatgtgtccctgcccccaccgcaggtgcctgagcccctgccccctcccttgcctctcagttcacaaacctccagcccacactggcttgctgtcgttgcctgagagtgacggtgaagaacttatcaagcccagcatctctggtccagagggactgccctgggcaggagtcaccgtggcaaccaaatgccgaagggaggcccaaagctgggttgtcctgcgatgccgcgccagccagcagcctggagtttctgcctggctggtgggagcacggggtggtgttcgtgtccctggaggggcaccaaactccccccacgctcaccccaggaagtcccatagtaacaccctgccccattattaaaacaagcaccaaggccctgggaacttacgggaagcttccccttcctgggcttctcccagagccccgaggggtccgtgtcctgcaaccacagacctcagctttccccttttgtccctgcgctctggcctgagaactccgagggctcactctcaccccaaggacgggtgtccgtggaggctgtgcccagagtccagggggccaccagggcacagagccagcttccaaccgctggtgtctcacacagcagcactcagccatgtgcgcacatgtgcagcaggatgggaggcctctcagcagggaggccacatcccagctcccgaagccccagggccgaccccttttccagaccacggaaggggcccacgtgcttcatgtgtgcaagattatatgcagagaacatgggtgggccagactcagcaagccaggtcggcagagggctgtgccgacacagaggaagcgggtggccacttcaaggactccgccctccctcggggtccattcacacttggacccctctggagaagcccaggttggtctcagtgggcagagccgaggccctggcaggggagggtgtgaagcccagggaggatcctttggatgtgcagctgggacccaggggggctcctaagatggcaaagtgagtcgagactcctgtggcacccaccattcagccatggttgggggcccagggagtggcccagagtttcagagcacagccgcacagccgccgttcccaggaagagggagaatgttggtgtggggtcctgactccaccaagggaggctggctcagccccgcacccaagacccccactgttctgtcgatccttccagggctgagtgcaagtgtgtatgttcatgagtgtgtgtgtgcacgggagcatgtatgggtgtgtgtgcatgggagcgtgtatgggtgtgtgtgcatgggaatatggatgtatgtgcatatgaaagcgtgtatgggtgtgtgcacgggagcgtgtatgggtgtgtgcaactgagcctgtatgggtgtgtgtgcatgggagcatgcatgggtgtgtgcaagggcagcgatgggtgtgtgcacgggagcagttctgcatgggtgtgcatgccaaagcatctgtgtgagcacgtggtgtttgcatgcgtatgaatgggtgcgagggtccatgtgagcgtgtccgtgcccgtgtttgagtatgcacgtgtgtgaatgtgtgtgtgctcatgaggggagtgccatcaggaagtccctgcctttcaggtggcaggccgttccattttaagtctcacccgggagccaccctagctctgggcacaggccacactgtcctctgcccaccaccacagggcaggacctggaccttcagagccccactccccatcttcagtgtgtctggtgcctctcggggagggtgcctggctggacacaggtgcatgagagggctctgggcacgaagaccaaaccaggccgggagcagcccagccccagacagcatggagacagagggcgtttatcacaggagacaatgcagatggggcatcattaacttgttgttattggggcagctgggtgacatcgtgtgttccttggccctctgggtgcacctcctgcccatctgggccagcgtggctgcagaggcgtggatgcttaggcagcctggggagggacaggtgggaacactcgtgctccgcaggcgcccacaggcccagtgcccacggctgctgagaggtgccctcacggaggccccagccccctgccccttggaggagcagcagagcccagtggacagggagagaactctcaagagtatggcccacagaggatgccagcctcgccgcacaggaccggcaggtagggtggacaggagggtgggctggtgggggctgatcgcgggccctcccgctccaaacaaaaaagtccccacacggaacaaacgaactgaatggcgatgtattttaaacgctcatattttgtttctcctctcacacttctccctttgcgtgttccttttccacaattctaatgctactgtccatcaaaccctggcacctgcggccacgatgtttcagagacaatcgtacggagaagccacttcacagtcagtcacaggaaggccagagccggcaacaggacacaacagagcaaggctttaaaaattactcgaaagggaagaaaacccttgaaagcctcaggcccaccctcctgccccgagggaagacacccccattgcggcggtttcctcccaagcctcgccgccgtcacaggagccctctcctctgccatcgtctgtcctggcgtttctcggacgaagctttcacctcaatctctagaagcagaaacgaaacagtcccagccctccccccgccatatccaagtatacatgagggataaaattacatttgtacaaaaatagattttttttttttacctttccagatgctttagacattttctcttatctttactctctttatggatctgtcatcctctctaaagtattagctatgcgtcccagctaaggcattgctaaggattgggaacggctaaagctgtctgctccaaagcatcttaaaatagatgcatctcctgccttgagatattcattcgaacccggatttcaccaaaggagggtccttatgtacttgcttacacgaagcaaatttataggaaaacaggggaaacgtcttgattaaaaataaacacaaaacactggtaaccgctccgcctttcctgggtggcgctggtgtgcggctctctccacacgcgtctctctgtacagcacatacatgtttacaccacacacctgcgtggacgagcaccagatcacgcaccccagctccacgacagggacaccagccgactacccacaggctgcacattccggcagggccctcctgggtgccccacggggaggggctcggggtcatctccagcactgccaccaggccgccagcccagaattcttgggaaacaccgtgctcggaaaaccgaaggtcagggctgtccttcccagaggccgtgtgcttccagggtgcggagggccggcggctgacacaggccccagggtggaaggtcctggcaggccagcttccaagcatgcccgacgcagcctaggggagcccggctctgtggcatcttcactcctgagcctcaggagccccatctgaacggcaaagccgggaggtgaccagctgaggagcgtgcctgaaggtgccggggtgccctgggtccccaggaagcagccactgggaagtgggggccctgcggggaagccgcttcatccagccgggccaaggcggggacaggcacaggtggctaatgagctgatgttagtgctatctttagaaaattaaagattgtcccaccaaaataataataattacaaaaaatcaccttaattgaactggattggtaatactactacaggtctggttaaatagaaattctacctctctactcagtgatgagccgcactccccacacatcaccttttcaaaccaacagcactgtacaactacaaggccgatgagaaagggacgggaaggctgcgggaagtgcccgggacacgtagagcggtgggtaaggctgctgtggccagggaggccaggttctgctttcaggggttggcggccggggggcttcagtgctttacagccagccagccagccagcgccggaaacgacaaagttcccaagaagcagccgaccccccgcaacggaggccccgtccctgggctttttcctctggagccgcgggcattcccaagggtccgggcacggatgggtgggcgctggctgcaaaaggcaccaggtgttggcgttgggtcttttgcactcccaccgctggggccccaagagtacctgcaccctcctgccatttccaccacacccgccaggggcagctggggcttcctggcagtgcctgggaggggcccagctggccggggacctggtacaggtatgaggctcaacactctgcctcaggacggtggatcgggcagggggccacctctagggatccacaacgctgaaaggcaggggtggagggcggcggggaggagaggcttctggaatctctgacagcctgtctcgggcacagactcagctgcaggctccactcgggtgcctaagctcagctctggctgggagctccaggaaggcaaagaatggacactttcttccccaccaaggctggaaagctgcctctccaagccactgcctcccggtccaacctgtaggcagctcccctcaccactgaggaagcccctgctccaggtggggaaagactatggagaaggcgtccacccccccgcatcattcctagactgcggctgggaagacaagaccccctccggtatcccccccatccaccctctgttcaggcacctgccactgacaaaggctgggtccacgggactgaggcgtgaacgggaaaagtactcaggccaaagggagggccttccagtgcaaaagaggcgagttcaacctgagagggccccgcaccaccggagcccgggggcagagcctgcgggaggagcgccaggccgcactgggctgagccagggaggccccaagccccgcccccaccccaccttcaaccagagcaggcgttcagtgaggctcccaagtaaggctctgggtgaacaacgctgtccgtggacaataccaggctgggtggtcccaccagggcctgcgtgtggcccaggcccgagggcgctgcgactccgggttctcagattccaagagtcttttagacacaactggcagccagagagaaggcctgagcaggggtcccaccaatgccccggcagagccactccaggccgcggagcatctgccccacccacgaggctcccagttcctgagcccctctctctccaggccacctgccccctctgagggaaaccaacaggccaccctcctcccctcccatccccgcgggcctcacagatggctgcaggtccgcagagccctgtgcctccagcaaggccagtgaggtggtgatgccccaccctgcccgagccagggccagccctgcaggaaacaaggacaagtctcagcccaccccgcagagcaaggagaagactcaggctggggaggggccggggcactctg

SEQ ID NO: 14071 - DNA, 14390 bp, Human
  misc_feature (1)...(14390): n = A,T,C or G
gccaggtgtggtggcacgcacctgtggtcctagctactcgggaggctgagctgggaggatctcttgagcctgggtggcagaggttgcagtgagccaagatcccaccactacactccagcctgggcgacagagtgagatgccatttcagaacaaaaacaaaaacaaaaaaagaatagagtaagtgaatgaaaagttgtgcatccattacacttttatttatttatttatttatttatttttgagacagggtctcttgctccatcatacaggctggagtgtagtggcaaaatcacagcttactgcagctttgaactcctgggctcaagcaatcttccagcctcagagtccagagtagctaggctttcaggtacatggcaccagacctggctaatttttttgtttgtttgtttgttttccttgagacggagtctcactctgtcacccaggctggagtgcagtggcgccatctcagctcactgcaagctctgcctcccaggttcacgccattctcccatctcagcctcccaagtagctgggactacaggcgcctgccaccacgcccagctaattttgtttttgtatttttagtagagatggggtttcaccatgttagccaggatggtctccatctcttgacctcatgatccgcccgcctcagcctcccaaagtgctgggattacaggcgtgagccaccgcgcctggccgacctggctaatttttaaatatttttgtgtaaagatagggtctcactatgttgcccaggctagtcttgaactccaggactcaggtgactctcccatcttgggtccattaagcttttaactacaaactacactgaaatatgaaagttattcagaatgaaatgaataagaatgcaaaattataatcataccgtaagaatactttctgagtaatcccagcactttgggaggccgagacgggtgagtcacctgaggtcgggagttccagaccagcctggccaacatggagaaaccccatctctactgaaaataacaacaacaaaaaaaattagctgggcgttgtggagggcaccagtaatcccagcgactcaggaggctgaggcaggagaatcgcttgaacccaggaggcacaggttgcagtgagccgagattgagccattgcactccagcctgggggacgggagtgaaactccgtatcaaaaaaaaaaaaaaatgaatactttctgaaagtatttattcatacaaataaagacttgacccgtgaggtaggaacacaaatgggccacggaatcactcattccacagaatataccgagtgcccttgaagtgctgggcactgctccaggattgggggcgtattggtgaaagagaagcaagctgcctgctcagatggcagggaatgggggaaaacagggagacagtttcctgtttgagatgttgggagatgcttcgagtagtatatttactggaaatagacattcaacttggatgtccctttttggaaatgtgcctgcgtccagggctgggttggggccccattgaactttggctctgacacagctgttgccacactcagtggaactgaatctatgtttgtcttccccggcatccttcaccccaactctccccgccacaacatacatcccatgccagcctggggaccctcaaaggtggcttcatcattaggtttgtggctgggtcccactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccgggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaannnnnnnnnnnnnnnnnnnngataagtgggagtggccagactttatgttgaagaggttggcaggagatggagcctgcagggcatggaagccaggctgaggggttcgctagacttaggaggtgtaggagagaaatggaaagatttcaaaggggttggaaaggcataaccagattggttcttcagaaagatcgctctgtctgaatgggaagaatggggagggctagggaaggagattaaacctgagaaaccagctggagctgatgcagtggtccaggggtgagatgatggggacagactccagataccattcatctatctaacatctatctatctatcatctatctacctatctatctatctatctatctatctatcatctatctacctacctatcatctatcatctatctctatctatctatctatctatctatctatctaatctatctatcatctatctatcatctatctatctatctatctatctatctatctatctatcatctatctatctatctatctgagacaaggtttcactctgtcgcccaggctggagtgcagtggcacgatctcagttcactgcagcctccgcctcccgagttccagcaattctcctatccagcctccctagtagctgggattacaggtgtcactaccacacctggctaatttcttttgtatttttggtacggacagggtttcgccatgttggccaggctgatcttgaactcctgacctcaagtgatccacccgcctcggccttccaaagtgctgggatttcaggtgtaagccaccgtgcccagcccagataccatgtattttgaggagaagctgagcattgttgggnnnnnnnnnnnnnnnnnnnnacttgcggcttttgtcattacttgtacatggcaaaaaccgcaattactttggcaccgacctaatacaagtggaatcatacagtatgtggccttttgtgaccccggcctctttcactcagcgtgatgttttcaagattcatctgtgtcgtaacgtgtatcagtacttcattctttttatggttgaatgtactccattgcatggataaaccacattttgtttacttactcataagctgatggatatttgagccaaactggtggacatttgggctgtttctacctttggctattgtgaataatgcttcaaaaggagtgatccctgcctgtcacattcttgagagaagtcacaatagtacctgccacggaagaagtgagtgggtgtgagtctgggagatggcgttgccagacttaaaaaataaaactataggatgcccagatcaatttgaatttcagataaacaatagctattttttagtacaagtatgctccatgcaattttgaggaaatgcttatgctagaaatctttttatttgttatttatctgaaatttatacgtatctgagtatcctggcctggagcccacatttcctgacccttgtttcagatctctttcttcctcagcttattcctccttccctgggacaatgaataatcagaacttttctgccattctcattgaggagaaagagcacatcactaacagttgagtttatacccaggattttatattttaaaaacttgcagccgggcgcggtggctcacgcctgtaatcccagcactttgggaggccgaggtgggcggatcacgaggtcaggagatcgagaccatcctggctaacacagtgaaaccccgcctctactaaaaatagaaaaaaaattagctgggtgtggtggcgggtgcctgtagtcccagctacccaggaggctgaggcaggagaatggtgtgaacctgggaggcggagcttgcagtgagctgagatggcgccactgcactccatattaagggatttattatatgaaattggctcatgcaatgatggaagctgacaaatcttaagattggctgctggcagctttgagacccaggaaaacccaatggttcagttcaagtccaaaggcagggaaaaaacctgtcccagcttgaaggcagtcaggcagaaggaattcgctcgtactcagcctgtttgttctattcaggccttcaactgattggatgaagcccagccacattggggagggccatctgctttactcagtctcccatgggattacccaaatgttaatcccatccaaaaacaccttcacagacacacccagaatagtgtttggccaaatatctgggcaccctgtggcccagtcaaggtgatacataaaattaaccatcacactcctcaagctgaggttgaaagagaaggaatagaagtgagccagatggggaagggcacttggggtagagggaacagtgcctgccaaggcccagaggtaaaggtagcactttgcatttgggaacggtaagtgttcccatgtggggctgcaggaaagggtgaggaagcctgcggtatggagctgggaacatgacaagtcacaggtttgcacagatgagcagaggtctgagttggcaagttgggtttgactgccatggggccctggagcagagccatccaggaggcagctgcctgcgctgcgaggaaaggagagaggtctgcactgcactcagagctctggaggcatcagcagtgtctgctaggcctggaagacatgggtagagattgaaaaagccagccagaagggccagagggggaaagcaagaagagccatgttagaactgtgacactcacgactctcggcctggtctccaatcccaggtgggccagtgaggatgctggagctgggccagctcattcccagcaggggcagataggaggttgttggggacagaaggaaacttttcctaaactggcagtacccacagttcccaatctcctgttgcacaactgagtgtcaggaaacagtcaggtggacttcccaggctgggccaactccaggggaaagcccaggccagcctgtttgccctgttcacaatgaatcaaaccctagctatggtcacaacccataatggccggcagcccaggattggaaaaatgaggaaaagaagagcgagaaaaagagaggctggcaggcagattccagttcctgactgggacatggccctgggtaggtcattctttctctctaggcctcagtttctctctctgcaaaatggggccgatatgctctgcctttcttgccagccacagaaaggactattgttcaataatagtagagtgaacggtatgaaatagaataatatccaatgcttttggacctgcaaaacccagtttcatatggttcaacccaagaatagcaccattcagaagaataatggctacaatttcttgtgcatggacggcacaccaggtggcatgctcggtgcgatctcatgcgcatgtgcatgtgatcccacattttcatctcatacacaatctcgtgggacacatgttgtaaccctggcttttcagatgaggaaactgaagttcaaagaggtttcttaagttgcccaagatcacaaaacaggatttgaacttgagaaaatctttttgggtctttcctcagcccagtcacagagttccccatgaggacaatttgctcagcctatgtattctcatgtggaagcaggtcacaggttggtcttacacagaccttggctctggccttgatgaagaagggtggaatgtgactttttcaggaaatgaagtgtttcaaacaggtgcatttccctgatgacttccagctcacctgctgtgtgacgtttcccacactgcctcgcctctctgggccacttttttcctcatctatataatggggggaatgtcttattttcttgagcctaggatagacacgttttcatgttttgatatctttaaaagagagatgtagcttgcaatcactgaagtacatatgcaatgcagaaatttttcttccctcctcaccccagcttgtctgggggatgcttaaactgacagcgatagttattataatcagaagacccttaggagcaaatttattgtatttaacaagcattttatgggtgtggtagctcatgcctgtaaacccagcactttgggaggctgaagtgggaggatcacttgagcccgggagttcgagaccagcctgggcaacatagtgagacctcccatccctaccaaaaaatcttaagaactttaaaaaaccaagcattacaactatgtaccaatttaatcttcataacaacccaatgaagtaggtaccactattattctcattttacaggtagagatactgaggcacagagaagttcaccaacttgcgcttcaccaccagcctgtactgcctgccctgaggccttttctctctcttttgttcctgcctaacttcttttgacatcctgccagggccagatggaggatagggccagacgagctagaaggactacttaaagcctcagtctttagaggcattcatgcatacctgaaatgttaggagacagagaaaattgtactgtggtagggtaggtgccagatgagcttggaggaattacttggatagtctaaggtggagagtgagacccccaagcggcagcctgagggacagtgaggacactgaagaccacttactcctgccgaggagaggcactcggaagcgcctctgtactgcattcacagtgcacagctccgctttgaatggtggtagctctccttattcacccttcccctacacaggctgcgcctgggatctctacactcgagcagacggagaccccagaccccattggcctaagtgcctgaacgttataaatcaaaagtattttaaatgaagctgacatgtttacatttaagttttagaaatttaattaattatcccagcactttgggaggctgaggcgggtggatcacaaggtcaggagatcgagaccatcctggctaacccggtgaaaccctgtctctactaaaaaaatacaaaaaaatattagccgggcatggtggcgggcgcctgtattcccagctactcaggaggctgaggcaggagaatggcgtgaacccaggaggtggagcttgcagtgagctgagattgtgccactgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattagccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcggtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaaggacagaggtgcttatctgttatttaataaactgttgtgtgtgggtgggtgtgtgggtgggtgtgatatgtggggctctctaaatccctgggccccaatagtccaggtctaatggtggtgctgtccccacacaatgctcagcttctcctcaaaatacatggtatctgggctgggcacggtggcttacacctgaaatcccagcactttggaaggccgaggcgggtggatcacttgaggtcaggagttcaagatcagcctggccaacatggcgaaaccctgtccctaccaaaaatacaaaagaaattagccaggtgtggtagtgacacctgtaatcccagctactagggaggctggataggagaattgctggaactcgggaggcggaggctgcagtgaactgannnnnnnnnnnnnnnnnnnnataatcttcctgttgtccttccgccttctgtttggctttagaacaggcaccagtgcatctataacaccacctacctgaatgtccagcgggaaaatgggaccatctccagcatacggtgagggccatccctcaggcaggagggttcactgtgggaacagggcaggccatcataaggtgggggctggatgtagagccctggaggctttgggcacagagaaataaccactaacatttttgagctctaacgatgtgctcatgaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaacggagaaaggccctgacagccacggtctgtgtgaggctcctgagatctcatgtacagaaagtgcttggcgtggagctgggcacgcagcaggggctgggcacacggtggcccaaaggagccctgggccttcactgatgggctgtgtggccactgacacacctaggcctcctcacctgtaagacagacaccattgtgccatcccatgttctcacccagaggctccttttctcttccagtgggaggccaagagcatttcgctcacttgctgatcctcagggacaccaagacctacatgcttgcttttgacgtgaacgatgagaagaactgggggctgtctgtctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccactcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccatctgagatgaccaccaggggtgtgaactacctcctgcccccatccgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccctggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagttcaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggacgtgtcctcagggtgctcacctgggagacccagaagaaggagacaacacgtaagggtgaggctggtccctggaaatcagttgacatcttgcaaatgtggagccctgaggtggagccaagcccgaggcacagcccactcagtggcacaagccacgaagggccggcctcacccagacctgggggctcatgattgacagcctcttgttacgtgagggaagcagcactcctcccgtggcagaaaagttgggcctgagttgttccatctattccgtatgtgcagctgcgtacaccatacagggtgataagaccatgagcctgaggctctgacaccccagggtccagtcctgtgtcctcaggcaccactcccctttgtacctcctgtcccaacagccaagctccacagggccaagactacagcatcctttgctcagcacccaaaccactgctgtgcccacagcacggaggctggggacaccgagctgatgtcctcagaaggcaagtggacaggacagcctctggggtcccacagtggcctggaactgaaggctcagaacctaaaagaagtttccccatttcaatgttactttcagtaagacaccattttcaaccatactgaggaggatccgctgaaaaatgaaacagaaatgagtcgtgatgggcagggcagggagaagcaagggagacgagaagtggggaacatggaaggaaaagccacgtgaggaagaaaccagaggtcaagagaaaaagaatcatggaggtagaggaagcaaaaaacacacataacaaagaatgtg

SEQ ID NO: 14072 - DNA, 5847 bp, Human
gggagggagagagagcgccgtacaaaatcccctgccctcgaaaaaggtgaccagaacttacgggagctgggctttaaataggaatacagcagaagtggtgcttctttgaaaactctacgaagaaaggactcacagctgttttggtcatcattgtccccccagcacctggagtagcatctgacacattgtgggttttcaaagaaatatgtgttgaaaaggactgaggaagggaaggaggggcgggagaggagagaaggaaaggattttctaattataagagaggctggtccactcagatttgaagacccctcatccaaacatgaactcaaatgtcagcctgatgccaaaatacctatacccggctgttgtggtaactcagaaaaactttgatgagaaatagggattctccaaaaaaatacccttattgctaccccctccaaagttaattaagtgtggcggtgagacccatgctgtttgggctatttatgtaatgaaaagctctgctaaaaatagtacccggaggttcagctgccaggactggtggctgagccagggagcgtggcagaaggtgatcgggaaccctgatccctgcacgaacacaatggttgtgattaaatgatgcttctcatattcaggttgcaaaccgctccaggcaagagcctgggagaggcttaatttatgttttatggagattagcttgcttctgagagggggttccgccatcaactcgatttctgcacacactcagagctcaggagattgcctgctctctgaaaaaccaggaggagctggtagggaaggactggggcgtggaacagggcctcagcttgtttctcgccagttggaatcatatacagccaccactgggagggagccttggagattacctagtgaccaggggctcttatttaatcaagaggcattgcacatgcagttactttattgacgtagtgtttgcactacttcaatagtgcaaagggaggaagggaggaaggagaaaccaccctaatgcccgtgagagggtgatgtggggatgataggataaacctattcatggtgagcctccccacagactgttatgcaaccattagaaggaatgagtgagttctgtccctgctgacctggatgtgggatcacgtgttctgccaagtaagaccagtaagatttagagatgcgttcggagcaggggtggcgtggatgacaggtgacgaactgccgattaaatctggccctctgcctggctttgtacagcccgtggctaagaatggtttttacatttttaaattttggaaaaaaatcaaaaaaaggagatttttatgacacgtgaaaatgatatgaaatttacatttcagtgttcattactgaagttttgttggagtgcagccacgctcttctgtcggcacgtcatctgcatagctgcattcgcactgcaaaggcagagccgagccgtcacaggctgtgaggcagaacgtgtttattacctgacccttttctgaaaaagtttgtcggccaccgccttagagtatgatgacattttgccaaacagcagcaccagatatggttctcagcacttcagaggagtagattcattacatttgtttattcgttcattcattttatcctttattcgtcagatgcttactgtctatctgtggggccaggcaccaggaaccagcagagaacaaacagatgcaggccttcttcttgtggagctgaaagtctgtgtctagatccttcttttctcagtacaagcacttccagcctttccaactctttctcacgagtctcagtgtccagccccttgcatcctgcctcccttctgcctccccagtatgtatcctgattgcccaagtccctcccaaaaagaggtatccaaactggtcccatacttcctggggtcttgccaagaggttgagatctagtagaaggacacatcttgaattgggtcatgctttctatctggtttcaaggtgcttaacatccaacctttgccttttcagctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaatagccctagccattggtgcacaggatgggggcaatgggaggggatgctactgatgggaatgattaagggagctgctgtttaggtggtgctggtttatgttctaggaactcttcatgagcactttgtaaacaccctcttgcttaatcctcccaacggcccccaaaggtagaacttagctcccttttaaaaggagcacattaaaattctcagaggacttggcaagggccgcacagctggggcctgaagagcggtcacctgacttcggaactcgcaagccctttttcccagctacgtggtccttacaattagaagtcttatgtttgaagcctgactgccactgaggagtcgtaagtgttcaaccaacccctccaggatagcactcaagtaaccatgtcaccaatgctgccacttgacgggcctgttgtggggttaaatgagaaactcagctcagttcagcatttattgagcacctgctatgcatcagctcttaccgtggggggggtgtaagttggtggggaaagaggccagtggagtcagaaaggtggggccttgaaggcggctgagtttgggcatgatactgtagattttaggaaaggtgaaagagttagaagcaagggaaagggtaacttaagcagatctatgccttggaaagagggctctgggtacccctaagatgtggaccagaggatgagactgtagacgagggggttgtggcactgactcatgagagaggaaagagaggaaagcaaaatcaaggaggccatagatcttaaaagcttgcagactctgggatgttcagagtgcgggagatgcaagggaggacaacaggatttcccctcccagagggcaccaggcggaaaagatgtatagaatcagaatgagatttggataaattcactggtgacaaagccaatgcaggatcttaagggaaaccacaccaaagacctgagtggcaccgaggaagctcgctgtgaggagagacagcttactggtctgggctttagctgctgaaaagagcaaatgaaagaatgctcagaggatacctggcacatagaagttgctcaataaatgttgctttcctttctcttcccacagaccatggctttgccttccagaatgctggtctgtggaactgacccattcattcattcatttgttcattcattcatttgcaaacattcatccaattcccaccacatgccaggaattatgatgaatactggggatgtagaaatgagattttttgggtttatggtgatgaagttacagaaaatcaatggcacagccctggtctcagctctgccgtcactcaacttgtatcttgagcaagttcctccccatctcaggcctcagtttcctcatcgcatagagagttggtcttccctcaccgggcttcctacttgccctccagagttgcctgaagctcacatgagcgaagggacatgaacatgctctgccatctcccaataggacataagtccacgctggagcgctgagcatcagactcaagaaaagcttgcgtggatattgcagacccaccaacaagggctccaggttctggagttgtggaggcaaaactgcctagtgagaaccctacatattccctctggtccttgcagctgccacccccattcccaggggtggagtgtccctccatagacttggatcctgggccctctgctccttcaccactgtccatctgaagcaagcctggttgctccggcactgaactgtggcctcgggccctggaccctgcccctcaaatccaccctccaagtgcacacctggaaacttccgcttccagtcctgatgggtaaaacgcccacctaccatatccttgcgcaatctcttattcaggaggcagctggagtgcaaagctgacttagttcacaaagtataaaaaaatacagggatgtggttcagctagaaggtggttgccactcttgggtttagtcttgtatatcactttgtgctgccgttacttgtttgagccctgggttaataagccgccttttcagttgagtccttaagggaacttattcattcaataagcacttaacaacaatagctaacattcattgagcatccactactggcccgtttcagatgtctgacattgtttctaggcattagttgctcttcaggggcatcctactcccacccctgcaccaagtgctaagggcacaaagtgagatagagcatcttccaccctgtgccaccctcggccacctgcaattgctca

SEQ ID NO: 14073 - DNA, 5650 bp, Human
tggaaaggcacccagagggagggtctttcactaagggagcagccccagttattcagttggcggggacctggaccctaactggagccaaggtgaagtctccgagtgctaaaggatgggatctgttcccagtaggggcgtcaacagaaagcagcagcagccctactggttagcatcctcctggttagcaccagtggtccttgtcttttttatttatttttattttttttcagacaaggtctcactgctgctagccagtttagaaggctccagacaagtgtagtcataagcggaggccctgacttccccatccagggagggaagtgttcagggcgatgagggttttgtttggaggttggcgaactcaggtcagtagagggagaaatttcaggctgtgataagataccaaggtgaagaccctgaatgagaatctagggaccagcaactccaaaacagtgaagtctcatagagttccacccgtgttgtcagccatcagaccccaggaagctgtgaacagataaggctcttcctcacttccttggaagtgctttgaaggggaggatctggaggcgaggggcacgggatctcttcggcagagggtgaattccttggactgtctggagtcaaggtcaggaccctgaatgtgcatgaaagggaccaccatcccccaacctgtaacaaagagggccacactaaatcctgccccggaagtcttccctgggaataccttgaaagctgtctgacagatatctacctggaaagtctcagggagggaagggccttggtctaagaaagtagccccagttcagcaggtggaagagagacttgggtcctaactggagtcaaggtgagggccctgagtgctaatgaagcaatctctctgcaatagaggtgtcaacacaaacaatgtccttgcactcattttgcaacctccaggcaaaggtattcataggtgaggggtccctgacttccctgtctagggtcttgttctgaggctggaggacttaggttaatggagggaagtgtcccacatcctactaagagtcaaggtcagagacctgagagaaaactaaagggaacactctctctaaaaagtagagtcccacaaattgtgcctcttctctcagctccaggaagccttggaataacgtcagccccccttactgcctagagagtgccagaaaggttgaactaattacatgccccagttctgcagagggaagagtgaggagacccagagccttacaggggtcacagtgaggaccctgaatgaagactagtgatacaactcctcccacataaagaagagacaacaaagattcccccactccccacttgcagcgctgatgaggctgggcatggaggtcaggtgtatgtgaactcaccttcttttaatggcattaggttgctgagagcctttatctaaagtgaggggcatcagagcagcagaggcagctgtcctaggtcctatctagagacaagatgaggactatgaatgaggtgtcaggactccaataagcccaggaaagagtaggactccacaatgctgttagcacccagttcctcctgtcaggggtggtaaggctgagacattccttcacctcctcttaggtggtcccaaggagatgaggacatttgctggaggtgtcaaatttagtgcagcacaggggagaagacccagccctgacagtttttatgatggtcctgagtgtgaactgagagaaacctcctaccccagagtaaaaggagatccacaaggactagacatgccacggctgctctcagtcccagtatacacagaacagggctggcaggctgtggcctaaggcacactttaattactttcacagggttctcagaggacaaactgatcagaacagaagccctctgggtttccagagcagtgctctcacagaaaactgcagaggcgaccttcttttaaatccaaagtggtacctctctgctgaaggcactcataccctctctttctctctctcctccaggtgcctgtatcacctgcccttctgctgacactcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaaccatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtgtttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtgcccaacagtaatcctgcacgctatgaattcctgtggggtccaagagcccatgctgaaaccagcaagatgaaggtcctggagttttgggccaaggtcaataaaactgtccccagtgcgttccagttctggtatgaagaggctttgagagatgaggaagaaagagtccaagctgcagctatgctcaatgatggcagtagtgccatgggcagaaagtgttccaaggccaaggctagcagctcttcccacgcctagtgaagttgaagcaaattttgcattttgtggttaaagagggcagtcactgttccaaggagtgaaggactgggtgttactggagggaacacactgtataataccttttgtttctgttctaaatggataatttgaagttttatctgtattttggggcatatttttcaaatgttccttttatttaacattgtaatctaagtttaggattgatactggtcacatttgttgtttaagagtaaaaattttgctgttttgtaaaacagattgagaaaaattcgatcttatttagtgatctgttgcaagataacttggaattagaataagcatttccttgaaaatgtttaaaaaaaaaaagtcagcagtaaaatgtatggcattaagaaatagagaaagagtgtaagatggtcaatatttggtttcctaaatgcttttactctgtgttttaagaaaatgaaagataaataaccatatatgtctggcttacttaagaatgtagaattaaatcataataaattagacctcatgctgacacactcattctccaagtgttaattgagcatctgctcttggaaggatccatgctaatactgggagggctaagaaaaagaagacctagcaactgaccttaaaattataaggtcgagaagcagctatcatctaaggaaaatggtgatatacactctaagaccaaaaggatacatgataagaagggagggaggtggttccacatgagaacagtcaagtatgaattatctaatcaaggcggtgttgggcctaaggaaagtgcaggtccctcaatgggagttaatctaagtgaggctccatggtgggctggatgaggctgtgggaatggcgagcaggggccaggctcttagaagttgcctctcacgcagtggcgggcgcctgtagtcccagctactcgggaggctgaggcaggagaatggcgtgaacctgggaggcagagcttgcagtgagccgagattgtgccactgcagtccggcctgggctaaagagcgggattccgtctcaaaagaaaaaaaaaaagaagttgcctctcagaggtgcgagacaaagcttggaataggaaacagttcttaacagttactttgggatcatggataaatcagggagaatctggggtaggaatgtgtcctgtgctcttgtcccagtacaaataaacacagcacacactaggtgttttgtgcacatcatctccagccagtttctgagaaataagggtaataccctcaagggacgggggaggcccagaagccactgtgctggtactctttgccctgggctgggggatccagagcctgttccattaaaagcgcattcaattaggttacctcatttgtgatttggcaaactctaggcaaggtctagattttgagaggtggttaaatgaatcaaaataaaagtggtttagatggaaggatagctgagagagagggaagtttttggtccttgaaactcattttagaatctgtgttgcatctactgaggaagtctacctcatactaatattgaatgatctatcaagtaatgaggaaatattatttagttttcctttctaggtagcactttgtctgatagggctttctttgtcttagaatatggtataatctctgacatctcctgcattgaaaaataagtcccagtgtagtagattgcaacgtcagggtacaaattaatcataataagaactggcactattatatgtctcaatacatctcaagcactttacatacattgtatacattttaccagtcctacaaaacagagcttatcaaacccacttcacagataaaaagcctgaagcccacagtctattaatatgtccaatttcacatggctggtaagtgacaggactgggacaagacccccagtctgaattagtgtaaagcacactctgttccatgcctcccaacctgagactgactgtgtccccttattcacttttcttctcactactcccaaacgtatatcaagtgatgaaaagattctgtacccaatctgctggactgaaatacagaaccagagcaaggaaattaccaaaatggtcaagaggtgtgaattaaggagagaaagataatatttggtgacaataagattacacatgcaaagtcagataaactcaaaagatcatggggtcacattctgtcattctggactgtccccctttttataggaagttaaatcttttccaagagaaatacataagagggtagtaaagagaagaaatagatcaatgttttttttttttttttttttttctctgacagtatgacttctatcctcgggcttctgccttgtgttacagcttccctatcttatatcactcctgggacagggatgcattgtctgcaagatttattatagggaaactgatcaagaatttttagggatgcggcatttcccaggaagtcattaactaagggacaagagccaagataaagaccttcatataggaggactcagcagaacaacatgccagacagagttcttagcctgagcatctcctcacttattcttcaaggttctcagggac

SEQ ID NO: 14074 - DNA, 6927 bp, Human
gtttcttttcctttttttttccattttcctttttttttttttttgagatggagtcttgctgtgtcacccaggcaggagtgcagtggcccgatctcagctcactgtaaccttcacctcccgggttcaagctattctcctgccttaacctcccgattagctaggatcacaggtgtgcaccgccatgcccagctaatttttttgtttgtttgtttagtagagacagagttttgccatattggccaggctggtctggaactcctgaccccaggtaatccacccgcctggcctcagccccacaaagtgctgggattacaggcataagccactgcctccggcctgaaaagtcagtaattaaagagaccttcctatcccctaagacttggtgaccccactcaatttcatcctactatcacatttgaggttattcatttaatgtctctcttaaatggtacaagatgaacttctccactcatgctaggactgcatttattttactactaaatctgtagcacctcatactatgtatcataataggtgttaaatataagaataaataaatgaattagtgatgcctgtacatttgctaaaggcaggctgcacacttggttctaagtttgtagtagccaagaaaaagaattttaagattcatagtatccttaggataaaataaaataacgatttcaggaccaagtaagagtttgagataactaataaaaatcaaataatagccgggcgcggtggcacacgcctctaatcccagcactttgggaggccgaggcgggaggatcacttgaggtcagaagttcgagaccagcctgaccaataaggtgaaatcccatctctactaaaaatacaaaaattggccgcgcctgggcgacagaatgagactccgtttcaaaataaataaataaatgcataaatctgaattaacagcatgcacatcactgctttactttctaaaaggtgtaggaatgcttattttaataaatgaaaaatgactcttcccctcttttaaatttgtttctcttcccctttttgttaaagtacaaaacaaaacaccttcccccacttttcgaatagttttggctgtgtctttaggactggaaggaaattcagctcaaatgaattactatattatgaacttaagtaagaattgttgtgcattttgtacagaatgcaactcctaggagttgacaaatgtttgttaagtgcatcagtgagcgacataggaccttctcctccctactctcttgtcacggtttttatttaatcaaacatttattattgttcgatgctcttaaatgccatttccttcagctgattatttgtatgacagaagagtcaattaagctattttgtcctaaaaattacgaaaacgaaatgtacaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttcttttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtattccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacaaatatatgcctttggatattaaattaatgcttgatgataaaagaatcaaacttttttttttttgagatggagtctcgctctgtcacccagactggagtgcagtggtgtgatcactgctcagtgcaacctctgcctcccaggatcaagcaattctgactcagcctcccaagtagctgggattacaggtgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcagttgcgtgaattttttttaagaaacaacccagtgaagagttctaccatagcaaggcctaatgttagctttagctttagaaaataacagtttgtgaacttacttccctatatttgcagctgtatctcacactatgatttacaataaaattgtaaagattgacaatagacttaagaaataacattttaaaatctattttatacttaccatttattattctgttattttagtctccatatgttcattacatacataatcttatttaatcttcacaccaaaactgtattcttatgaatatacgctaaaagattaagtaaaatgcccaagggtataaacaaaagcaacatgaaagtggaagccgtatctgtcatttattttatttccagaagcctagcacagtgtccagcatatggtagatacttgtagtgtttgaataaatgaaaccagcattagagctttatatactttctcttaaggacttgaaaagattaggaatctacgcatacactgagagagaaaaaagtgagaggaagactataaaaatagaatatttgataacttctttataaaatctagagatatttattttgtgttttttccctatgtcctatcaaatgagggagcactattgaaatctcccattgtaacattgtttcaggaaattttatcaattatcatcttacgtattttgagcaattttatgacatgcaaacaaatatagaatcgttatatcatcttaatgaattgaaccttttgtttgtagtgactgcttttctgctttaaagtctatttttttctattatcattgtcatatattaacactgtatgattggactttttcctgctatcctattttgtgctttccacttcctttgatttctctatgtttcacttctcagttctttaattgactaaatatttgtttgtcttcttatttcatgatattttcccctctaccagttaggatgttaattctatacccatgcttttactctcaaaacttatcatatttaacttaaaaatatctaatattagtatcttaaccctccttcttaatgatactatggaccttaggaaactttaaccctgatctcttatctataaactctcaagttattatccagtgttttggtttaacaattttgtttcccatgattgtacctcaaattcccttggagaaggtctcttggtggtaaactcagtttttatttactaagatcattccttgttgttgttggaaggtagttttgctgtgttcctgatttcaggttaacatgttaaagatattaactcttttctggttttcattgttgataagaaagctattcgtctacttgtggttattttgtagagtgatttcttctttctgtttattttaaggtggtcccgatttcagtatctatagtcacttcagaatatctaattgtaaatttctgtttttcttgcttgttttatgttgtgtttcatttatgtgtggatatgtgtttttcttcattctgaaaaatttccagccatttttccccaatatttcctttcttccactttttaaaaatcattcctgtcactttgatcgggcctatattagatcttagatcttctcacactactcatatcatgtaaccgctctgtcccagtttctatctccatatcattctattttgctttggaaattgctgttatatcccaagatcaatattccccatcttcattttagcctaccaccaggttttagctgaaaatggccacccagatagagagtaaatttcccaatttctcctacagttacatgtggcgataatgctaggttttggttacttttatataagcagaagtgatatgtacaacttaatattcattccctagaaatctgaagttatttgcccttaatactctgcttctccctttcaatgggctagaaagttaatttgctgctagtttgctgctaccttgaatcatatggctgaagatgactgggacaactgctgtagacccaaagatgaagtcacatgtacagaatggcaaaacagagcccacctacctagcttgtcctgttaatataggagaggaatacacctttctcttatgaacactgctcgggatgtcttatgtcatcaacattgcctataaccctaagtagtattggtatagtcttgataattctgtctg

SEQ ID NO: 14075 - DNA, 12951 bp, Human
  misc_feature (1)...(12951): n = A,T,C or G
gtctcaaactcctggcctcaaaggatcctcccacttcggcctcccaaagctctgggattactggtgtgagccaccgtgcctggcaagaaacactttcaagtgggcctcactcccatcagtaatgtccctctcaggtcccttcccccacccacctggagtagccttaccttgcgagagaagggtagccagtaccaggccagagagaaacgtgctatgttccatctcccagcggaactcatccagtagataaagccaggtcaccgaactatcagcctgggtgagagctgccctcccctagctgactcacaggtaccggaaagaggagagtgggggaggaactagaagatgtctgcttctctgctttctgccgttgatggtgggaaattttcagagtgggggtgggctaggggtagggtaggaaggaagcggtgtaaattgctctatctctgagcagggagctggcagagaatatggaaaaggtggcctgaactttagcgtccctattgacaatgcaaccacatttacacacaacctaaacactgccacatctcgaagccccttgagagaagccgtcggccccatagcgcaagccgtagcagctagatttctcatggaggctgatctttctcaggacccttcactaggcagccagggacaccagatctagcagcttcttgtcagtgggaggttgggctttagagaccccagccagagatttgaatcctgggtccaatactgcctacctgtggggcctgggccagccataaaatttttcagagtcttattccattagtaccattattaggattcaaacaagatatttgcatggtgcctcacgcatcatatgtgctcattaaggggtagttattaataataatataattgactgacaggcaatattgagcctcccggtgagacaaatggacctttttcccctgtggcctacgaggatctgaaactcttcacgctgctgcagttagactgtcacttacctggggacagagtcatgcctgtcttgctcactgctgtatcttgtgcctggcacataacgggagctctgcacatttttgttggctcactgactgactggctgagggagataggggcctgagatcctggacattcagtccgggctctggcccctgaaaatgtgctggcctgtcctcggaattgttccacctattgccttccaggcgcctctttcatgatctcaaaagaatagtgaaaccaggtgccgtgtctcacgcctgtaatcccaacactttgggaggctgaggcaggtggatcacaaggtcaggagttcgagaccagcctgaccaacaaggtgaaaccccgtctctactaaaaatacaaaaattagccgggcttgctggcacgcacctgtaatctcagctactcaggaggctgaggcaggagaatcgcttgaaccccggaggtggaggttgcagtgagctgagatagcgccactgcactccagcctgggcaacaaagtgagactctgtctcaaaaaagaaaaagaaaaaaaaagtgaaaaaaattcctgaatgaaggcctggactgaggtggctttccatttggaggtccagccccaagcatctgagagtccctcctaaattcattacctacagcaacaacaactagcaacaagtaacaactggctacgatcctaacaactaatgacagggacatttatctccctcatgaagaaacggtcccaggaccatctcccacccagcatccattgcggttccctgtgcaagatgagtctctgagtgggaatccagcactctctccctcttcttccccaccaccttcaccctccttaacggaaaaacaaaaggcatctgcacctgcagccctgctgaggcccctgctgctcacacttgcagcagagggtggaggctctgggttcttgccttctctcaaaggccccagccccaacagtgatgggtggagccagtctagctgctgcacaggctggctggctggctggctgctaagggctgctccacgcttttgccggaggacagagactgacatggaacaggggaagggcctggctgtcctcatcctggctatcattcttcttcaaggtaagggcctactaggggtctggaagcctggggaagggctcaagggaagagcccatcactagtgagacaggaatattggtatccctaaccttcagcctacctctgctgtcaccttagagttcaaagaagggcaaaatggaggctcttaactgttctctgctagagagaaacagtgtcccatggaggagaaggaatccttgtctctgaaaaatgcaaacagagtacttaaatggctgaagagaggaccctgttaccgccatcttagatttgaatgcagcccaaaagggcataggccaagaaactaaaaggaaaaagtatatgttccctacttcagagctgggggctagcagtcgacctaggaaatgtccattcactcagttgggcagttggccaattggtcaacaaagatgggtgagaccctaatatgtgatatgccatgaggaaataaaaatgaataaaacacttatgctctacagaactcatagtctcattggagagattagttttcatggtgccagactgagtgtacagtatagtatgggtgcctgcatgaatactccattggactatccaataggaagtggatgaactgggttgatgcctggagtctggacatcctgggaaagttaaaaccatggaatttgctgaagtcacacaagtactatgtgaggaagagggagctgaagatggaacagtgagggcaccaattttaaggggcagttagagaaaaaaaaacattccaggaaagagataaaaggagaatcaaagagctgaaataatcaaatgtatgcactaccttggaaaccaagagagtagagagcttctagaagaagagaattaccaagagtataaaatgttaaagagagcccactaatataagaatatatttaaaagtttaagtctgcgggatgtggcagaatatgcatcatgggtgatttagcacagtttcagcagggtattgtgagtggaagccaagtgaaaattggtagaaggtgaaggtcaggtgatgaggtcagcaagtgtagactattctttaaagacatttggatgaggagggagaaaagactgggtggtaggtagaggaggaagtagagtctaagaataaatgtttttgagggtgagagaaacttgagcacatttctaggctaaaggagaagatgatgagtagagcaaggtcctggagttgatggtggaaggacagagtcaagagtggggtcaagagcacagagaggaaggcaacgttaccctctaagaccaggagaaaggaagtgcaaacggcactggccacaaataggtttataaagggaaaggaagctaaaggagaaaggacaataacaacttccgtgttctaaaaaatccaggtgggaggcaatgccacctgctgaaactgagctgggtgatgaccggttgggagacttgaagaggacagtgagagtttagaatagaattatttctgagagaaatgcaaggaaaagtcaggtaaagacaacacaggttgaggagcaactctcaagcctgggtgaggtggctgcatatcatggaaagagcatttgagttcagcagtagaaaacctgagctctggatccagcttggacaccaatgagctatgtgtacttgaacaactcctccactgtctgggagttctcatgccagccaatccagaaatgtggcagggacgggcatggtggctcatgcctgtaatcccagcactttgggaggtcgaggcaggtggatcacctgaggtcaggagttcgagaccatcctggtcaacatggtgaaactctatctctactaaaaatattttaaaaattagtggggtgtggtggtgggtgcctgtaatcccagctactcaggaggctgaggcaggagaattgcttgaacccaggagatggaggttgcagtgagccaacacggtgccactgcactccagcctgggcgacagagtgagactccgtctcaaaaaacaaaacaaaaaaaaaagaaatgtggctatatgaactcttaagtcctaaaaggaaacctcactcagatatgcaacattaaaagatgtcaatcagccaggcacagtggctcatggctataatcccaacactttgggaggctagggagggaggatcatttgagcccaggagttcaagaccaacctgggcaaaatagggataccctgtgtctacaaaaactacgaaaattagccaggcatgttggcatgcacttatgccagctacttgggaggctgaagtgggaggattgcttgagcccaggagcttgaggctgcagtgagccatgatcacaccactgcacttcagcctgagtgacagagcaagaaaaaaaaaaaaagatgtctcaaaaaaaaaaaaaaaaactatgtcaatgatcagtgcaatctccttccctgaatccaatttagaatgaggggtctctgtcttctctcggtcttctgaccaggtggtcaggagaaaaactagttagaaacctctttaactgtttgtcttgccttttctcccatttgctcatttattcatttgcacattcattcaacaaataaagttcctaccatgttccagacactgcactggatactgttcaaaaataatcccgccctgcatgaggttctaagacagttcacttcttgtatttccattatactttgactcatgaccgcctctccctatcacacacactccacctctagccacactacctctcttgtccttttccaaagctgcatcttattcagctattctttctactcagaatgactttctctatctggtatattcttgcttactcttcaaggcccagacaaatgtcgtttcctctattaagctttccctgatcctcacccttggacaaaattaatagcttctacccttttttcatatgcagtcatataagcactaaaagataatgtatacattctattaaattaattgcatatatgttttaattttttcacttcattcataaactttggaagcagcagttgattcttcatatcagcactcttttctttcataatatctaattattttaggtcataatagtcctcgttaaatgtttggattaaatctaattgaattgaattcaagtgccagatctctgtaatatgtctaccatgcaactctactaccctaaggttttgtttgtctgtttgtttgtttttatttttttgagacagctttaacacctaggctggagtgcagtggtgcaatcttggctcactgcaacctccacctcccaggctcaaccattcctcccacctcctgagtagctgggactacaggtgcataccaccatgcccggctaatttttttgtattgtctgtagagacagggtttcgccatgttgtccaggctggtgtctaactcctgggctcaggcaatctgcccacctcagcatcccaaagtgctgggattacaggtgtgagccactgctgccagtcaactctgagttatgagacagatttgaggactaattgaaaagctaacttccctgggacatccagggtttttataataaaaggatcaccaaggctgaatattttataaggaactcagcctaaaggttttggatagtgcacacccactccttgccagggcattagctgctcaagaagcagagtgttctggactggataggcaatatccttacttacatatactacaatacaattctgatgctaaccccccaaattagtgtcagaccctacaggttaagagcatggttcccaaccagattgccctcactttaaatgccagctacaagttcagggtaccccagaccactcacatttctgacaaactgcctgcaatcttaaggattcccatgaccctcctcattgataatttgctagaataactcacagaatttaagaaagtgctgtacttcctatttcagttttattaaaaaataaaataaaatcagaaccagctaaatgaaaagggcaaggtctaggagggtcccgaacacagagcctccgtgccctctccccgtggaattagaacacatcgcccccagcactctcccacactctgccagcacattgatgggttcaccaaccaggaagctccaccaagtttttattgaggtatctttacataggcatgattgattgaatcattggccgcttgactgatctcaatctctaggatcccttcctggggctgataccactagtttcaaagctgcaatcctcttaccatatggttggtcttgaccagcaccatcctgagtcattgccatgcataaactcaggtatggtctaaggatccaccacagataacaaagccactcctgtcactcatgaaattccaacggttagaaacaccctcccaggataccaggacaaagatgagacaaattgtttattatcaccttgaattcaattgagtgatttagtctacaatccggaaaactaagtatagatactaccattttcatggatttggatctttcttcatcttggcctcaaataaccatggaaatacttcagggcatctgaacaactccatgcccagctaatactctatctctcttctgtctttacaggtactttggcccagtcaatcaaaggtaggagaaatggcttctttctatactcagactcagaatattgacggaaatttggcttcctacaacagtagtcctacaggagcgaacagtttagaatgaatgaaatgacggggatagagaggtgatgtctctattgtcaaccaaatcagtgacctgacataacctgttccgggcagcttgcctgtagctaagcatttaactggtctcttacaggagaagcaggaccctagtagctagggacacatctcaaactgtgacccatgaaccagtaggtattggcgtcacctgggatcctgacgttagtctctgtcaatccttctctttagttcatctattctacccaaagtgatctcatcatctggtatgctgttagcagtttcttacctgtatagtatcttccaaataacatgccccaaaatcccaaagttttacccctactaattacagcaatgtctcttttattcttcaccccctgacgcagatattggcgtcacccgagagcatgttagtaatgcagaatctcccctccccagaactactaaatagcacctgaaattttaacaagatccccatgtgattcatgtgcacatcaaagtttgagaaacactactctaatgatctcctggtatgcagaagcagggagaatttcagaggcaagatccttaatagaaccacggcttttctcatttcaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaagtatgtaatcccctttggtctgtttgttgtgaaattaatcagtatttgctgttctggtgagctttttatctggggtgaaagtggaaatagatcctcaacagtaatattatcgcctgttctcttaatttcagcttgcctcttttaaaatactgtaagatacttccctcaccctattgaaaaactacagccagtcctgtaaaattttgtttacctttgggtgggctccatggattcaagcaattcagcactgagttgaatgaaggggttggggagacagaggtgatcataaggtgagcagcagtgagaactggagcgcagtggagcatgaagagtatctagtcttccttctgttccagatacttcctggtagttagactacatgggcttccccaggaatcctgggggacttaagagcatcaagatgcattgagttttggcgcaaggatcttcccttgccctgccacccacagaggaaaagcctgctgccctccacagcggcattattgcagacaggcaggagaaaacgaaccaggaaaaacaactttcgcaacctgaaggtttgtctctccttttccctacagtgtgtcagaactgcattgaactaaatgcagccaccatatctggctttctctttgctgaaatcgtcagcattttcgtccttgctgttggggtctacttcattgctggacaggatggagttcgccagtcgagaggtaaaagaatgctcttagatgagagatgggaccacctgagaccctcagctttcctcctaccattatgtacccaatggaagagactgagttggtgcttcttgctagtgtgcatagttgggtgaggctgtatttctctgagacaggagaaaggatacttggtgttatcacagcatgttcacctgtctcaagatacagctccctctgtgaaaaaaaaaaaaaacaaaaacaggcgcagtggctcacgcctgtaatcacaacactttgggaggccgaggcgggcagatcacgaggtcaggagatcgagaccatcctggctagcacggtgaaaccccgtctttactaaaaatacaaaaaattagccgggcgtggtggcgggtgcctgtagtcccagctactctggaggctgaggcaggagaatggcatgaacccgggaggcggagcttgcgtgagccgagatcgtgccactgcactccagcctgggcgacagagcaagactccgtctcaaaaaaaaaaaaaaaaaaaactattttaagtaaacccttacatacagaaaagtgaatcacaagcatacagctcaaaaaaaaaattcacagagcaaatacacccatgcagccagcacataatttaagaaagacaatattaccaatgccattgaagcccctcttgtggtcacttccagccactacccatcctcaagagtgagcattgtcctgacttctaacaacaaggattaactttgcttgtttttgtcctttatgtaaatggactcatatactaagtattcttgtgagtagcttctttcactcaacaacatgtttatgtgctttatccatactcttgtgtatatataaaactcttattgttatttagtattccattttgtgaatataacccaatttattatgcattctaccttgtgtggattctgtttcttttttgtgcagcttcagacaagcagactctgttgcccaatgaccagctctaccaggtaaggggatgaagaataaaagagacattgctgtaattagtgggggtaaatctttgggattgaggggcatgttatttggaagatcctatacaggtaagaaactgctaacagcataccagatgatgagatcagtttgggtagaataaatgaactaaagagaaggattgacagagactgaggtcaggatctagtgagcacaagttgaagaacacactgagagggacacacgaagaaactctcgacaggctgggcactcactatagacaggccatggctcatgcctgtaatcccagcactttgggaagccaaaacaggtgaatcacctgaggtcaggaattcgagacaagcctggccaacatgatgaaactctgtctctactaaaaatacaaaaaaaattaaccaggcgtggaggcgcgcgcctgtagtcccagctactcaggaggctgaggcaggaggaccacttgaacccaggaggtcgaggttgcagtgagctgcgattgtgccactgcactccagcctgggcaacagagaaagactccgtctcaaaaaaaaaaaagagagagagagaaaaagaaaaaagacagagcctccatctccttgtcctctttccatcctcaggaccatgaagtacccactccaaattctcacatataaaaaacattcaataaacatgcatcaaattaattaatagaggatggaaaaaatgacttatgactgtgctgtcctttccagcccctcaaggatcgagaagatgaccagtacagccaccttcaaggaaaccagttgaggaggaattgaactcaggactcagagtaggtgggttcttcaatgccaattctaataaaggacccttgcatcaactgccctcgcaattgcttctaagtctagctcccttccctaagcggctataagcatcagactctggggatcagggattgggacgtggtttggggtactcttttctaaaaattctggggccatactgattgtcttggcctaggtaaatatgaattttatgtatctgtaaatcctgtcagagcagggcctcaagccatagagatgctgaatattaatcttaacctacatttgaatttctcattatctacactattaacattttgggctaattaattatttgtgatgaggggctagcctgtgcattgtaggagttatggaagcatccctggcctctctccaccagatgctggtagattgtccagtgtgacaatcaaaaatgtgtccagacattaccaaatgtgtccaaacatcacctccagggcaaaatcacccttagttaagaaccactaacccatattaaccttccaatcaataaatcaatcagtcagaagttatgatttaattaatctatctgaagtttctatcaggaagacagggttgaaagcattatttgttttttttgaacaaattgcaatttttcttttttcagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctctttttttttttttttttttttttttggagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctcagcctcccaaagtgctgggattacaggtgtgagccaccatgcccggtcttaaaaccagtttcttatatatctctctggaggtattctaggcatatatgagcacattctcaagtacatattatcctcccttcccctatcttttagacaaatgatatcaaactatacatcttgtgagattattgcataccattatatgaagataccattatatcctttttaatgcaaccatattgtacaaatagactatgatttatttaacctgttatctatcagtggatatttaagttggtagttggttccaatcttttgctcttacaacaattctgcaatgactaacattgtataaatatcatttttaaaaataattgcattgaagcataatgtacatgccataaaatccacccatcttaagtgatttcacctgttctcagaaatttttagtaaatttaactaattgtacagccattaccataatccagctttaggacattttcttttttttcttttcttttcttttttttnnnnnnnnnnnnnnnnnnnnnnnnnnnnnnnnnnnnnnnnnnnnnnnnnnnnnnnnnnnttttttttttttttttttttttttttttttcttttttttttttttttgaagtggaatcttgctctgtggcccaggctggagtgcagtggcgcgatctcagctcactgcaacctccacctcctgggttcaagcgattctcttgccttggcctcccgagtagctgagactacaggcacatgccaccacgcccagctcattttttgtgtatttagtatttgtgtatctagtatttgtgtacttagtagagacagggtttcaccatgttggccaggctggtctccaattcctgacctcaggcgatccacccgccttgacctcccaaagtgctgggattacaggtgtgagccaccgcgccaggcccgtaactgtattttaatatagccattctatggatttaatatggtattttattatggccttaatttgcatttccctagatactaaccatgctgagtgtcctgtcttgtgtttattaaccattcatatatttttagtgaaatgtgtatcaaatcttttgcccatttttaagttgacttatttgtttgtcttcttactattgggttgcatatgtttttgatataagtcctttatcagatatatgatttggaaatattttctaccaatctgtggtttgtttttcttaatggtgtcttttgaagtgcaaaaggtttgaattttgaagtacattttattgattttttcttctatatattgtgcttttggtatcatgtctaataaatctttaccaaacccacagttacaaagattttctcctgtcttctttttatactttttacagctttatggttttagctctaacaataaatgtgattttgaacatacataagactatttgtaacaaacacaaataaattgaattgttgggcacttgtatttgcatttgtaattttattaactattgccaaatagcagttgtaaacacgtacacacacacaagtgtatatacacatata

SEQ ID NO: 14076 - DNA, 4666 bp, Human
agtggtgtataacacggtcttaagtcccagagacttgtttctaatacatgcaagagagtaaataattacttaagacaagcttagtaatttttttttttgagatggaatttcactcttgttgcccaggctggagtgcaatggcactatcttggctcactgcaacctccgccttccgggttcaagcgattctcctacctcagcctcccaagtagctgggattacaggcgtgtgccaccatgcccgcctaatttttgtatttttagtatagacagggtttcaccatgttggtcaggctggtcttgaactcctgactcaggtggtctgcccagcatggcctcacaaagtgctgggattacaggcgtgagccactgcgcctggccaagacaagctaagtaatttttatgaaattagttgaatgaggagagatgacatctttaaagttgattattttatctaggatttatatgaaaaaatcctctaatcactattgagtgtaggccagaataacttgattttttgaaatgagtatttttgttagaagaaacataacatcaaactacttctcttgtttcttcaacataggagttcatttcagcatctgattacttgatggagaatatcaattttgtgcttaattatttaataataacctaattccatcagctgtattgcaaactaacagataaagaatactgaagttactcatgtttgctttgaaatgtttgttcagctccttaggtggacatattcaaccaattaatttagggtgtgacagcttagttcatattttgtgtgtaaaaagccaagtagaatgatgaaaatttacagtgatttaaatcagatatttttctttctaacccttgatgcccacacttgcaatgttgaaaatttgtattttatttttttaaagtgacttttaccagttattcaaacaggttgtacagagaaagaggaagggaaatttgtattataaatatgattttaaaatataaaaaatgtacaaaattctatgatgaatattagcaaaaaaatagtgtatttcattaaattatttataaagtgatgggacacaaacatgtacacaagctctcaatgctcacagttgccaaaatgatgttggcctgccattctattatttgttggttcagttttcttttttggggatgtggtagttgatctttaatgcccattctagatcggaaaaatccatgatcctaacttttaagagaaggttggtaactctacttaggacttttttttctgtaagaggaataatgtagcctcacccttatctttctggaaatgtttaaaccactgaaatatggagatcaaatccagcttacacactggtaactcaaatactatttttttttttaaactatcttttctaaactaatcacccctcttgtacatagaactttctacctcagtgccaattcctagaggttgatgcaaacagctcgccagagagcctgtgctattgttcctgcgaaaaaacccaatttccctgcacatttggataaaaatgagtttatctatataaagttgagacggtaagaattcacagaacaatgccctggaagagagatttgcaaatgaaagagggagaaatagtatttttaaggaaaacatgaaagttgtctcgatttgaccgaagtttgaaagagagttgggggaataagaaaagtttcaagatgccggttttaaaactatgcatagaaacaaaggcaggaatgaagcccgaactctctcggatcagtttcccccaagtctctaattatttcatgcccagatttcttatatttttactcttttttaaggggcaacaaacacagcagcgcggtagatacgaggagtccttttccagcagcgccgcgcatggagcaaggaaccaatcatcactcagcgtctctctatataaaccctcagcctccctcgtagaggacatgctgttctgacagtttgagattacttattgtcttttctgggaagacaaaaacatgtcggagactgctccacttgctcctaccattcctgcacccgcagaaaaaacacctgtgaagaaaaaggcgaagaaggcaggcgcaactgctgggaaacgcaaagcatccggacccccagtatctgagcttatcaccaaggcagtggcagcttctaaggagcgcagcggcgtttctctggccgcgcttaagaaagcgcttgcggctgctggctacgatgtagaaaaaaacaacagccgtatcaagcttggcctcaagagcttggtgagcaaaggtactctggtgcagaccaaaggtaccggtgcttctggctccttcaaactcaacaagaaagcggcttccggggaaggcaaacccaaggccaaaaaggctggcgcagccaagcctaggaagcctgctggggcagccaagaagcccaagaaggtggctggcgccgctaccccgaagaaaagcatcaaaaagactcctaagaaggtaaagaagccagcaaccgctgctgggaccaagaaagtggccaagagtgcgaaaaaggtgaaaacacctcagccaaaaaaagctgccaagagtccagctaaggccaaagcccctaagcccaaggcggccaagcctaagtcggggaagccgaaggttacaaaggcaaagaaggcagctccgaagaaaaagtgaaactggcgggacgttcccctttgaaaattttaaacggctcttttcagagccacccacaggtctcagtcaaaagagctgaagctttttggaggggggagtggggtggagaggggtgcgggtgctgcggtgttgtgcggccacggtctatcctagtcgtgctggttgggggtcagttattaacagctcccagcagcctgggcgcaaggatccttccgtctcagtctcagccacagtcaccggatagctaaggctacttgagccaccaggtcctactttttcttcaaattcccgcggtggtgtgtgattggccggccgatttctgttaaagcgcggcgcttaaaagtggccctgaaaaaattttatttctgacacagggatgtggtgtaaatgctttagtttactttagcgttgaggtgacttcctgagcacatcccgtcctggttgtgagcagtacgtggcatgcccaaggtgcttccggcccacgatcttgtgcagctggtcgttgagaatggccaactgctggtggtgcccggtgtctgtcttttcgcaggcctttgataagccttagctttgggatatcggccctcaggtactgtatttgtaaatagtgtgggggctgcactgcgtgacgaggtggctctcctgtaatcccagcattttgggaggccgaggcgggggcatcacgaggtcaggagttcgaggccagcctgaagaacatggtgaagccccatctctgctaaaaaaaaatacaaaaattagtcaggcgtggtgccgcgcgcctgtaattccagctacttgggggctgaggtagaaaatcacttgaacccgggaggcggaagttgtaagccgagatcgcgccacttgcactccggcctgggcgatagaacgagactccgtctcaaaataaaaagtgtgcccattgtctttttctgtcagtggccagcgtctccaggacttattttcccaggggctctcttgcttgttcatttatttctgcctactcttaacctcctagcactgccgccaggtaacactagcatgctggtccaacccgctcggagtagctgtatttgcggaggacgcggtgtattagccctactggcaactgtaggcccgcgtggcaaagcaggtcttgcttttggcgcgagtgtggtcttgcttcccacgtccaggtaatgttagaaaaaaatgcaattcttgtattaagccaatcggagggatagttcatcatagcctctggctcagttttgtaaaacttgctttttctgttggtttgcagagcctgctgaattaaccaatcagaacgtattcttagatttttatttgcgtggtttttccgagagaaaatttttcaccaatcaggttgcgatattaacagttgtgtatgctgggacgtagtcgaaaagcctgtttttttttccacctccccctcagatggaattctccaaatggaattctctttttggagactactcaccttgtcattctgcgtcaatctgcacaagtattgctaccaccctgatgctgagagatagtaaaaagtatgaaaggaacctctgtcagcttataatctgcttcttttcccaaattgctttctcacagattgagctgaaccagggagctagagttagctatccaatacatatttggtgattagataagaaatagagagggaaaaataaatgaaaaaacttggagaagggaggaagaagcctgaaattggggttaccaggacaaataaatgggctataggaagttgggctgacttggatgtactactgtttacattgtatttgggaggctgaggttattttttgtttgttttgtttttgattttagaaaagcccacttaacagtacggagaaatctcgacaaaatctgatttctacagatggttatgggactctagatgggaaaaaattacattttcacaaatcctaaatgcaatttgcttatttcctttgtgagtacaggcagctaatcactggatttcacatcaa

SEQ ID NO: 14077 - DNA, 8641 bp, Human
  misc_feature (1)...(8641): n = A,T,C or G
ctccctgatcgcatcagccactctcttccccatgtccctggaaggggctgcagaggggtaggggtggaaccagaggctgccatcgcccccacccggtttgggtcgtgtcccccagtgcagcctctgccatcgccctcaagagcatttatcacgcatttaccacggatctttaaaacgaaagctgcaggggagggtaattaagtttaataggagccgccgtcgatttaaagccacaggggggaagtaattagatttaacagaagccacggctttctgaaccaagacacacagcgtgggggtccctggtctagaaagccttcgggatgatgtctttttgtaaagactttcctggtgacatttgctgcgccctcagtcattaacgccagtcactgactggggaatgaatgtggcctctgctcattgaaattcattaggcctggcatttctctcgctgtctctcctgtttgccctccccatcgcctttgcgctgggccaggagggctctgcccccaaaaccagcctcctggggccccacatccaggagctgggggtttggaagaataacaagaaataattagagttaaaccaaagccccgtaggaggacccctttattccccgcctgggtattctctggttgtcgttttctttattggcaggaaccgcttcatggagcggcccccatttctttcctcacctggcacctgcccggacgccaggggcgcccatcaccgttcctgggccccttcccgacccctccccaccaggtaaggcgctctcgacctccccgaccgtgctgttcctcctgaccccgtgcgcagggactcagggactcggggactcaaaaaccagacccccgacacaagacagctcaaaaaacgggaaacggaggcccaggcctccctccctgcgcccctgcctccaccaccctccagccgagaagctggggttcaccaatcccgcagctggcccgcccaccctgcccgagagcctccttcccagtgccccctttcaggttgcatctcgcgcacagccgcggggccggggcgagcgcggagcaggcaggggcgcggggccaggagcgcaaagcccaggcggacgccgaggctgcggcgccacctacagtccgcgcggcttccattgtttccccgccggccgagagcgcgcccggccccccgtcggggggcaatttacccggataaaaggggcggggcaggaattgcaagaagatgaagctgaaagaacctgagactgtcggaactgccggggaaaattctacgggacggctttgacgtcagatgtgcggggctgcgaaagtcgggggagggagtgcgagtgggcttttaaggggaagggcactaaggccgaggtgaggcttttcccgacagagggtgaagggggcaaaactcggtgccccccaacctctggccccggggttcctgaccccgcccccgctagtgccccacgccgagtgcatccactgggagcctgaggcctgggggaagggccccagttgtcgattgctttacaaagtcaaactctcccagccaagaacctcggggccgctgcgcggtggggaggagttccccgaaacccggccgctaagcgaggcctcctcctcccgcagatccgaacggcctgggcggggtcaccccggctgggacaagaagccgccgcctgcctgcccgggcccggggagggggctggggctggggccggaggcggggtgtgagtgggtgtgtgcggggggcggaggcttgatgcaatcccgataagaaatgctcgggtgtcttgggcacctacccgtggggcccgtaaggcgctactatataaggctgccggcccggagccgccgcgccgtcagagcaggagcgctgcgtccaggatctagggccacgaccatcccaacccggcactcacagccccgcagcgcatcccggtcgccgcccagcctcccgcacccccatcgccggagctgcgccgagagccccagggaggtgccatgcggagcgggtgtgtggtggtccacgtatggatcctggccggcctctggctggccgtggccgggcgccccctcgccttctcggacgcggggccccacgtgcactacggctggggcgaccccatccgcctgcggcacctgtacacctccggcccccacgggctctccagctgcttcctgcgcatccgtgccgacggcgtcgtggactgcgcgcggggccagagcgcgcacagtgagtgcccgccagcacccccgcccgccccgccgcgcgcaccccaccccgctgcgcgcgccccaccccagcgcccttccttcctttgccacccttaggctcctgcggacccctcaactcctgggaaccccaggttttggcacctggacgttaggatccctccgttagtccccaaacagcgcgggacgctagggagaagcacaggcttgtggaccgaccgcacccacgtggtgcgggcccagcggtccttgctgcagcttctcgcttcccctgcgcctaggtttgctggagatcaaggcagtcgctctgcggaccgtggccatcaagggcgtgcacagcgtgcggtacctctgcatgggcgccgacggcaagatgcaggggctggtaagtgtccccacggggcggatgcgccggggcgggggaccggcgcctgtccccgggcggaggcctgaaggagagaaaggcgctggttcgaatccagggtttcctcgcctcctccgcccagacccgcgtgcaacttcgagggaaagattgcaaagaccgattaagtgcatgtccgacgatttcctacggaaatttagggtctcagccagcagccagagaataggcaaaagctgcctttgcatttccaattgagtcaaaggccggcctagccggaccgaggaaacccattattcggcctcctttgatattaaacaggaaaacccacctcgggccttttcagcctctgcctgcgcgtgtgtggtcctcgcctccgtttccctccctccagtataaaagaagaaaaaaagaatgggaaagaaaaaagaggatctacccataactttcctttaaaaacaaatcaattgtcaagcaaggcagaaaacagtgcatttgggataggagagattttttttttagaattaatttttaatctaccaggagcacggtgtggcttagacgcagatgcgctggagtcatgttgcgccaggggagtgcttttcctcctgcgggcctcacctgtcctgtaaannnnnnnnnnnnnnnnnnnntcctgtaaacgctttctggtgggggcagggggtgggggctggcagggaaggcccaggtaaccgcagagtcccggggccggaagtgtacgagcgctggggctctggtggccgggaacaaaggctgggagttcaaaggaacgaacccgcgcccctcccgcggccccgcgcgcagaggaggctgtgtgaggtctcggcccgcgcaggcctcacacgcagccccggactccctggcggagcaggggccagggcgggggtggccgcgcctgcccggggcccccaccccagaaaggatgcagaggcggggccgcctccggcccaaccagctcctttgtgaacagcgggacaaagcattttagagtctcaaaattgctcggtgcctctgccgtgctccgtgtactcggagcgcctgtttcaggttttatggcggagtcctgcgtgagaggactgcagagaaagggggtggtcggcacgctggacgctgactcccacccagagccgctccaaacccacccttgcaactttaattttgacatttactatggcagggggtgtgggggttcctaatgatgggaggccagcaggggacgtcaacctaacccgccattctgcccaaattgggggttgggtcacctgaaatccctctgtgccttttttttttttttttttttggcagagtcttgctctgtcgcccaggctggaatgcagtggccagatctcggctcactgcaacctgtgcctcccaggttcaagcgtttctgctacctcagcctcccatggagctgggattacaggtacccaccaccaagcccagctaccttttgtattttgggtagagatggggtttcaccatgttggtggccaggctggtcttgaactcccgacctcaagtgatccggccgtctcggcctcccaaagtgctttgggattagaggtgtgagccaccgcgcccagccccctttgtgcctcttgatcccctgtgcatggtctaacagaaattgaggatcttttttttttttttttttttttttgagacggagtctcgcttgctctgtcgcccaggctggagtacagtggtatgatcttggctcactgcaacctccacctgcggggttcaagcaattctcctgcctcagcctcccaagtagctgggattacgggcaccgtgccaccatgaccggctagtttttttgtatttttagtagagatgaggtttcaccatcctggccaggctggtctcgaactcctgacatcacgatctgcctgcctcagccgcccaaagtgctgggattacaggcatgagccacctcgcctggcctctttcttaaataaaaatgccacattcttctagaaacttgaagtcatttcgttttctgtatggagaaagtgatactaatttctcccaaaggacaagccaagtaaatagaagaaggtcctccaatcattcggttttgtgttccttgtttattgatcatttggcatttttgggagtttgggagaaatcacgcttgctgtccgatgctttgtcccagccatccgtgggctcggcaggagcctgggttgctgcaatgagcctcttatcaggagcttattagcacaggtacctcgtcacccacctgcagttcagtgacctttgcagacttaggcaggaacctgactgaggccgtcctgcagtgtgtttactgcccagcccttccggctcccgcctgcgcctgtcctgggtcgccaaggggtaatgacaccggtgtgggatggcacttgcccactggcacctctcaaccccgtggactatgaatgttctaagacaaggcttccctcagcacacatttccggccaccagctgggcgccggcctggcctggcctggcctggcctgggggaggggctgctgagatctgcctcctggcagcctgcctggaaggcccttggtgactgaatggaggagacagcggggctgatggttctcagaactgctgcagaccagaaggtcttagaatgataaaggcacacagtgatttctgagataggtggggaacagatgctttcatctgggacccagatcggatcacacgcaatttatttaaaagacctatcctaagatgacaacccagtttatcagtgtttcccaaagtgccaatgaaatacccaggaactttttaaatgccaggagttatgtctgtaatgtaaagggtgagggaaacacagacggcattcctgtgggttgatggatattattgcttaggacaaggctctcgaaaaagtgaggtaatttagtggaaattatttgggtctatatagagtgtatatgtagtattaagtatatacataaaatatacatatatgaaataataaacctcagttttgtctgtgtgcatgtatatctatataaagattataatttataaaggtatataaatgtatatttaatttattaatgggttatatattaacataatgtacatattatatatgcttacacttacagtacatttatatatgtgtgtgtgttctctgtgtatatatatagttgtgggttttttgttttgtttttttttgagacagggtcttgctctatcacccagactagagtgcagtggcatgatcattgctcagtgcagccttgactacccagcctcaacccatcctcccacctctcagcctcccgaatagctgggcctacaggcgcccacctccatgacctgctaatgtttgtactttttgtcaagatggaattttaccatgttgcccaggctgttctcaaactcctggattcaggtgatccatctgctctgggcctcccaaagtgctgggactacaggtgtgacctactgtgcctggccttaaagtacattatatattatatatacttacatatataaaggtatattttatatatacttacacgtacagtgtgtacatcaggaagtatgtataaaacatgcaagtgatgcttatgtggaaggtcactgctggtggccaccagggacagtctgtagcacaaacgtccatgtggacccgtgttccctgtccactgtggattgctcagagctgcctgttttctctgcagcttcagtactcggaggaagactgtgctttcgaggaggagatccgcccagatggctacaatgtgtaccgatccgagaagcaccgcctcccggtctccctgagcagtgccaaacagcggcagctgtacaagaacagaggctttcttccactctctcatttcctgcccatgctgcccatggtcccagaggagcctgaggacctcaggggccacttggaatctgacatgttctcttcgcccctggagaccgacagcatggacccatttgggcttgtcaccggactggaggccgtgaggagtcccagctttgagaagtaactgagaccatgcccgggcctcttcactgctgccaggggctgtggtacctgcagcgtgggggacgtgcttctacaagaacagtcctgagtccacgttctgtttagctttaggaagaaacatctagaagttgtacatattcagagttttccattggcagtgccagtttctagccaatagacttgtctgatcataacattgtaagcctgtagcttgcccagctgctgcctgggcccccattctgctccctcgaggttgctggacaagctgctgcactgtctcagttctgcttgaatacctccatcgatggggaactcacttcctttggaaaaattcttatgtcaagctgaaattctctaattttttctcatcacttccccaggagcagccagaagacaggcagtagttttaatttcaggaacaggtgatccactctgtaaaacagcaggtaaatttcactcaaccccatgtgggaattgatctatatctctacttccagggaccatttgcccttcccaaatccctccaggccagaactgactggagcaggcatggcccaccaggcttcaggagtaggggaagcctggagccccactccagccctgggacaacttgagaattccccctgaggccagttctgtcatggatgctgtcctgagaataacttgctgtcccggtgtcacctgcttccatctcccagcccaccagccctctgcccacctcacatgcctccccatggattggggcctcccaggccccccaccttatgtcaacctgcacttcttgttcaaaaatcaggaaaagaaaagatttgaagaccccaagtcttgtcaataacttgctgtgtggaagcagcgggggaagacctagaaccctttccccagcacttggttttccaacatgatatttatgagtaatttattttgatatgtacatctcttattttcttacattatttatgcccccaaattatatttatgtatgtaagtgaggtttgttttgtatattaaaatggagtttgtttgtatcaaaaggtgcattctattatccgcctagaatgttagggagggtggggaaggggctggtggggggcagcaccgtccacgggaggaaaccctcggtgtgtctgccctggacaccaaaagctcgggtgggaagttagcgggtttgggccagccagctctagtggtggaggctggtttgggccctgctgtcctgccctttcctcatgcctaggggcttggcttcctcagtccaccttctctctagcaatctcagtggttagggcggcctctctgccaggagtgtttttggctgcaggaaacaaacaccaaggaacagcggcctaagtgagggcctctcgccctcagcactcttccctggggaaagacgttcctgcatttaacagtgccccccccaccccccaccattagatgcctgtagaaaccctcaagttgtgacaaccaaaatacctccagaagttgttgcatgttcttaggaggcaagatcacccttaacggaggaccactgaccggagcaaataggatttctttttgtccagccacaaatccagagggacccagtgacccagcgatgcctgggctgtgccctgtgtgattcccttggtgtccctgtcctgctggggcctcgtctcgccagggctgctgtggcttcagctgagcgccctgtactcagggagagggaatcatttcgggctgggcctctctcatcaagaaagccaaaacttccttagaacctttcagcaaattccggctacatcctaagaaccaggtttgcgtcacaggaccaggccagccccagctgcacggcaggctgggaaggcaagaattagcggtcagggtgaccagatgtgggccacatcctgagtgcaaggaggagcaggtgcaaccggacaccaacgtgtgcatgaaacatgattccaagtgagcatttgccagggattagggatggtggagggagtcggggaggagggttgggtcact

SEQ ID NO: 14078 - DNA, 4951 bp, Human
tttcacagttcccaataggaggttgcatgctatgccatgcaaggccactcagggatgcactggagttggtcaggaggaagaaggaggggggaaaacataagccagaggctttgttgtgtttttcatagggaagcaatgagtaaggcaccagtggaaagctaagcaaggttaggattgggtagtttgaataatttcagcaggctgcaggttctcaagatggtccctagttatcaggtgcctggccctggggtgattgaaggcaaggtcatagtgtcctgggctcgttttctacctaagcaaaggaggtagatgggaggggcagtgtggattcaggattggctggtttgcttatcaaaggagttttctcaggcaagttggctaactccaggaattagctaaccttgggagggcatgccctctctgggtctgcaaggcccaaaagtgtcaaagcataaaatacagaaaataaacatgattaatgcactacccagtatctattgtcccttctgtatttatagaacccagatgtgacagggtgcacagcacatgtattgcattcctgttcttttcagttagggtttgccaaggggctataggcagaagtcacttggtgatgctctcagggaactttctatatgagttactcttgggaggcgtatcctgtgtgcttccccagactctcgtactacagcattttcttttttgtctgaaatgtggacatttcatggctggatttccagttgccatcttggaccatgaggcagtcttcagaatggaagatagaagaagctgggatctgcaatcactatgcaaccaccataccagcctggacagtttgcctctggactgctttgggagacaaaaatatacctctcctctaagccatttacttgtgttgtgtacttaaacctaattctttcttattcatatattgttgactttatctccgtatacatgagcaactctttactcttatctttctcttacatgacctttcacggcaagtagaagtaaaatcttttctttattcccacaatcctttaggttttaaactaatgtctcattaaatttagggaagggagtaggacataaaaagtatacaaaccttagcaattagctttaaaaagagtcaacataagcatactttaatacaaactacgtactgcttaattctgcatatagtcctgaatgaagatccttaattaatagccgcttgttaaatagaggagctcttaggttaagaacagaagtattgttcttatgcctccctggacagtattatagcagactagcaatccagagtgggtctgagacttcccactgcaagtccaagttcgggatgtaagcttggccactttctggtgaggcttctcttgctagcttatagcttacagccatctctctgcatgtaagccaggctccaaggggcatgccttttaattctaatccatgatcaatggcactgaacttttacaattttatgcacttaaacctcactccaggtggatagtggctcctagtggaattccttttctgtatctctgagtcctccctcctgaggaatgagactttttactcttctgagtaattctgagcctcctccatttggtgccgctcatctttctgttttgggtaactcagagccctacaccctttgaaactgagtccaagtcctccatcatctttgtgacctagatctcttccttctctatgtgacactggacactactcatttgcattttagcaaagagctgcaaagtttaggttcattgatggaatatgacaatccatatcatctgtgaagaggacagactaacctgaaagagccagagaggatttcctaaattgtgctctacgacagactaaattgggcagagacaagagacaggtacagtgaagcaacaggtagaggagtagattaacgagaaaaatatcacatcagtgaggagattctatgtatcaacagaaagaacaaagatcagggctgcctaattgctgacatgatgggactcaccgagggggtgttcctgattctgtctggcactcagttcacactgggaattctggtcaattgtttcattgagttggtcaatggtagcagctggttcaagaccaagagaatgtctttgtctgacttcatcatcaccaccctggcactcttgaggatcattctgctgtgtattatcttgactgatagttttttaatagaattctctcccaacacacatgattcagggataataatgcaaattattgatgtttcctggacatttacaaaccatctgagcatttggcttgccacctgtcttggtgtcctctactgcctgaaaatcgccagtttctctcaccccacattcctctggctcaagtggagagtttctagggtgatggtatggatgctgttgggtgcactgctcttatcctgtggtagtaccgcatctctgatcaatgagtttaagctctattctgtctttaggggaattgaggccaccaggaatgtgactgaacacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggcgaagtaatgacaatgttttatcctgctggccactcatttattctcattctggggaacagtaagctgaagcagacatttgtagtgatgctccggtgtgagtctggtcatctgaagcctggatccaagggacccattttctcttagagtaacagagggcatggggtggagcccttgagccttttggcctggctcaagactacaggactcttcctgaccttcctatgttaccagttccataacatcagtaggagagaaacactgactgctttgcccctggtccctgggcacttgttccaaggtgaaagccacgcttctcacagcctctctctgtatggtggttgcggaggtggggagggtgcaggagtagtagtcttggaaatgaccatgtcgtaagaacactctcactataaacatatggtgctgtattttaataatcatcagctcgacataatgagtctgattactagtttcaacttaaattagatactaacagtgataaacataaaattacatagtagacttgaaggaaagagcaaaagctttgcagtcctatagatgtgggtttgaattctgattctggccaagatttttggcctctggtgagttactttaattacctgtctgattccctcttctgatccctactggccattttagcacagtgtgttgtgtacagtactcagtaagtgaaggctattattgcgctaatattggattgtgcagcaacagcaatttccatatgattccagttcccacaaacacattgtgtaatgatgaaaacagtggaaagaaaatcaagacctttagattctagattccaattcaatcttgcatttcatgatcattttgctaaagtacattttcaagtaattattttgtagattgggcaaaagaccaagtagttttgtttttatttttgaccaagatgcctacctggttttaaaattacagttttatcaaatgtaatataagtgaattttgtaagtttaatcacttttatttaaatagaagtatataggcattgatttacttcctgttatttacaattttgacatgtcaatgaaaagatattgcttaatatcctgaagaattctcaaatttgtaaacatattcagttaatacacatggcattattcagaaatgtgtatttctagccctaatgggactctcagaagtggactgttgtggctaagaatgtagaccctgaaattagacaatctgtgtttaaatctggctttggcccttttgaactgggtgaccttggggaaacttcttaaccagtctctatttaactttcttcacctgtaaaatagaaatagtaatttgtgtgtgtgtgtgtgtgtgtgtgtgtgtgtgtgtgtgtgtgtgtgttgggataaagttgttggaaggaatgagtgaattaacacatgggaagtgcttagagttctacatggaacaaacacacaataaaactgctatcgttgttgttattttgtgaaaaggagcatactttgacataataaaaaggagtatatttggacatagcatgaatgtccattacattactggacatttggtcatatgtaaccagaaattgacattagggttgttctgggatttatatgttaattcctaaaatgatgggaataaaatttcctttggtctgcacagtttgcattatcccattggattaaacacctccacaaccagcaagtgagggttcaggagaaaaaccatattactgatagataaaataaagaactgacttgttttcatcacatttgagcttgtagagtgagtaaattttgttagccccactatcattaaattgtcattgtgacttggtggagcttggccaacggtctgagcaagatttccaggttaactctgaaatacatattttcaggagttgatgagtggagtttcttggctatgttctgtctggtgtcaatttccatttgtggccagacagtgtattcatagccagagaggaaagatttctgaattgtccttggcttttcaggcttctccccttattgcccagctagcagatccccttgagaaagggatgagttctgcctagcttctggatgttgctgtaatattccaggaatgaatacatggttcacttcattttgattctggccaaccttgattccagt

SEQ ID NO: 14079 - DNA, 19698 bp, Human
accatattaaaaagtgcttacatttgtatagtattaatcattctttcaaatttttgccagtttaaaaagttttttttaatggatcttactgtttatttagtggggttggggcatctttttgtgtttgttgacaattttacctatttttttcctttgagtattgtttatcatgcattttgacctattaaaataatttatatgtaattgacatcatgttttacttttatgttttctgattttcagtcatgctttaaaagtactttcctatgccaagattataaaaacatccattcatttttttttctagtacttttatggagttttttaaatagcaaattttattttggtgtaggtgtaggaatctacatttccattttcttctccattatactccccactctaaagaactacatctcttcatatgtggtcatatttccatgatagcttactgtaagtaataaaatcacaaatggtagtagaatttagaaatcttcaacatagctctcttactgtgaaaaagaaccttatggtacttgtcagtgacatgataacttcatatgttttatagatgtcacaagcaatttctcatcattaattcctgttttaggaaaggtatttttagggtgttacttagctatgaatgtttggtgaacatttatgagaaattattatttacttgttaaatatgcattttgtaaattcattattacatgaggtttcttaggaaattttagaaataatttttataaattattttaaaagtttgcttttattttccaggtttttatttgcatatattatttgcaggaacattcatttcactgcaaaagacgaatagtagtttgctttggctcctgggaaagattttatggaactttttgggttttcctttccctgtttttccacctcacacccctttcctttccttttttttctcccatggtagagggagaagcaaggtaatggtagatagagggagattattttgccttcttatatgtacatgctattattaaacatctgaatatagaaaattaatataagagagctgttatctattgggaaaatgtttttattcctatttagttttattcttccccacctctgcccccagcccccgagatggagtcttgctctgttgcccaggctggagtgcagtggcgcaatctcggctcgctgcaacctccacctcccaggttcaagcaattctcctacctcagcctcctgagtagctgggattacaggtgcccaccaccacacctggctaattttttttttgtattttagcagggtttcaccctgttggccaggctggtctcgaactcctgacctcatgatctgtccaccttggcttctcaaagtaatggaattataagcgtgagccaccgtgcccagcccctatttagtttttttctattatttgtcattttttttctattatttgtcagaattaaacttttatggcaaatactctttattaaggtttctagacgaggagaatttcatgctacgtcatttatattttatttatttgttaatcatccccttctctctttgctttttccgttgaaaacacattttaatcatcattaggttattagctgaactttcaattaaaattactggacacaatgtacctgtattaatagttgtctatagaaacactttttttcaaatttgtcttccttattatttccacagaaaggacatgctctctgaataactgtacagtggccaaaagatttggaaaaggaaaagatgctactgtcacctttgtgcatttcaagaaacctgtagatccatttgttcaagaaaactgtttatgcaatgcactaaattcagagataaatcctttcatctcaaatatttctaactcctatggaaatgtacaaaatggaaacatttctatacctgaaacatacagtggacagacagagcacagtttagcagaaattagagacacttctcaagtacttgcacatgattcagacatttcacttatgcccagtgatgccaaagacagtgttaatggtgaccttttgttaaattggacaagtcttaaaaatattttaagtggtcttaatgcttcttttcctcttcacaacaatactggctcaagcacagtcactacttcaaaatccatcaaagacccaagactgatgaggagagaagaaagtatgggagaacagagtagtactgcaggcttaaatgaggttttgcaatttgagaagagttcagataatgttaattcagaaataaaatcgacaccatctaattctgcctcctcctcagaagttgtccctggtgattgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttctttacaaaatcaaaaactgactataatgataccaaaaataaaaaggaggtagaatcaagaattagcaaaaggaagctacatatatcttccagggatcagaacataccacataaagatttaagacgacataaaatttatgggagaaagaggaggctaaccagtcaagactcatctgagtgtttctcttcattatcccaaggacgaattaaaacattttcacagtcagaaaagcacattaagagtgtcctaaatatcctaagtgatgaagcatctttatgtaaaagcaaatgtctttccagaaaactagacaaagcagttgttcacttaaaaaaagctcatagaagagttcacacatctttgcagcttataactaaagtaggagaagaaagaaagggcccattaccaaaatcatatgcaataatatgcaataatttctgggaaagttgtgaccttcaaggttatagttctgtgtctcaaagaaaatattattctactaagcatttttcgtcaaaaagaaaatatgacaaacggagaaagaaaagagctccaaaagctgatatttctaaatcattaacccatgtgtcaaagcacaagtcttataaaacaagtggagagaaaaaatgcctttctaggaaaagtatggctagcagtgtctcaaaaagtcaccccaccaccagtcacatgggagaattttgtaatcaagaacatcctgaatcacagttgcctgtatcctccacatcccaaagtacaagtcagtcagtttattataatagcagtgtaagcaatccaagtttatcagaagaacatcagcccttttctggaaaaactgcatatctgttttccccagaccactcagatgagaaactaatagaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaaacattattacaggaaacttccttatgggcccattaaacctaactttgatagcaagtaaaaagtacagtattcctcagttatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcaggtaattgcctccatacagatgggaatgaaacaaatgtcactgagaattatgagttggatgtagcatcaggaactgaagaagataaaagttatggggaaaatatagtggaattatcttccagtgatagttctctgcttttaaaagataatgtaaaaggctcctcttcagaaacatgtattgtgaagaaagacactgaggacagaataacgtggaaagttaaacaagcggaaaaagcaaaagattctgtttacaaaagaagcatgactgaaggatcaactgttaatactgagtacaaaaatcaaaagaatcagatctcagaagaatcctgcttaaatgagaaaattattacaactaacttgattgattcccatctgagcactaaaaatactaccactgagtcagtccctttgaagaacacagtttctaatccgcttaacaaaagagagaagaagggggaaattaaagttagtaaagactcgcagtctgacttgacattacattcagaaatagcctatatttccaaaccaggaattctaggagttaatcatacgcctattttacctgcccactctgaaacctgtaaagtccctactcttctgaagaaacctgcgtcatacgtgagtgattttaaagaaaaacattgctcagctaatcatacggcccttatagctaatctatctcaaattttgcagagggcagatgaagcatcatctttgcagattctacaggaagaaactaaggtttgtctaaatattctccctttatttgtggaagcttttgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatgatctcctcaaaggttaattttattaagaacaacgaggcagtacgtgttaaaatatctctttatggtctggaacatatcttttttgatgctgcaaaaaatcttgtttggaaagagagaacacaatccttcagcaaaaaatactcacaaaagaaggacgaagaaaggctactcagagtgaataaatgtgccttttctaagttgcagaagatatatgatactttgtctaaagatttaaacaatgaaccaatttcccctattgggcttgaggaggatactataattgcttccagaaagtcagatcatccaataaacgaagcaacaattagcatagaaaattctaaatttaacagtaatttgcttgcacacccagatatttgttgtattagtgagatattggatcaggctgaatttgcagaccttaaaaaattacaggatctcaccttgagatgtacagatcacttagaaattttaaaaaaatactttcagatgctacaagataataacatggataatatttttatcacagaagaaaatgttttagacgtggtgataaaccacagccatgaggctatcattttaaagcctgaagctattgaaatgtatattgaaatcgtcatggtctcagaaacaattcactttcttaaaaactcaatagcaaagaaactagacaaacagaggtttcgaggtatgctttggtttgatttgtcacttcttcctgagctggttcagtgccaagaaaaaatggcttctttttcatttcttaaagataactcaacagatgtttgcctttggaaagtgatagagactgctgtttccgaacttaagaaagatctggatattatctgcaaatataatgaagctgttaattgctcatatgctattcatttgctctcaagagaacttcaagaactttcagaaataaaaaagcttctgaagaagtccaagtattttatttccacatatattgactttgtgccatatatagcatccataaattatggaagcactgtgacagagttagaatacaactacaatcaattttctacactgctgaagaatgtaatgtctgcccctaggaaagatttaggaaaaatggcccacattaggaaagtcatgaaaacgattgaacatatgaagatgatatgtactaaaaatgctgaactaaccatttcctttttcctatgccaaatgctgtataacagaaggaagattttacagctgaagagaaaagaaaaaatgaatattcatattgtaaaacctggggaaaataacaataaatttagtatttctacgatgttgcccccagtatcagagtgcataaacaaaaacatctcaaattcctctaaaaaacgaccgagcactgtagacaaatgtgaagactctcaggaacaacagcaagatactactgtttccagttgtaaaaagctaaaggtatgtatgttttaaaacaaaacttttataagtattctttttgaaaacaagtctactcataagcaaacaagtagtttgcagaattctaaaagttaagaatggtaaattgtctggcaaaatgaatttactaactataatattgatttaaacaattcatattatctataaaatgatacataaattatatgtataggtgataccttgcaaatgtctactttttaaacgtaaatgttttaacttagaaaacattttttggaaggacgtggattttaaaagcttcttaagaaggagttcaatattatgaacactgagtgagagaccaatatttattgagtagcttttctgtataacaagcctatgccccgtgtagtgaatattaaaaagtggctaacaaagcctgtcttcttgaccattatcatcccaatggagaaataggacagatatttttcaagagataattatcaaggagttaaaagtcctatattaaatacattttaacaaattgtctaaagcatttaatatgtacttggcactgatttattttatacacaaccccttatgatgtatttcctattatcttacttcaagataaggaaagtgggacacagaggaaatgactatcctggggtcacagaatttagtaaatgggagcacccagatctaaaccaggcagtctggcctccagagcccttattgacagttgtctcagcactgctctaagaggtttctcttacagctgttcaagacttcttagttcagaagtttagaaaagaaacctatatgcagctgggtgcgatagctcacgcctgtaatcccggcactttgggaggccaaggtgggcagactgcttgagtccaggagttcaagaccagcctgggcaacatggtgagacctcatctctactaaaaataacaaaaaattagccagacatggtgacatacacttgtagttccaactacttggaaggttgaagcaagaggattgcctgagcacaggggcggaggttgcagtgagccaggattacaccactgtactccaagctgggaggacagagtaagactctgtttcaaaaaaaatttatatatataatttttaaattaagtctggaacaatttaacttagtgggtaagaataatctatggatggagaaggttatttcagattatggaatatcttaaattagacctaaggagtttgaccttcattctgtacacattgaagtgtactgtcatatgaaattcgtttttctaatgatttaacagatagattctgagtatataagtcatatatgtcttctgtagaagtatatatagtaataagtagtagtactgtatacaatactacttacagtaataagtcagccatggcttagaaaaaggtgttagaaaggaaaattcatattgacagacatgacttaaagaatcgatggggcttagcaactggtttacaagaaaggacataaaagagggagggaatagtcataaatggacttcaaggttagttttaagggccaggtgtggtggctcttgcctgtaatcccagcactttgggaggctgaggcagatggatcacctgaggtcaggagttcgagaccagcctgaccaacatagtgaatccccatctctactaaaaatacaaatatcagctgggtgtggtggtgggcacctttagtcccagctactctggaggctgaggcaggagaatcgcttgcacccagtaggcggaggttgcagtgagccaatatcgcatcactgcacttcagcctgggtgacagaatgagactccatctcaaaaaaaaaaaagatgtgaggataagaagaatgttacaaatttattttttttaaagttactccaaacatatatgaaatatgggaagtctaggagagtcactgctttctgcagggaggtgataattaattagtttaactttagatgatggcagaacaagcaattaaaaatatctaatattgaaataataattatttttattatagtttgtcatcactaatgaagattttctttgtatcttttaaacacaggtagacatgaaagatgtcacaaaaatcaacagagaaaaggcaacattcaagcatccaaggtaggagttcccatcagccctatgtggaaaaaaaattgaacaaaattgggcaaatactaaacaactagaataacacaattatttatataatgtcattggatcatacatgtaacttaggggatgagagtaagctaaggaaaaagaaatttgtttgaaattatacagtttcttaaattcagcctaaggagtttgaacttcattctgtaagtattaaaggctaaagtcatgtgaaatttgctttttcagtgatgtaaaggttaagaatattctgagtatagttagaagtaagtcagccaaggcttagaaaagggtgattgtttcacagaataagaaagaaaaatttatatctttacaagatacgatacaatacataaagaattgatggggcttagtaagtggtttaccaaaaaaagacttctaaaatcaaaaagggacttttaaaaataggacaagtgataagattacttttttttttaacttgtgcattttgaagaatggcaaatttcaaaactggcattttaatgagaacctacatagtcatcaattcccatacgatactttgagctctcagaaagtataattttgattttatcgcatttctggtgatgtttcagtgaggctgaattcagtgaaatatttggcttttagtttgttgagtgggatatgtgaattccaggccaaagaagaatttctcttgactacagagaaatagtactacttttcccttctcaacataatatttcctcatacaatttaagaatttcataaagcaccaaaaaatctaattactggctgggtgtggtggctcatgcctgtaatccctgcactttgggaggccaaggcgggcggatcacctgaggtcaggagttggagatcagcctgaccaacatggtgaaacactatctctactaaaaatatagaaactagccgggcatagtggcgggtgcctgtagtcccagctacttgggaggctgaggcaggagaatcatttgaacttgggaggcggaggttgcagtgagctgagatggtgctgctgcactccagcctgggcaacagagtgagactctgtgtcaaaaaaaaattcatatatatatatatgtttttatatatatacacacatacacatacatatgtgtgtatgtgtgtgtgtatatatgtgtgtgtgtgtgtgtgtgtatatatataattacctcagggacctatattaactgtctggctttagacaattcccatttggatgcttctctcagctgcttgagactgtctgaatttagctaataatttcaaggctattaaattgggcaagaaattttggagatctgcttttcctattctcaaagatgaacagacaaaaacgtattagtctgttataacagagagggaagaaatctttggtgggaaggcaggggttacagctggtagtttaccagttatttatagctatttacaagtaatgaagatcatcaggcaggaggcatatgaattaaaaaactatactgaacaattgactagtgatagttttctacttttaaaagcctccattagaaaatgtctaatgcacaaaatagtttattacaatattggaaatatatttaaaatgtagagcatatcatcttcagtaggaaaagtatctaaatccaaaccacggcagtcaaactaggaaaatgttaacttgtatagtgccaatagaatgggaaaacgtaaagcttaagaactcttcccctggataaaaatttcaaatatatatttccattaaaattttatgaccctatatatttaaattcatttttatgtatgtgttgcacctaataggactacaggatctcatcccaaaagcgaaaacaaaatagtaccaagttcatgtgacagtctgaaaagaaatcatttaacgccaaaaaaggttgaaatgcaaagatcactacctggctcacttttacccttagagaacccaaaagacacttgcgcatcaaagtcggaaagcaaaatagacttaactgtttcatctgatcacttcagtggacaacaggaaaatttaaatagcatgaagaaaagaaatgtgaacttcagtgctgctgaaacaaaaagtgataagaaagattgtgctgcttttgcaatttgtgaccaaaaaagtgtacatggcacattttcaccagaccatgggacacttttgcagaaatttcttaaaaattccccagatcccacccaaaaatcctgcctttctgatataaacccagaaactgatgtttctcttgtgcctgatgcgtcggtgctctcaaagccaattttctgttttgtgaaagatgtccatcctgatctagaaatgaatgacacagtctttgaacttcaagataatgatatagtaaattcatctattaaaaattcctcatgcatgacttctccagaacccatctgtatccagaacaaaattcctactctgcagataaacaaactacagcctacagaaactgagtcagaggacaaatacatgaaggatacattgaatcccaatactgtgcatacttttggagcatctgggcatataacccttaatgtgaatcaaggagcagagtactctctttctgaacaacagaatgacaaaaattcaaaagtcctaatgcagaatgctgccacatattggaatgaacttccacagtctgcatgtaacccaacatataattcttctgagcatttatttggaacttcatatccatactctgcttggtgtgtttatcagtacagcaacagcaatggcaatgccattacccagacataccaagggataacatcatatgaagtacagccatctccttctgggctgttgaccacagttgcaagtactgcccagggcacacattctaatcttctgtactctcaatattttacttattttgcgggggagccacaagcaaatggctttgtgccagtgaatgggtattttcaatctcaaatacctgcttctaattttcggcagccaattttttcacaatatgcttctcatcagccattaccacaagctacatacccttaccttcctaatcgatttgtgcctccagaagttccttgggtttatggtgagtttcacattttaatgcctgctttattgagttgttacttttaactgtgtccatttatgtaagtgaaattcacagtaagtgatgagttagagggagaaagagcagtcatttttctgtacagatttgtagaattgccaatggattgggcagagagggtggaaatctagttgtcaaaaattcaagaaaaaaaactgtcagtatcactaatatgtccttgacatgtttgttcttcaataaaacccaacagtagggaatagttaagtaacttatagttaatcgatacagtggggctgggcgcagtggctcacacctgtaatcccagcactttgggaggccgaggggggcagatcacgaggtcaggagttcaagactagcctggccaacatagtgaaaccccatctgtactaaaaatacaaaaattagctgggcatggtggcgcacacctgtagtcccagctacccaggaggctgaggaaagagaatcgcttgaactcaggaggcagaggttgtggtgagcggagatccgccactgcactccagcctgggtgatagaacgagactcgacctcaaaaaaaaaaaaaaaaaaaaaaaaaaacgatacagtgaaatgtgacgcaaccattaaagggtttttaatgacctgacttttttaaaactatatcatgtaaagttacctacatgaatgtggaaatagatagaaatactgaaataaaatatgccaacattttaatttgtctatcttcaggtaaaaactttagggtgtgtagagaattttttcttgcattttctagattatctactgtgaaacatacattattttgataattagaggaaaaacagagtaaactaaagtgggaaaataaatttcaattagacaaaacaacccttctgtttctctcagttatctaatacagtatcttggtgtaagtgaatagagttaattaaaatgtattggtagaagaacttgatagtttgctctgtaacatgaaattgtttctttctaaaatgcttaattctacttgtaaaatagcatgattagaatataggtgttttaatgaaattgaaatgtgcatttatcagagttaaagcaaaatataaaaacaattatcctgcagaaaaagttaccctaacaaccaaatattctaccattggaaataaaatgtactttaaataaaaataaccatcttttaatatcttatacggagaaatgcaagataattcttttttaaggcagggtctcattctgtcacctagactggagtccagtggcacattcatagcttactgaaacctcaaactcttgggctcaagctgtcctcccatttcagcatcccaagtagctggaactacaggcatgcatcaccatgtccagctaattatttttaataatttttaatttttatttttattatttttaatttttagtagaggctgagcacctgtaatcccagcactttgggaggtggaggtgggcagctcacttgaggcaaaacatggcgaaaccctggtatctactaaaaatacaaaaattagctgggagtggtagtacacacctgtaatcccagctactcaggaaggtgaggcatgagaatcacttgaacccgggaggcagaggttgcagtgagccgagatcgcgccactgcactccagcctgtgtgacaggaagacccagtcccaaaaaatatatatatattagtagagatgaggtcttactgtgttgcctagggtggtctcggactcctggcctcaagtgatcctcctgcccctgccttgcaaagtgtgggattacaggtgtgaggcatcaggcccagagaatttcttttaaaaagtttctaagccctggatattgttacaaatggatatgtagaaaaaactgagaggccgtaggacataggtctgaattgggcaagaagcagcctattgacatagttctgtttctaactgagaaatctgatcacatcagctcctctgctttggagttatatcactgattcactataacctactggataaaattcaaatactttagcctggaatgcagagcccttcacagtcctctatgtccaacgtcatctgccaccacttccacctctgcattcaagccacgttgaacaacttaatgttctcccgtaggaccatagaacaatctctctcgtacttctgtagtactttttgtgtgcttttctcacataaggtatgtgagtattaggtggtattgtaataatctctgtatctttccctttcttccctgcctcagtaaatgactttacacagggctagaaatttttcacctaagaacataaggaaaacgataaaaggggaaaaaaggctggacgcagtagctcatgcctgtaatcccagcactctgggaggccaaggcaggcagatcacttgaggtcaggagtttgagaccagcctggacaacatggcgcaaccctatctctactaaaaatacaaaattagccaggtgtggtggcacatgcctgtaatcccagctacatgggaggctgaggcagcagaatggcttggatctgggaggcggaggttgcagtgagccgagatcacgccattgcactccatactgggcgacaaggttaaactccgtctcaaaaaaataataaaaggggaaaaagaaagcaggaacaaagtccatgactctgctttttccttttttattaatttggtatcattgctgatgctgtaatgataaacaccaagcatagtagatgggacaaacctatgaattaaagtggacactttaatttctgagataggaaatcttgattgtaattgtttcagaagggttctcatagtttgggctttcttttgttcttaatagttaagctatttgtgatattaaaaaagatagctctggaatcaagtccagctatggctctcaaataatctgtattgttacctccttggttatattagtccaattaaaataaaagaaaaagaaataatcatttacttaatatccaaaagtcactctaaaaaaaattaaggaggcaattgcaatgttataagcacatctttgagttatcatgagtgtaaataatccacagaaatcacctctcacacttacaggaactgcattcttaaaaatgtgaaaatcccttggacccatttgtcactatattgttcgtggtgcttgtattcaacaccagaaaatggaactaaaggacagtgcttgagtgagccctgtgtccagccacattatgtcctttattacatttaatttcacaggatagcttagagagatgcagaggtgctgttcttttacagatgaggaaaccactcctcagagagccttaaattaactttcataggacctgatgaccctatggctacttaagggcaaataagcactttgatctctttagctgtaatttaaactcaggttctttccactatagtatcatgtaccattagtctaaattatttatttaaatctttgtggtgttttttcttccagctccatggcaccaagaatcctttcatccaggacactgaaaatagtcttctgtctattgaaataagacataacaagtttttccaaatattttttacttatatattttttaacatttagcgatttttaatgtttgtaaatgtggtaggaaatataaatcatatggtcctttgtaaaatatacaaataatctaacacatatcatataggacatcaatttctaacatctgatataccagaattatttccatgcaattataaggggagggtaatatgatcaaagttaagcaatagtggtaaaatctttaaaactagattcttgcttctgatatgtttcaatacattgttgatggcattgtgccatttgagctgaaagcaggattttttttcattagtcatcaaaccaagaattttataattcttgacactttattatataatttacaattctatgccagatatggcaaatttcttcaatttcagtattttatagtttctacttgtaaaatatttttaataagaaaaattggtttgcataatctcagtgtttccttgagtagagatgttttaaatgtttatgttggaagcaattgtagttaattatattggcaatgaagcactttcaatgcctttttctacaagagccatttccagaagattattttgtttttggatttcacaatttaaatagttattttaatgattttctagcaaataatagagaataatgtttatgcttatgcagttagtctttattacagtaatttaaacaatgtggcacaaacatagttttttcatgctcttgtcatagacttttctttttaaccttctgcaaaagtaaaaactctcttagtaataatcatcatagggcaacaggatatagtatgtaactgcagtcttgagctgtctcttttcatgtattacctttcttgctcaacagctattcctgttttctgtaagatcctagtcagacagagccctcacaactggatagacctttctcaagggttagccctaaaatgtgacaagagaattggtttggctgaatcacaacaaataactagcaaagcttcagtgcttttgcaaactttttatgtaagcaaactttttgtgttatctggcacaggcctttgaaaagactataattctactttgtttaatgtagagtaactaatttttcaatttagaaagacagtgagaatccccaggataagcctctttatactcacttaaaccaactgggatggaattcagaatacctaagctgcttctttaacatagagatctttaaaaagggaaggtcaagcaaagaactgtaaccgaaagaagtaagagatttgaaaagacgatagagttaaaacaatatttaaaaaacatttctatttggtccatgcagttttatttgaaaatagtctgtcaaaatcagaactcctgaacaactttgaaagcagtaatattaactggtattcaaaaatgaataacagccaaaaatgaataacagccatttgatttatgtttccctcagtcatttggtttatgtttggttatggcaagatgttacagcatttatagttaatactactactaatatgtaaaccaaaagttaaatattctagttaaggattgtttctttaaacaactttcagattctgttgacattgtctttgtggtatttttatttcatgggttttaatttctcttaaagacttacctaaatattcagttacatttttaaaaaatctgtacgtgacagaatattaaaacatggaatatttttgcttcaagtgtgttttttgattctaaatagtagaagaaattaaacctgagcaaattttataagaaaaaaaaacctgtttgtaaatattgttaaagaagaattatttgaataaactggattccttctaatttcagggtttttttcttttgtgtttcttgaatagtaagcataaatatgggccaggcctggtggctcacacctgtaatcccagcactttgggaggccaaagcaggcggatcacctgaggtcaggagttcgagaccag

SEQ ID NO: 14080 - DNA, 60990 bp, Human
ccgtggcagagccgcactaggatttccaggaggttaaacgtgcgatgctgtggaggtgcttggaggtgagggaaccccaatggtggacaggaagctctcaaagcacttagaggtggaggagtcctggacagtgggcaggaagggtggggtcaggaatggagtgggcaggggaagggtggagggagctgggcaccctgcagatggcagggtgggtgctcagtgccatggggctgccaccatcctccaagtgtggccccgagggccggagctgctctccctccattgctaggcgtaatcagttccttgtgcctggctctgcccaggaggtgtatattggggggcatgaatgtagggccagcccagctggccagtgaccctctgagcacagagccttcgggatggggctgggggtgtcccccacaacagagttcccttcctgagatgcgctggtggaggagggggcagtctctggaatttctgtttggagactttccggaggcgtgttcagacataaaatcacagcagcagcagtcagttttcaagcaaagagacttctctgggcatctctgagacgagtttgagcagtgtggggattcgttttgggagcacggcctcactgacatgcagatgtttgcttgtggaatgcctgcgcctgccctcgagaaggaggtggcactcagctgcttgaaacaaggctgggtcccaagcagcccagccctgccctgtggacagcaatcgaccgatggctacagcatgtcctgacctggggacagctggggacaggttgtggggctgtttcgtcacagctgctgtcacattaactgaccccagccctgggggagggtggctgcaaccccagccgcacagcctggaggaggcagggtgacgagggactccagctgggggagctggcgtgcagagcactgagggggtgggtggattgtggggtgaaacctgggtgtgtgcgtgtgaggatgcacatgtgtgaacgtgtgtgtgagtgagcacgcctgtgtaaactgcctggctccacctctgatgggctccgtgatcttgagcggggtcaccaggctcatgcctcagttttcttcatctgtgaaatgggccgatggccaggctgcacacaggtcctcagagggcataaggcacactcagcacccactgctgtgcctgggcagctggcgggggggcacagcagccactcacatgccactcacatccctgtgggttaccggctgcctggaatgttccagtctaaccggatccttttgtggacggggagactgaggccgggaaggagtatgcattcctgccctggtcccgggctccgtctctgctgggtctcctgggcagaaggtcaggaagggctgagagggacacagtccaaggcaggtaaagccccagctttgaggggaggcacagcagctctgagagggtctgagcccctcgagaccctccccgggatgtttaacgacttgggcagccattgcaacagtggaattggcactgcagcaagctgagcattttttcggttccaagtttcccacaacacaatggctccaggccaggcgcctctgggcgttccaggtcagagggggagcaggggctgggggccgctgcctcagtgcttctgggatggggtcctggcttggagccccaatccagagactcagcagccctgccccggcagagcctagcggagcacgttgggaaccctgtggacactgcacacagcaccctctgtcctcacggagcctggggctgctgcagggccgtgggaaagaagttataaatccttgggtgctggaacccccgggtgctgggcaccttgattccaaggctggtgccttctttccttctgcaagagtggggggtggaagacagccggccagaggctgggaagcctgcacaggggagggcaggagggcgtgagcctggctagccccacctccaggcacagaggccctcccgccgcccgcagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcaggtagagcttctctctcctccttgctgggcggggcccctccctggggaagcctgcaggacccagacagccaaggactctcgcccgccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtggggccgggtcttgctaataactctgccctgctcggggctgaccccgaggcccccgccggtcgctgcctgcccctgccaccctccctgccagtctgcggccacctgggcatctcacgcttctggctgcccaaccacctccaccacgagagcggcgagcaggtgcgggccggggcacgggcgtgggggggcctgctgcagacgcactgccaccccttcctcgcctggttcttctgcctgctgctggtccccccatgcggcagcgtcccgccgcccgccccgccaccctgctgccagttctgcgaggccctgcaggatgcgtgttggagccgcctgggcgggggccggctgcccgtcgcctgtgcctcgctcccgacccaggaggatgggtactgtgtgctcattgggccggctgcaggtaactggccggccccgatctccccaccctttcctttttgccttgccaggtaagtgtgggcggggctgacgtgagcctggtacaggttccccccacatcgaatctctacgttcaggggcccgtggccctcgggaggtgggagagctgggagtgaggcctcctgtgtggggaggaggccggcgtctggacaggaagagggctggatgaaccgcagccgatgtgtccaggtgccacctgggcctggagctccctgagcattttagcgcatttagtcctcagcacggtcccgagataccctgccatgccccgagtcacagaggggaaactgaggcgtggggcagtggcgtgactcaccccagggagccgagattcccgctcaggtgtggctgcatcgaccttgctccggtcactaagctgcacggttcgatgcgcttcctgggagccccagcgtgctcgggccaagggtgctgccgcgtgggcagtgcagagaccctaccagcgtggggaccagggaggtctgcagggcccgtcctgagagggagcctttcatgtccccctccccatcctgaagcacacagcctccctgccacagtgggggccgcttctgggcccaggggacgttgccccatcaccgtgtggcctggccttgttgctggctggacagttgggggcaggaagaggagggaaagggggactctttaacctcctgggggcaggggcagcccagaaaggaccccagcagatccctcctctgtgtccgggagtagacggggcccctgagctgtgcctgccccattcagattctgcttgctatgtgcacctggcagccttggcccagaggccctatccccgcagggtgaggtgctctgtcctcctctgctgtcctccccatagtgccgaggggaagcagccttgctgtttgctctttgggctttgggacagggttggtgggggttagcagctgtgccggacctggaggtgggggtgcctgcagtggaaattctggtggacgcccacccaccaggctccgtgagggatgacgagcttggtgattccccttgagtttcaggccagtgaccgtttctctcagcaaagcccagagcctctgcagaccctgtgtggggcctggggagtggccggggggccacagacagggcagggacaagtgctgacaacaggtggtcccaggagtaaagcccacgtgggctggaatggaggggcagggagggagggagggagggagggctgcagcggggcctggctgagcctgaggggggcacaggaactgcgctgggggggcctggtgtgtgcaggagtgggggcccttgtggatgcgccccagaagcatagggctggagctctccgaggcaggggccgtgcccgcggctgttggcatctcgtagggctggagctctcccaggcagggaccgtgcccacggctgttggcatctcgtagggctggagctctctgaggcaggggccgtgcccacggctgttggcatctcatagggctggagctctctgaggcaggggctgtgcccgcgaatgttggcatctcagggcttagatgtcacccccagggcagctggcactgccacaagcagccagattcctgggtcccactcatcctccgtccctggaacacccaaatgcccagcaagcaccagccgccttgcaggcaacccccccggagccacaccccacctggctactgttccccaccaagcatgtgggtagggcagccttgcaggagccgtactgactggagggacccgggtccggtgtcctggagccccgggaggctccagcacagcccaccttgtcctccactgcaagcccacggaggcagacaggacagcggtgggctgggagggctgcagcctgtgggaggggaaacgccaggcctgcacacctgaccctgccctagccctgccagcccgagactgtctgggatcagctgagcactgtgagcaagcttcagcctcagggaaggtgccggtctcctgggagttggggcacagctgcatggcttgggggctggggtccgagtggggctgtgagggcgaggaatttctgcaactgcagctggcccggtcggtggcacagcctgatggggacttttcactgaacatctggacagcttggtagcgtccccgtgcgagggaggccgtgtcccgtgcagggtcctgggggactccatcagcgttcctggcctgcattgcctctggccaggggtgggcctcaagctttatcaaggagccccttcccaggtgtggcctggccgggagggtcctgccccctcttctggcctctcagctcctccccagcccaggctcctcttgggttagccccaactcctgccggacccctatgttgggctggacactcccagccctgggtgaggggcaggaggaggagggggagcccagcctgacccctcgggcagacttcgaggccccgaaagtgggggtgctgggctgtgatccgggcaccagaacagagccctcgaggcccacagaggtccctggctgcatctccagggatcagggagtatgtgcccctgaggggaggggagctggaggggtcctgctgcctcctgcccggctccatctccagcgccccctccacctcgtcctgggcactgccctgtgtgtccaccccgccggcccacctcgaggagagtgtgggggacagtgcagccgtgctggggcgtggggggcgctcaaagggagggtgaaccctgtggtcagcacacaagcagggaccctgtggagggttttgctgtgttgtgggcttgtccctcaggtccacgaggaagggagtgaggccccctcacacgggagggccggggtggggtagggaggctcccttgctgcagctgccaagagtgagcgagcggggcttgggcttgggctgcccgggacactgcctccaggaagccccctgggctgtctcagtgggactctgtgagtgacacatggagctcaggtcacaagggctgtgggagtgtcaccccacaacagcaacgggtgcctggccctctggactttgctctctacacccctcctgagctctcacaaaccctggcccctgggaccggaggcaggtgatgtttccaaggagtcctacaggcaagcatcctctgacctgggagctgcgtattgttcccgtttacaggtgagaaactgaggcctaggaaggacagacacgtgtgcgtgccgcaagtgtggctagcaaggagggagcctggaggagggcccagcagcctggccccagagcgctcttcagcatcgcagcagatgcaggacaagcaagctcccagccggggagcaccaggagaccagcaggcatccaccctcgtggtgcaggccatctgatgagggcagggaccagtgccgggatggatagtgcctgtgcacagagtggggcgcaactgggcacagctgccaccggggtgctcgggaggcaggtccacacacacgccggccaagtcgctcatctcaaatgcacgagtcccgtgatcttggaaagtggtgcacaggcccctgggctggggcttcctctgcctccacccccatcactggacattcggaggtcagtgggaggccacgggagtgcacgtgaaggtcatgtcaccatgatggccccgaggggctgctccttcatcgctcctccctaccccatgggccagccactggcacacaggtgtccttatatggtgcttacctcttgctcctttagtcaaatgcagaatttgagaaaatgtcccttctccttaaaatgctttgatttgtttgatgtttccatgtaactttggtttaagaagggagaagaccactctgggaaataactcatgcttatctctcaccgcttggcaacctacaaatattttttcgatgatgctggctaagcttctcgtaaattctccatgcctcttagatgcaccaagagtgactcagcatttaactcctactggagtgtcaagggcccagtgcattgggtgcagttgtctgtgggtacaagatcttgtgtgattctgaactaagcacagacagaatgaaaagcacagcactccaaacagggcttcctgcaggtccttttacgtatatttgggtttttgtatatatctaaggtcaagctagtggacatctatcacttcaaccagttaccgttgtgagtgtggtgagaaaacttaagatctactcaagtttgaagtgccatatgcgatacagtattctagctgtaatcaccatgtgtacattagacctctagaacttacttttcctgcataactgaaactttgtacccttcgaccaacagtcacatttcctcttctctgtgggctggcctcggctgtgccctgttagcattcccagataaacaaaagctaagggggttaattgccactagaccttccctgcaggaaatggtccagtagtccaacaggcgaaatgaaaggacactactcagtaacagtaagtcaaggaggcccccgttgcctatgcacagagtggggtggcagctgtgccccattgcaccccactctgtgcatgggcaccgtccatccggcaccagtccctaccccttatcagatggcctgcaccattagggtggacacctgctggtctcctggtgcccccctgcagggctcttccttgtcctgcatctgctgcaatgctgaagagcagtctggagccaggctgctgggcccccctcgaggcttccttgctagccacatctgtggcacacacgcatatttgtccttcctagacctcagcccctgacaaccaccattctactctgctcctatgaatgtgacttttttagatcccacatgtgagatcatgcagtatttgcttctatgcctgccttatttcctttagtttaatatcctccaggttcattcataaaaagtgcagttacaaactgttgttgcaataccagcttttataattgcccatgtatttacctttattgagatcttcatttcttcatgtgacttactgttattgactagtgtcctttcattttacctgctggactccctggaccattttctgcagggcaggtctagtggcaattaactcccttagcttttgtttatctgggaatgccaatttctccctcacttttgaaggacagttttactggatataggactcttggttaacagttttttttttcttttagtacattgaatatattggtccactgccttttggcttccaaagtttctgtgacaaatctgctgataatcttattaagaagcccttggatgtgatcagttgcttttctcttgctgctttccagattctctctctgtttttgaaagtttgatgataatgtaacttggtgtgagtctctttgagtttaccttacttggagttccctgagctcttaactgtttatattcatgtctcccaacaaatttgagaagctttcagccattatttcttcagatagtctctctgcacctttctttttctcttctgtttgcagcttccacggcatgcatgcttccttgtctcttgatggtggccacaagccccttaggctcttttcacctttctttcatcttttgtctttgaaaatttccattatcttatcttcaagctcattaatttattcttttgtctgctcaaatcaccttcagattcctctagtgatgttttcaatttcagctattgtacttttcagttctgtaatttctttctggtttctttcaaggtttttatattgatatttccatgttgttcatacatcactttcttgactttctccacaccttcctgtagttctttgagcatctttaagacagtcattttaaagtctttgtctagtagatctgccatcaggtcttttgcagagacagcttctgttaatttatttttctcctttgaatgtgctatattttcttattgctttgtgtgccttgtgattttgtgttaaaaagtgaacatttgaactcagtaatgtggctcttgaattttgcccttcaccagcgttcgcttttttttgttactttttaaaaaatgttttgtgtctgtgccagaaatctcccttaggtgtgaacttcaggtcttctcaggtcttttctgagcctgtccctttccctgggtgtgtgcagccactttctaattttcctcttacatgctgctgtttttcaatgtcccgttctttcatgtttggctcccaaaggaggaataagataaaaatgagggagaaaaaacagtgccagccctctaaatccccttcaagtcacttcagctggaaggggcagcttgcaacaacagagggagtgtaaaacaatggccccacctccctgtctgcacatctgtgatcccaggcaacctgatcagagcacaggttctcgatgtctgcaggacagggtcctttttgccgtcctgtttcccacaagctgtgtggctgctgctccaggaactcgtgcatggcacctgctatgggaatgggggtggaggatggatgtgtggctgctattgtgccaagagctggggtttagctaaattaaccacccgttaccgtccaagccttcctgtggacattgcaagctttcagtagactccagagttccaaaagagttctaagacaaattctgcccatgcacttgttaattagttggggagatggattcctggcgctttccatctgccatttaccagagtactccagaatcattttcaaacacgtttctttctgtcaagaaatcaagtcttggccaggcatggtggctcacgtctgtaatcccagcactttgggatgccgaggcatgcggatcgcctgaggtcgggagttggagaccagcctgaccaacacggagaaaccccatctctactaacaatacaaaattagctgggtatggtggtgcatgcctgtaatcctagctactcgggatgctgaggcaggagaactgcttgaacctgggaggtggaggttgtggtgagctgagattgcaccactgtactccagcctgggcaacaagagcgaaactccatctaaaaaaaaaaaagaaaaggaaagaaatcaagtcttgaggcatcatcattgttatatcatgtgcaggtgtctagcctggatgccacccagctatgccaaatgcggggagaaactccctatgggcactgtggctgggtccagagctcagaggctggagctttgagaactgggctggagccaaaccatgatggaagcctctagctctcaggaagagacacacatctgcgggggcagagtgaccacatttccaggttgcccagccctcgggagtagcacagtgcccaggcactggggcagaggtggatcccgtagtccctcggtgggagctccaaagcctcccgttttcatctcttcctcttcccaggatgggattttggggatgagatcttcctggtgggctggagtctgtcccagaagtcaacagcccaacctggggccaaaaaagaccctcttagataaggcaggccctcggcaagactccagccacacatgagagggtggaacagagctcctgagtcccactaaccacggccacctgcagtggtcaggtgggggcaccgtgtccatccccccatgggtttgtgccaatttgcatataggtatgtagcttcctattggcgactgtaagaaattgccacaaattcagtggcttaaaccaacacagctgtcttacctttcagttttggaggtcagagtctgaaaccagttcactgggctgaaaccaaggtgttgtcagggctgggtccctctgggactctggaggagaatctgttttcttgacttttccagcctctagaggctgccgcttcccttcgctcaaagccccttcttcccccttcaaagccaacggtgttggacaagtcctcatggtgccatcttttgtccttcgattttaaggctttgtgtggttagatgtggatcatctcccatctccaggtccacagcctgagtcccagctgcagcatccccttgccacgtaaaattacgcttgtgggttccagctgttgtgccgtggacatccttggggccatggctctgcccaccacagtttgtccatgtgcacggctgcacatgtgtacatatgcatgggagtcttactttgcattaatgggattgccctgtgtctgaaagttcctctttcctttatcctgcatctcaggagtctccataactccagggagatgctctgctcttcgtgttgttctggtcttttcctcagcccttcctgactgaagcactcgcaggtatttctgcttctctgtataacagatgaccctgcagacacctgctcagccccgactggcgggttcatcgcacagcctcgcctttgtttatcagacaccagctgagccaccccacctgtgcctggcgtgggttttgggtcagcgctgacggtggagagattgaatgttgtaaacgtgtccgagtgtcaacaggaagtctccacccggggacaggggcccgtttcttaggttgtttttagccttccgtgggggctctgcagccttgggatttggtggaggtgtttgttctgaggccgtttttctttgatgccaagatgtccccccgggcacttcactgcgtaagtgctatggtgtgatggagtgatgatggtggcgcactcttcaagctctggatcaggttccggaagctctgtgtgagtcttactgaggtggttattttctcttttccctggaaagtgggctgagagcactccatgtgggcacgagcggccctggctctgcaggactggagggggctgtgctggagggcggggggctggccaggcagccttggatcttgtcctcaggagcccttcaaaggggcagcagagactccaggccctgtgccccgaggagtcaggctgggctggttctggggagtgtctggagcacctgatgctgagcacaggcgggcgtccgtggagtgcacgtgtctgagggtctctgaggggtttgcccttttcttcggagccacggtggccgtgagggatgcaggacattgggtgtggccctcgaggactggcctgtctggagcccactcccccgtgggtgaacgcggctcttggtggagagcccagtttggggagaagggacggtcttgtcctgggaggtgtcagacaaagccgagcatgggactcacaggagacccccagtcaggccgtgtcagggtgaggctgggagtgagggtcctggaaagtccggcttctgggagagggcgctttggctcagaggctgccactgcagaagggatggacgtccccggtcccctaagataagggacccaaggggaggggcggggacgttccacactggtgtgagaacagcggagagtcccagccagaggtacccgctgctctcctgcggggaggatgctggctgcactgtctgtcctgggcatatttaaaggggcctctgttaacacacacaggcctccagaaccatccacacttctggctggcctgattcctgagggggaaatggtctttaaagaagcaagcaccttgatccaaagggaggtggtccagcaggaggggccgccccaccatacccaggaaggttgagctctcgcacccgggaaggctgagctctcgcacccgggaaggctgagctctcgaaatggggttcaggcatttgctgtttgattccaggacatctgagacagctgggcctgtacctcggggagtggaggctgcgccattctctgcccatccagcatcttagggccgggcatttggaagctggcttctgaagggagcccccaggagcttcgtggagaggagacgggacagctttggaaagggcgttgctgtcactggggtccctggggccgccggtgtagcgtgctggtaccctccagcccaggaaggtggcagctgccgcatcttgctttcccaatgacggaatgttctaggaagggtggtgggaggtttctccaaggtgaacgcgggggcagctgggtggctggcacggcctctggcccccaggccgagtcctgtttcctgatcttatcacagccccagcttggacatgtgggaccaggcacttcttatgagaaaaaggatcattgtaacagctgccatctggatggacgatcattgtaacagctgccatctgggtggacggcggcctctgtctgagggggatgtgaccgctggcccccagagcccaggctcagcccgttgggacccctctgcccctggcccagactgtggctgcaaagcccgggctctgcctggcacggcaggtgtgctgggaagtcactctgagcagggtctgcccttgagtgggtgctgcccccctcccgtgggcaggaaacgaggtgtgagaactctgggcaccggggctgcgtcctggcttgggctccctgggcgagggatggacagggctccttctgaccctgggctactgagtcgaagtgaagtcaagctccgcctgggcaggaatgagtggagtgagtcacccggcgctgtggggcatttgcacggagcagcggggctggtggggagactgtggcacgttggcaggtacgtcaggcatgcagcccctccaaggggtgattgtggccccgaggggaatcagcatgggggggatggggagatacagcttgtccttgccacatgaagcacctggcccagcaggtgagccggtgaccgacagcgctgggtgaaatcccgcaccgtgtcctcagatgccacgtggaaccccagctgaggcagccactctgggcgacgccccgtagccgaggcttcgaagaacactggggtgtggggtcagcctccctccttccctgtggtggaactgtggcttcacagtggaggccaggctggggtgccggcctgggctgctccagcagggtcagagtgggcgggcagggcacagggccgggcgggaaggctgccagccccagcccctcacagctccttgccccagcgggggtgccggccagtccctggtcccttctccccactggctctgcccatcaatgctcaaagcatggaaggggaagcctgtggacaccatgtctgctgtgcccatccctgctcaaagcatggaagggggcctgtggacaccatgtcccgtgcagacaccatgtctcctgcagacaccatgtcccctgcacacaggtttctgcatggagcctgcctgtcgtttgggaatgagtgaaccagggtggccgttgggtggctgagcccaggggatcagggcaggctgccaggcacgtggagagccctcccagactcagtttctcctttctgcccctgcctggctgcctctccaggccgcgtcggtggcccctggttccgtcctgcacagccacctcaccagctgtctttctttttgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccaggtaacccccactgtgccgtcgctgggggactggagcagctgggatggggtggggtgggggtggccactgggacagggacggagctgtggccggaagaggagagcccccaccccagctgtggtcagcccgggcctccagcgcaggcctcctgggttcttggctgctcagccctggcctccggcgcaggcctcccgggttcttggccggcctggctggggtggcattcactttcttggctctctggctcctgcgcccccaggaagggtagccctgggcttccatggtttctctgagaccccgaggcccagcccaggagggccctctttgaacgactttgtaactagacatccaccccagccgtgaccccgtgacccagagacacccccaggcctgtgccaagccctgtggtgaagtggggctcccggcctctgaccggccggtcgggtaagtggggaccgagtccaggcccagccacacgcctcgtggccccatgcagaatgaaagctggggtccttgttgaaaacgatgaacgatccaaagctggcggcagcagggtgttgatcccagcagggttctcctgtggtagctgcacacccgctgggaccaggggctcagggcggccctgcaggtcagcacctttaacaaagggtgcagcaacccacgcctgtgagactccactttggagcacgtggtgggagtcccccagcggtgaacgcacgtggccgcctccacctgagtctccgggaagtccctccagtgggccttcatttcttggggttgggggggtggacagatccctaaacccatgtggggtctgtgtccaaagcccctgcatttctgggaacctttggctgggaacagccacgtgggtgacctcagctggcactgtctcacaagtccctgaattctagcattcaagctggcctgcagctggacgcccctgccctggcgggccgcaggggacagaaggttaattattgcccagacaagggctgtttgtttgaagttgttctaagtcctggtgtctgggggttctgaaagctgacttttcacctttggcaggaacttttaaccctcagagctcaggagccgctaggacgttgacaccaaactgggcctctttgttttcctcttgatcacaaacatgattaccgggaaagaagtcagagtcaccccctccagtgagaggcaatttgttgtgtgagtccccagccgtttcttggtggaataaagtggcccacaagtgccgtacatctttaacactgttaggaaaagcggctgagtgccgagagctcggtacgtgggtgcacagctgtgccccgatggtgctagggagagccgggccaccgccctgcggtgagggcctcctcatcagcgaagtcccgtgtgtaggaagagggggtctgggtgtttaattttgcatttcttggactgtgaagatagactttcattttgtcacttgtttattgtctgtttgtatttcttcctttgtgactgaccggtttatgttctttgtggttttcaatgggcccaactctcagtgatttatacaaactccttatctttaaaagaaacttctctttggttttgcatgctgcagattttatttctaccatgtcatttgcctttttaccttgtctttttttttttttttttttttgactattgggattggatgtgtggtttttttgtgggttttttttttgtttttttttttttagatggaatctcgctctgttgctcaggctggagtgcaatggggtgatctcggctcactgcaacctctgcctcccaggttcatgcgattcttctgcctcagcctcccaagtagctgggattacaggcacctgccaccatgcctagctaatttttgtatttttagtagagacggggtttcaccatattggtcaggctggtctcgaactcccgacctcaggtgatccacccgcctaagcctctcaaagtgctgggattacaggcgtgagccactgcacccagctgggatttgatgtgtttatgtggttaaatctggcctggagaagacaccatgacttacaacagcccagtgaaaccttggaaggtcagagagctggaacaggagggagctagagggccctgggtctggccctgggctggggccctgctgggcgtgggtggcgtgcagcaggccgtgtgctgctgggcgtgggtggcgcgctacaggcttcgtgctgctgggcctgggtggcgtgctacgggcttgtgctgctgggtgtgggtggcgcgctacgggccttgtgctgctgggcctgggtggcgcgctacgggccgtgtgctgctgggcctgggtggcgcactacgggccttgtgctgctgggcgtgggtggcgtgcagcaggccgtgtgctgctgggcgtgggtggcgcgctatgggccgtgtgctgagggctgtgttggttgatctctgtgtcaggtccctgcaggcctcaggtgtcaggaactttctctttgggtcttagatgagattccagctggggagaggagaagcatgcttgtgtggtagaaaagaagacagacttgttcagcacaagattttctcagacttctgaattgagatacttgggaaagaaacattcaagttgtgtgactcataatttttggcagaaacaagcacagagctttgggagcagggaggaaaccgaggcttcctcctcctcagcctctccacaagactgcatcgaccctggcgctgccacagatggtgcctgggacccccggccgcagctgggtccaacagagccctccggagcattggttgtgttcctcgtcctaagagtccttgggcgttgttggtcttttcaggttcactttcttgagtcaggtttgtcagtggtcgtctcccgggaaatcatgcacccctcccagctgctgccgttgccttgaacgtcatttccagctgtgtcctgatttccagctgtgtcctgatttccagctgtgtcctgatttccagggcgctgaggctgcagcgtgtcgggaagcattttacatgctcttccctcacagaattcctgtgagctctgtttcaggtgtctccggatttcataactttcagtccgaagtcccttaaatatttacaatgggcctgtggcttttgcactagcgcctcctgccccacccccggagccagcggccaccacgggctcagagcttctctgccctctgtagtcgccccccacccaggcaccctgtagccccgtgcaggaggcgtcggcccctcgggggcactctcaggagagcgctgtggccacctgtgggggggtcagggcctcacgggcctctctggacagtgcatgtctgtgtggggatcgggtgtcaggaatgcccagtccctccccgacaccaagaccacccaagatgcaccccccgcccgggctgccccagtggagaagcgcagttttttttttttgttttttttttgagacggagtctcgctctgtcgcccaggctggagtgcagtggcacgattgcggctcactgcaagctctgcctcccgggttcacgccattctcctgcctcagcctcccaagtagctgggactacaggcgcccgccaccaggccaggctgattttttgtattattagtagagacggggtttccccatggtctcaatctcctgaccttgtgatccacccgcctcggccttccaaagtgctgggattacaggcgtgagccactgcgcccggccgaagcgcagttttctagaattcaaccccagctcctccctgggcctgacctgggggctcctgaatgtgaaggctcagctgctgggctgctgccccacccccacgcagtaggtcctggtggacagtggaccctggaccccacggtgctgcccctggccgacctgggggcactgtaggcaacgccctcccccgcagtgtgacgctgagagccgctggtgcgctctgtgaggctgagaaccgctggtgcgttttgtgggaaacctgtgggaaacccagggggcccacagggtccacacccccccacgcatgagctcacacgcgtgcatacgtgatctcatgtttgcacacatgtgtccatgcagatgcatgctctcacgcacatgtgcccacacactcagcactcacaccccgtcctgcaggctcagccccactcctgagccacctgcctgggctttgggggcccagccggcatggggagccccaggctccagctggcctcgcttggctctgaaatctaggccaggatgcagaacccgcagtgcggccagtggagcccctggtactgtgcgcagcccccacctggcagccccttttcctgtcaaagcccctcccagcgtcctctccccaccaggcaagctacccgcttgaggcttaggacgttgcgccctcctgtgtccttgcccagcatccccggcctgcatctcaccaggcaccgccggccgcgccagggcccgagagggcagggtcaggcaccctggcactcagcccaggactgaagatgccagagggagcggtgggtaggtgggtgagtgagtgagattgggtccggacggaatgggcgcagagatccaggaaactcccctacatctgcggcgtttctgtccttggcttctgggttttgtttttgatgaaaaggtgaagttcaaagaaagcaaagccatggtgccacctcggttggtccgagtcgggagatgaggccgcctggtgcttgcgtaaagctcccgggacttggggttgggggacttgacctgcagcccctcgaatctgcccgccctcccaggccttggatcgagccacacctgctgtggttctaaacccgtagccctcaggtggcccatcagctgcctcagatgagccaagtctgagggagcagcctccgcccagccgggtgctttccacatgaaagcgcccaggacgcccctgggtctcaccacttcttcctaccatgaggcataccgcacccccagggaggctgcccgagaccccttccctctccgagactctcctgccctttgtgggccccccgaaatctggagctcaagcagcaccggggttgccactgccacctcaggaccgctggtgacccctttctctgtctgcatttagggggtgatcgctgagctgaaggtgcgcagggacccccaggtgagccccatgcactgcctggacgaggaaggcgatgactcagatggggtgagtgacatctggggcacgggtggggtctcccctcaatccctggcacgcggagttcagggccaaggtctatgacaggaaaagtcccaaaatataccacttggggcactgggaagctgcgataccatttctgtgctctcctgtagcacctcagagcccttccttgccctgaactttcccataaaaacaaatacaaagcatgatataaacaccagaaaccaccctccatggcagctggtgagacagaggatgtgaggcagctcagcaaagtgtgtgtgtgtgtctgtgtctgtgtggtgtgtctctgtgtcttgtgtggtgtgtctctgtggtgtgtctgtcttgtgtgttgtgtgtggatgtgtgtgtgtctgtgtggtgtgtctgtcttgtgtgttgtgtgtgttgtatgtgtgtctctggtgtgtctgtcttgtgtgtcgtgtgtgtctgtggtgtgtctctgtgtgtagtgtgtctctgtgtgtggtgtgtctctgtgtgtgtggtgtgtctctgtggtgtgtctgtcttgtgtgttgtgtctgcatgtctgcatggtgcgtgtgtctctgtgtctgtgtctgtgtgttgtgtggcgtgtgtgttggtggggtgtgtggaatcacgtggtacccaaggggagaatcccccagccccaggtgtgaggaacagcagggaattctcactcaggggcccagatcacaacatgccccacgtgaacatggacccacagcctcgctcctgggggcgtgggcaggagacgccgtggacgtggacccacagcctcgctcctgggggcgtgggcaggagacgccgtggacgtggacccacagcctcgctcctgggggcgtgggcaggagacgccgtggacgtggacccacagcctcgctcctgggggcgtgggcaggagacgccgtggacgtggacccacagcctcgctcctgggggcgtgggcaggagacgccgtggacgtggacccacagcctcgctcctgggggcgtgggcaggagacaccgtggctggactgtgggcagtgtgtgaacatccatgttactttcatgctttttctttattttgcccaataagcccgttgtttttgcctggaacatgccagaagacgccagatcgttcacatggcggccatgacaaggctgcgccctgggacagcttgctgggtgcggggggtcgccgaggcgccgcacccctcccctggcctgtcttgccctcaggggtcagtagcggtccctgaggatgtttctcctccgggttttcctgaagtttaaaacatccagccgccttggcgcgtgttcggcccagccgggcgtgcgctggggaaacctgtgcggggagcatctgcggtgcggcctcctccagggcagggctctggccagaagagaggagcgcgttccccctcccgcctccgcatgtctgaccaccggccgaggcaggttcagaagcgtcactgtcctcgacccgattggacacgacttactgaagctcagatggtgcctgggcagggaaggccagcgtgcccaccccagcggccccccggagagcaccagagagggctggacgaggcgagagggggcctggaggaggcgagagcagcgtcctttgcttcccaggcctgccgggctcggggcctggcctggctgccatctctccagcctttcccttttcaaactcctcaggcatccggagactctggcagcgggctcggggacgcccgggagcttctcagggaggagacggtgagtagccggacggggcccagcccacgctgcagggtcccgggagagcccctcccagcagtggggtgacacatgtgcacacgcaggtgtggctccaagagctccctctatgccacgaagacatattcctggctggggacagggatgctgggctgggcagacgctcggagcctgggcacaggccccgctccggccctgcctggccgccgcgtgtctctggtgagaggatattcctttaaaacgaggtcctgccctgcacactccttggtcttcgaggcaaccttggccttcccttcgccccatccctccgttagctcgtgcgtggccatcagggaatgaacgcgtgtgtgagcctgacgaccaggaggagaaggcggcgcagggagcgcgcggaaggctttccccagctcgggccacctgagaaaacacaggaggggcggggagtggggaggccccagccgcgggactgaggcgcggtgctgtccgtgagagacgggtgcgggaacgtgttccctgcggggaccctctgcagattcacatcagcttcccagcatggcctgtcgggcgccgggaggcctctgtggtgacggcaggcgcggtcctgggtcctggggagccggggagcccacaggcggccacacccctgcggcccacggaaggaagcccctcgcgcacggccctggagcaccctcctgtttcagaggatttttctttatctttcttgcgatcttaagtatttcatttcacaaaccaagcaagtctccaccgggcatctgccggccgaataacaggccacctcccctctcgtcctccagggcgcggccctaaaacccaggctccccgcgccaccccccgtcaccacgccacccttggctggaggcagcagcacggaagattccagaagtgaagaagtcgaggagcagaccacggtggcttcgttaggaggtaagctcttttctggatgtggtgtgtgtgtggtgtggggtgtgtgtggtgtgtaacgtgtgtttgtgtgatggtgaggtatgtgtgtgatgtatggtgtgtgtagtgtgtggtgtatatggtacatgtgtgtgtgatatggcacgtgtttgtgtgaaatatatggcaggtgtttgatgtgtggtgtgtgatgtgcatgtttgtgacatgtgtgatgtttatgtgatgtgtatgtagtgtgtatggtgcatgcatgtgggcatgtgtgtgtgcagtgtgtggtgtgtgtattgtgtgtggtgtggtgtgtgtgttgcgtgtagtgtacgtgtgtggtgtgcagtgcatgttgtgttgtatgtgatgtgtagtgtgcgtattgtgtgtatgtgtgtgatgtgcatgtgtaatgtacatgtgtgtgatgtgtattatgtgttttgtgtgtgtgtgtgtgtgtgtgtgtgtgtggcaggtggggagatgccgaggcccggatggtggctctgggtacaggctctgggtgttcactgtgcttctcttgcaggatttctgttggttttcatttttattttaagtaaaagttaagagggaaaaaggaaaagggacaaagcatgctgggtgataagaaggcattctggggggccagggtctcttgtaacaaattcaggaagcatctcccagacttcagctgtcattggcttagatggccacaccggcctcactgttgattttaaattctgtctccctgttgcctttgcctgggagctggagctcaggggagtgcggcctgaggctggggatctgacagtgtccagccgggctccaggactgaaagcgtttgggctgccggggccgtctggggtgccgagagcagagctggggccacccggggggcgtgaccgtggccacctctgcttctcttcccagctcagacacttcctggctcagattctgtctccacgtgggacgggagtgtccggacccctgggggccgcgtgaaagaggtaaggccacctccctgtgctcctgaaccattctgaaccagagcacctgtggccttttgggccactcactggtgagccctgatgaagcccctctgtgcccgtgcctcctttgtgcccagcactcggtgccagcatgcgtccaccctgcgtgtccactgtgggaagcagcccagcctgggactctggagggcgcagcgggacacgtgggcagggtgtgtggggccccaccccagcccgagccctgtgttctgtttattcccagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccggtgagtcctcacgtccccccgagtccggcccggtctggagggtgggggcttgggtaggagggggagaggctgcggccgacatgggagtgagctgagctgggatcggggcaggtcagcagcctccttaggcccaccgttgctcggggttggtgctggaaggtggtcagacgtgggaggcggagctgctcagacacagcccttgtgggtgtgaggaggctcctggcgcgggtgcgaggacatcgggggaaggcgtctgccgcctcgtggggacttggagcgtggggtgcatttccatgtagacactgtaggtggcgccggaggagtcatttcccatcactaatggcttctcttgcacacccagggcgaccccggtgaagacggaaagccggtgagtctgcttttctttctgacccctgtgttatctgtgatgtttgcttagaccccagggctttgttgccagtgacactctttttaaacgcgacccagtgaggagactgtacagcaaaaccattttgaaagtggaattttgtaaagaaaagatgagtgtaactgttgatgggaaatagcagttatgcatttgtgttgagacatttgggccacaactaccatgaagaaggaaaggaagtgagaaaaggcagagcttccaaacccttagagggaagacgcacagcaaagaaaaaggaagtcgggcggggcagggggtggtgcaagtcggcgggggagggaagcacggggcgacctgagactctgtgaagtccgagcttcgtcgcaaaacacgcagttcagtctttaaaaatcagcaaacaccgtttccaagcacagtaatgacgtgatcgactgcgaataaagacctgggaacagcctgcccagcaaatggtaacactcggcagaaagtggggccgtcacgaacgctggacaggagggttcaagttaaaaacagtctagaaggtctgaaaggacagggagggcatctcatggtgcccaccgaacggtcattaccgaccgcctggcaccccacagccaagctgcctgcgatgaggaccacggcagacaaaggacagtcggctggggggcggcacggggcccacccactgcaacagggtacacgcacgcgtgtgagtgtggggtgatgatccacggggcccacccacagggcacacacacgtgtgtatgtatgtgcatgtgtttgagtgtgtgaatgtgtgactgcgcgtgtgtgtgggggggtgaggatccacacgtacacataccacacatgcacacacagcacatatcacacaccacacattacacaccacacgtggacacatgcacacacattacacacatgtgtgcacacaccacacattacaccacacgtggatacacttgcatacacacactacacacacgtgtgtgcacacacaccacaggtggacgcatgcacacatgctacacgcacgtgcacacatcacacgtggacacatgcacacacaccacacattacacataccacacgtggatacacacatacacataccacgtgtgcacacatgtgcacaccatggattatgcacaccatacatgcacactcacacatcacacatacatatcacacatgtacacaccacactcctcacacacacaccatgcataccacacacacacacacatgtatgtaacacccaagcaccagctgttgtggaggccttcggggaacctgctgtgacctcccgagggatgctgcccgcagcttcccccaggcgtggctggcgaaatgggctcaggcgggagacagtctgctgggcctggcgccctcgtactttccgggccccagagactcccctgaagggctcagctcccgtccgtcccctgcttgggggaggagcactgagagtgctgggtgcggcccatggtggtgccttccctgaccgggcccccggatgttgtgttccagggcgacaccgggccacaaggcttccccgggactccaggggacgtaggtcccaagggcgacaaggtgagtctccgtggctgggtggggccccttcctgtgttggcccttggctcaaggtgggggctgtgtgcgtgcccagggtatgataggcttgtcttgtgttcccagggagaccctggggttggagagagagggcccccaggaccccaagggcctccagggcccccaggaccctccttcagacacgacaagctggtaagtcccgcccttggcttcctgcgacccggggtctgccctcctcaaaagcaggcactgcctctggcccagaagtatcagctccaccctcaggggcttgcgtggggtcttggctgagctgaggggtcacaggtgtggtgggagcccccatccacctgccttcaggcttctctgggggcagcagaggggccgtggtttctcagctccttgtagaaacagctcgatatgcagcttgcggggcaggggccaggagtaggccaggcggggggccgagctcagggcaacgtgtctctccggctcttttcctcagaccttcattgacatggagggatctggcttcgggggcgatctggaggccctgcgggtgagtggcccttaaactgcagcgctgcccgatgtctgtgcccatgaggaacaggccatggacccccaagattcagctggggtcctgtggggggtggggatgaggcccgttctgggggtggtggtcatccctggtgggtgccacatgggctgtgactatctgtgttcgcccacgtccagggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccggtaagtcctgcctccaccgtcagtgtcgggagccctgtctgctgggagtgaggggtgaacaccccacatgggagcccctgccccgcctcaggcctccccagtccccgcctcctcacctcatctcctctaggagctggcgggcagttgctgactcggggccaccctggggtgtgcggaagcacctgagtggccaccccatggttctaggggtgctgaccagtgggggtgaccgcaagcaaggcctccgacctctctggccctgtgggtccacggactgcacagagagcgtctccatgagcaattcccatgggtgggtgtgggagggccgaggtcagcattgctggagggccaggggagggaggagcctgcttggccaacgcggctcgtagggtctcaggtccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctggggtcactcggtagcatgccatgacgtgcagggcagggagtgtggggttaggtcacccatgacatgcccctgcctccgtaacagtccctacctgagccagccaaccctaccgatgggcattcaccgtcaccatcggctctgaggcctctctgggtgccgcatggcaagtgctccccaggatccattctgaggggaatttgggcttaaagaacatgcctaatccatattcacgcatgtggccagactgcctctcagagggagcagcggctaccccagccctggtgtgcaagcatcttcccgccgtggtgctgtcggctctgccatctcatcctgccaatgtggccgcgaaactgcgggctacgcaggctgtggggtctcccgtgagccctgggactctggccctgtgtctggggaacgttctgtgtcctgccttctggaaacctgcggaagcccagataacctgttaacccagaaatcgttttagtggccgaatgccatcaagacccactatgctctgctctcccccagggacccccaggccctccgggaagagaggggcccccaggaaggactgggcagaaaggcagcctggtaagtcttccctcgagtccagggtgagtgggaaccagcaccacaccatgtggcccgggtccgggggtgcctggtgacgcccgtgaaggggaaatgccaggaatagccccccatcacagccccacagcctggggcctcgcgctctggaggtcaccctgacctgggcggctggggcttgggtagaaattcataaccctgtgatgatgagtggactcacgggttttaagaacatgggcaccctgcgagatctgagatcttactccaagcttccacgttggttacggggcagtggccatgagcctctgtcggactgacgcaaggagccggggccccaggcgtttgtgggtggacctggcgggagtcgcctgcgtctggccccctggggagcggtctccagcatgacctcagatgagagctgcactgctttggactgagcaggggacgcgggctgtaaatgcccctcactgctctaagcctgtggctgagctgaagggcccttcttggggaggcatccaggccccaggccccacgtgtagccaggtccagcattgggaccaggcttggcgtcccttgtggcttccctttcaggaccccaaccacaccagaaaggggggatgacagcggcaacagcctcagaaactattaaaccggcacaggcagcaaagcagggacccgggtcggggcacagttcctggcagggcgatgtgccttcctctgtccactgtgctgcaagtctgattttgtcataatcctgctcttttccgtacagggtgaagcaggcgccccaggacataaggtacaagcagaatccctggcacatcagtcccctgcccctggtgcccactcagtgctcggacccccaaagagggtggcagccccacggtcgagagagtgagctctcttggggctggccttgacccccactcctgccatctgtccatccgtcctgccggaatcgcgggcagcagcctctgtcactctggcgaggtggcttcggcccttgtcacttttgtgatgtggcttccgccgagctctggtctgccggtgaactgagagtagacgcgccctggaagctgagctcatctggaaacaagctccgtgtggcaagcgcgataaagcagctccaggagctttgggaggaggggctgggccacagcaggtggagaggctgcccgtggcctggggagggccctgagctgggccccccaacatccccccataggggagccccatccacccgtcccgcaggctcatgagcatctgggggcactcggaaggagcgctgaaggcagcccgggtgtccttggcggccctggcctggcccagagtctgctcagaccctctggactcggggcagctgctctccatggacccagccttccttcgggcagcctgaggtctgggccacagcctgcttgaccagacaatttatctgacacccccccaacgacccacttcctccttctgttctgcggaaattgagctggaggaggagctagaaccctgcagaggaggggctgggagccgggtctgggcctccagtcggcatctgtgccgaccccaccacagacgcccccggaggtgccctcgaggatccaggcttccgtgggccgcccactcgaatcatgtccaaaacgtcaggagctcctcaccttggctggacggggttggcactaacggggaactttccccagaacatggccaagctccaggatgggggtgatgagggaaggaaggccagtggggagaggagtgaggaagaggacagctgcgagtcaggtggtgagagcacttggagaggctgagaggacatgggctgggagtgaatgcatgtgcacatacacacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcacctctccagcatatgtgcacatacacatagccagcacatgtgcacacagctctcatgtatgtgcacgtgtatctctagcatacatgcacacatgtatctggtgtatatgtgcaacacatgtatctggggcatgtgcacacgcatctcttatgtgcacatacacacacatgtatctaggtatgtgcccacgtttttctagcacacatgcacacacatctctctagcatatgtacacacacatgtatttgtagtgtgtgtgcacatctgtgtctctagtatgtgtgcatacacgtacacatgtaggctttgagttaagcaggggaggaatattttgatcaactttaaaatcagcaaaattagatatgcatgtatgaaaataatgaaagttttaaaaaaacaaaaatgtcaagtaacatgaatgagaattctagaaccctacaacctaattgtaaaccaaatagaaaatgaagaaaaaagggatgaaattagaaagaggttttcaacaaacctttttttggagacagagtctccgcagtggtgcagtctcagctcactgcaatctctgcctcccggtttcaagtgagtctcctgcctcagcctcccgagtaactgggactacaggcatctgccaccacacctggctaatttttttttttttttttttttttttttttttagtagaggcagggtttcgtcatgatggccaggctggtctcgaactcctgccctcaggtgatccacctgcctcggcctcccaaagtgctgggattacaggcgtgagccaccacactcggcctaaacaaacttttttataggcactttttaaagatcaaaaattagatgaggctggacacgatggctcacacctgtaatcccagcactttgggaggctgaggtgggaggattatttgagtccaggagttcaaggctatagtaagctacaatcatgccactgtgctctagcctgggcaacagagcgagaccctgtgtccaaaaagaaaaaaaaattagatttttaaagacgataaaaggatgccaggcactaagacagattaaagccaagaaagtaaaatctaagattctcatgaagttagccctcaagttaagtgggtggtacatggtgcccacctgttaagacccagcgtagctgttggagggtggctgcagtggagacccagacctagaagggaggagacaggaggcagtcgaggatcaccttggcgggtggagggcggggaaagctctggcttggaggcccagcccctgtgggggacatgggaagcaggaaggacccttccccacagagggggtttccttcctccagctgggcctgtgaccatatcaaggcagcgggtcacattcctgccccatttgtggacagtgctgggctcacactatctcattccgctctgtcccgagcctgggaaggaaccctgggcctctccgtctacagccacggaaaccgaggctcagggagcttgtggctgcgaggagaggggtggttcagctgggccacgtcacagcgggacccctgcctcagggcctccctccctcacgccccccacaccgggctctcacctcacactccaggtggctggggccttgggtcaccgatggctccagcacatgcctccgggctcgcctgcttctcacggctttcggactaatagagtcaccgcaatgcctgtgtctaccctagccccagtggtcccagggtcctgagcctcctctcctctctcctctcttctccccttgcctgccggggagccagggctggtcccagggtcctgagcctcctctcctctctcctctcttctcccctcgcctgccggggagccagggctggtcccagggtcctgagcctcctctcctctctcctctcttctcccctcgcctgcccgggagccagggctggtcccagggtcctgagcctcctctcctctctcctctcttttcccctcgcctgcccgggagccagggctggtcccagggtcctgagcctcctctcctctctcctctcttctccccttgcctgcccgggagccagggctggaggtaacgagggtgccctgtgcacctcccgctgtgcatgtgggcctccccctgtgcatgtgggcccaaccccgaccaagttcgggctccgtggctctctcctcagttgtgtttctgtgtggctgaaatcgtgtcgtaaagttagaagaaaggctgctgtggggcctgcgttgcttggcagaatgttccttaccttttgatttgcagggtttagaaagcatcataagaaaacgtgtctacgctggggttgcagggccagcgggggctgggctgggtcctgacacgctctcctcaccccacgcaggggagcaagggagcccccggtcctgctggtgctcgtggggagagcggcctggcaggagcccccggacctgctggaccaccaggcccccctgggccccctgggcccccaggaccaggactccccgctggatttgtgagtaccgcctacacctgaccccctggagagccgggggctgccgttgccccagccctactacccctggcatctcactcacagagcagcacgtcctgggcggtggccttgctggcactgcctcatcctgggattccatattccgcatggtggggctcgagtctctcgcccgtcgcccgtgccccacggtgctgatggggatcttggcccagccatgccccagcacccgtgccctgaccaagagcgaatgagctgacccgagacgggctgccccgggggggctccacccaggccctgccaccaggtagacagtccccatctgagaacggcggctccccaggccaccgtggccccaaagcatgtcccaccctcctctcgggcagtgccaccccagggaggggtccttccctaagaagggacacaggcccctacgtgtctcgtgtgtctcttccaggatgacatggaaggctccggggggcccttctggtcaacagcccgaagcgctgatgggccacaggtagtgttgtgagctgggcgtggccggctctgaggggtaagggggtgttgcctggggcaggagagtgtccctgagagccaccggccttgcatgggatcggaagccgccctgcagagccgtgaggaccacgtgtggcgggcgctgtgccccgcgggccacccttgttcttcggagatgccccttcattgaactaaagtcacggggtgagggcctggtctgcaaagtgggagacactgtgagtggtcaagacaaaggaacacggggccgcatgccccctgaaaggcctttctggggaaattcaagtcatcacattctttttgtggccccaatttttggtagtaacaaatgtttggcctgagtagaatctgaaattcctatgaaatctccactttcttctactgttaacatgtatactgctcagggttagagccagcaaggagtgaccaaaatcccaaaacaactgtgctcagacagctcagacgtgccaggggcagacccaggggccacaagctccttcctcccctgcccccactgtcccctccacaccaccagcgctctcgtggcgccagcatggaggagcccccggggccacagccctgcccaagagacacgtggggtggctgaagccacagcgtccagcttcatgctcagagactcagcctgttgagagcacgggtggctgggacacatttcttacttggagcaaaacgaatgagaaatttcaattaggcagaaactaattgattccatagtaagttagaatggctttaccattttaacttagtacatttccttttacacacgtattttgaagtcttgactgttactagcgggcttttcttgcggcagacgcatctcacagcagggcctccagctgcactaacactgtgtctcctctgccctgacagggacctcccggcctgccgggacttaaggtcagtgacggatatgtctgggtttctgtggttgctggcttggccctgtctcgacatcttggggctgggggagacagggccttgcctcgggttttctgatggcaggagtaggatgaattcatcctgggaagtttgcaaaatacagcaaaaaagcctgacagggaaataatcgcacaccaaccccaacctagacttccagcgttaaggggccattgtcccgttctctctccgaagcccaggaatcaagattcctgggttcacacacctgaagcatattctcagacttgggccgaaaagaggggcataggggaagaactcagggtccccacctcagcctcagggacaggtggactcctgggctcagggacagagccgtggtgaccttgtaggacccaggagctttgtcctctgctccccccatccctgggggacactagcccccagcctggccccgaagaccccaccccacccaggccccgaagctcccagggcaggtgcctgagcagggagcctggagcctcctctcctaggccctgggcagcagccgcctttcaccccgctgcgtgctcatcaaagcgtcctctgctgcgtgcggggccaagggcgcacggggcccaccctggggctgcactctcacgcgtcaccagcccctgccatggcacctgctcctttgagctttgctttcatttgcaagacatcgggacactcaaaaggctgacttatgggaagggccgtgtgtttgctttcttaaattgtttgaatgaggccgtctcagcggggttcctcttgcagtctgcagtcctagtgatggaatatgtccccaggttccgcagccgtcccggccgggtgccttcagccagcctgggcccacggggtccctgcacaagttgctcagtgtccctgggacccctcggctctgggctgggggagggcggtgagatgcatcctgggtaactcacccttcccttcacccggggtggacgctgcctgaggactgggctggccccagcaggtgctcacggagccccttttttcacttagggggatcctggcgtgcctgggctgccgggggcgaaggtaagcgctgtgcccgggttcagggacgtggccaggcagaggcagggagggcccagccggacacctgcggagatcagctcggggcggccttccccgctcttcctgccactgctttgtttctttataattgaagacgtgctggtttcaaaggcaacccccaggatacccacctgcagggcacccaaccccagggcacccccaggtttgactgcgtcaggaacatggccttcctccctcccggctgtctggctgtgcaggccccgtcggcccctgccaccggcctcccgcctctccctccttttccccgacttccccctcccccacactgcctcccccacttgcccctcccccacacctcctccccgacttccccctcccccacttccacctgccccacacctcctccccgacttccccctcccccacttccccctgccccacacctcctcccccacaccctcccccacttccccgtcccccacacctcctcccccacaccctcccccacttccccgtcccccacacctcctcccccactccccccgactcccccctccccccgactcccccctccccctgactcccccctcccccactcctccatccctccacagcccctgctcaggcccacaggggtgagagagagaagtccaggccatcgccacgtccacgggtgccccggactcctcgtgggggtccctgcattcctgggcgtgtggccaatgccctgcgtcctccatgtgaccctttcagggagaagttggagcagatggagtccccgggttccccggcctccctggcagagagggcattgctgggccccaggtgagttgccttggtgggcccagggtgcagggggggcgtggagccctgaagggactatgctaagatgaaagctggcacgagatgtgccctcccgggtccctgggtctccatgtgccctcgtgggtccctgggcctccgtgtgccctcccgggtctctgggcctccgtgtgcccactcccgggtctctgggcctccgtgtgccctcctgggtctccgtgtgccctctcaggtccctgggcctccgtgtgccctcccgggtccctgggccttcgtgtgccctcccaggtctctgggcctccgtgtgcccactcccgggtctctgagcgccaggagttaagtataagtctccgtcagggctcttggtggctgcctccctcccaggccccagccggtcgggaaataaagaaccccacatcttcatcagagccatccctcacggggggccaggggctcctgtttctgttggtgatgaaccatttccttcctgtctctccaggggccaaagggagacagaggcagccggggagaaaaggtgagtgtccctggggcgggtggatggggatggggggcgctgggacatcccagaaggtttggcctcagctgccccaggtccgtgcccctgctgcccatgtgacctcagagactcagggcaaagaccctcaagttgacaggggtggctttcaggctgggggcagcgtgtgtggctcaaccgtccctgttggagcctgccctgcctggcagggggctccaaggccacagtccacagccccgggcgcctcctcacccaccgtgggctctgggcaccccctccagggctgggtggactctggggtcctggccagagcggttgagatgaaatgccggacgcgtggcctcctcttccagggagatccagggaaggacggagtcgggcagccgggcctccctggcccccccggacccccgggacctgtggtctacgtgtcggagcaggacgtaaggacgctgcgtgggtgggcacccaatctgtccagaccccccacggggtgcagagatccctccccgagccccccccacacccccacatcccccaggtcaggacaggccctgactgccagtctacactccacctcctcggtgggggctgcagacgccctcggtcagagacgcctggggagcccagctccatgtggtgttggagacaccgaggagaggggagggcctgcacaggggccagtgtttttacgtcaaaggctcccattgggctcactccctgtgtccttgacactgtggccccaaagctgcatgtagtcacccagctgccccgtcagaagaagcagatgcacccttggcccctctggtgaaggttgtgttggttccggaaccttcctcccccactgcggcccgtccatcaggcctctcagctgcaccctctgcgcctgccagcagtgcatcccactggtccctgtgccaccctggcctcacagaggcagacgcatctccgcccagccacatggaacacagggaccaagccccactctgggcagggagctgagccctgggcagatgcagggcccagggcagcagagctgggtgtggccaggggttcagatccctgcagagttctctgtggccaccagtggaaggggggctgcccggggcagagctgagagcaggcaccgtcagctgtgtgacactggacaagttacctaacccttgtgctccagctccccacctaggaggtgggactctaacagtcttgagaggaggggtggagttgggaacaggcaggagagggcttgccccagcacggctttgctaggagcaggcagacaggcatcgggaggcaggggcagcccgagaggccacagggacctcggcgtgacggtcaagacatcagaacatcagaaaagcctcccgtaggccgagccacctccgccggcaagcaagggagcgtctagcagaggcaggagcattttaaaacaaaatggaagtaaaaaccatggcccttagggcgtctggagtctgcatccagctgctctgagctgaggggcgtctgtgctgcaggagggatgccccaggcccaggaagactggaaagcaacattttccttgaatttcctggtttggtgttttgttgatctgtaagtcgctcgagtccagttgaattttaaacgcggctctttgtttccgatttttccttttgctcgtggacagggatccgtcctgagcgtgccgggacctgaggtatgtgcctgcccagcttctaagagacgggcctgcggggacctgggtacaaggctgggtggggtccgggcaggcgcgagggtgcgtgatgaccccagctgacgccgtccctctttccccagggccggccgggtttcgcaggctttcccgtgagtaacctggtgccagagctgcatgctgcccggctggggaggggtctccacctggtagcacagagcagcccggtcgagctggggtgggccttgtcaggcccgagggatagcgacagtcactgcccccaaggaaatgatgggagtgggatgtgggcgagagccgctggcaggccctgtgctgggtgggcacccgtgagggtgaggcagctccttgcacctgcagaggcctgcagtgtccagagtgaggctggggccgggaggtgtcctggtgggggtcacctgcggaggcctgcagtgtccagagtgaggctggggccgcgaggggccctggtcgggctgtcgaggcaggcatattgcggggggcagctgtcgggggagatggagcagccgtcggggatgggggagatgccagccgctcgggcctcacggcctggcctccattccagggacctgcaggacccaagggcaacctgggctctaagggcgaacgaggctccccgggacccaaggtaaggggctcaggtgctgtccctcaaccccctttgtgacccaggggtggctccagcctgcccagatgaccactgttgggagggacctgggaccccccggctgctgctgtgacacgtgaggggtacatccctgctcgggccgtccctgtggtcacctcccgtgaaaggacccagcctgcgaggcccagtcacagcggccctgccttcggggctctgggtgaggctttgtggggaaggagctggccctgactctgctggacctcctgccattccagggtgagaagggtgaaccgggcagcatcttcagccccgacggcggtgccctgggccctgcccagaaaggagccaaggtgagggccgggcagcctccttccggcaggcgtgggggctcctggggctgtggagacagcctggggagggtcttcctgagggtctggctcctgatgcacgagcctctcccaagcagggctctaccatccaggcctggccctggtggcccctcctttctcgcacccatgtcggcggttccgccggcccctcgtcctctccctgcccctcgtcctctccctacccctgagcccaccctgctgaggggaggttctcagtgggctgcagctctgagctcgcgcctccctggggcctggcctgtggggtgcaggagcccaggctgtaccagctcagcctcagcaggtttctggctgcccctccagcctcttcctgggggccctgatgctgtgggcagggcccggagtcagttcctcaaggggcctgtgcctgcgtccccacccccagcaggcagccgcccagaaaagccctcggggagggtcctggggagaagcctggatctttggagtgtgggccaccggctctcccactttcagagggagcagtgagccctccggggtgtttggggtgggcctcagacacaggatccccaggcccagtgagagctccactatcccacccagctgtgcattggagctggggcctgtggcaaccaggacactgcgtggcacatgccctccaccctccaccctccacccctgcttcagggtcccggggcatgcatgcacgcaccaacctggacgcaaaccccaaacccgaccctcccctcaccagtggctcctgtcctccccagggctgcctgcgccttggggacggcccagtgcacccaaagggaccacagcggcccttagggaggctatcaggtggggcacaagccgccacctaaccgtgccttcgccacaggggccctcagagaggctgccaggtggggcacaagctgccacctaaccctgtcttcttgtttttttgctcagggagagccgggcttccgaggacccccggtaagtcggtccctggctttctctgcactgagctcgggcatgacggcccccaaggacacggtcgcccgcggctgctgagcttgtgctgtgcggcccagggctcatctccctagtgcagttttaaagcgtgtggggcaggtgtcggcgtgaggctgcagtgggctcctccgagctgatgggtggcccagggtgctgtgctctgcatggcccctccccttccccaggaccccccaactcgtggtcaagggccagggtctgccccactaagcctggcccccttcctcttgcagggtccatacggacggccggggtacaagggagagattggctttcctggacggccggtgaggacctggggtctccagtgggggcggcagatggggtctggcaggtggggagcagcccaggcccacgggggtgacatgcccagaggggagtggacggccgccgcacccactgtcctcccccaagaaccggccctgcctgagcgcagctcttgtcctggatgtggctggcagtaccccacgaggggccagtacccaggaggaagccctggaggcagacagggcagtgggcctgtgtgtgctaggctcagtcacctcctcccaaaagggtccttgtgcaggaaaggggtgagaagggccggggtagcctgagagctgggaacgtgtgaggctgagcgtgggccggccgggcctggcgtggggctaacggcaggcaccctgcgggaaggtgtctggtaatcatcagtgcccagcagtccccaccccctgtgctccgccccagggtcgccccgggatgaacggattgaaaggagagaaaggggagccgggagatgccagccttggatttggcatgagggtgagtgtctctcaaggggcggactgggtggctgggagaccaggacctgggaatggcctggccacagcctggggtcctgcagctcctcccagaggccacttataagcagccctgccatgtggccacacagcactggtcatgccatacccatgcacagtcatacatgtccacacacgcacacgtgtgcccaaacatgcatgcacatatatggccgtactcatacatgtgtgcacatatacacatgcatctatgcacatacatgcccatacacacgcgcacacatacacgcacacacacatccacacgtgctcatgtgtgtacacatgcccatacactccacataggtgcacatatacacatgtattcatgcatatacgagcctgtccacgtgcacacccatacaggtatatacatacactcatacatgtgcacgtatccacatgtgtatccacatacatgactatgagccctccctggcccattccatgatgggcatacacactgcacatgtatactcatgcacacatacatatacacatgcatacacaccaatacacatatatgcacacatgtgcacccatatacacacatacaacaggcccctgtggattctcagcagggcatccatgggcctgggccatgccctccatgccctctatgccctccatgccctccatgccctccaagccctccatgctgggggttctcccgctcagcccaaaggtgtccactctgctgtcttttgagccaagagctttgtctccctgatgtcagcagggtggggcattttcagtcacctttttacctgagacgcagacccggtggcctcttcactcctcccgagggacgtctgtgcacgactccagcgtgggatgaggtggggccggggccagttcctgtcctcagggagccgtggcccgagtgacccactgcattctcggttttgcctggtcagaggtctgcctggtcaggtttctgatttttctgatttttctgaactgtctctgctcccagctgctgcctgacaggcaggccataagcctaacagctctctgccctccccacagggaatgcccggccccccaggacctccagggcccccaggccctccagggactcctgtttacgacagcaatgtaagtccccagggcacccactgtcctacagccacccttggctgtcacacagagccccacagaggggctgggccttcttctcccctggcctctgcgtctgggggtccttctaggatgtgccagtctggtgggcagtggattagcagctgagttcccacggaaggtgaaggcctgggaaagggagggctctctgggtgtggagctgcttccagctggctctgctaagggcctgagcccagggttgctaggggcacccccattttcccaggctcagcaaggtgaagtgaccaatgagggccaagtggcgtcaggccgtggctcctgctctccgtacccctgttccctcccgtctctgactgggggaggctgctatgtggcctcatacaggggctggtgcttctgggcttggggacccctgagtggtggtggcctccatttcagaacatcgccctcagcagccgcctctccccgttccttgcaggtgtttgctgagtccagccgccccgggcctccaggattgccaggtgagggtcctgggctcacagctggggacacaggctctgaagggatgctccagagccccaccttccttcccgtgccagcagcagtgagactcccccagtggcccaaggccagtgctacacgcccagcccacgccccagttccgatgaccttggcccttcctgcgggccctcccagcacagccgtccaggacctgaccttggggtggcccccatttgctgttctccgttgagattttgcttctctggccaaagcagggtggaagcagccccgtccctcctgttggtcagcacgtgccctgcaggtgtggcctggcccccacatggcctgctgacggggacccagggcgcccctgctctccagcagctcctaccctgactgtccccatgtccatctgatgcccccccatccaggcccccaggcactagggcatttcgggcaggaggggcaccaccctggagtcctccctggcacattcctgatgggcactgggtctctcttcctccagggaatcagggccctccaggacccaagggcgccaaaggagaagtgggcccccccggaccaccaggtgagcaactctggacatcccaggcaggagagccatggcgtggccagcactgaagtgtggtcacacctagagccgccaccacaagcaggtcctggaccctcactgggtggtgaccacctcaccctgcgggaggaaggaagccccttctgggttgatgggggcctcataggacctggatttgggggcgagggtggctgcagggcacaagcccagcaagatagccccatcacctcctgaggagcagatggctgcccttccatgctagacccaggtgggcactgcgcagagacacagcagcttcagtgtcctgagatgccccctcccctccacggggccgggggtcggcactggaggaccctctgtcgagaaactctccagggtttcatgtgggaaggaggcgttgcccgacaggccgtctggagggtgagcccagcacccctgctcccccaaaggacaagaattcccccctgagccccacctccattgagggtggcagggctgcttggatgtcctgccaagaccactgagaacagctggataaaatgtgagaaaaccactgtttgaggatgtctgggggctggcagagcagaagcccagagagccaggctagcctcgggcgcctttcaccaccagggtcccctctcgccgccacggtcccctctcgccgccagggtcccctctcaccgccagggttccctctcgccaccacggtcccctctcgccgccagggtcccctctcgccgccagggtcccctctcgccgccacggtcccctctcgccgccagggtcccctctcgccgccacggtccccgctcgccgccagggtcccctctcgctgccagggtcctctgcagaggaggccgccatacctgctcttgctggggctgcactctggggtgggaagggaccaggcaggcagaggccgagtctgggccgggacatccttaaggcctgtggaggcaaaggcaggcagaaagcaagcgggaagatggaagatgtgcccatgccagccttggatctctcagcgtcacacacgacgcccaggaaggagtgaatgatgcacagatgaccagaaaccaggagaagaggccagtgacacaccagaccaggaggcccagctcatggggtcatcggacccaccttgaactctgaaggtcacacattcaaaagccacaggaagtctggagatggcagcagagagctgggaagctcagaggtgtcaggatgaacctggggctgaaggcggaacagttggagattgagacctgtgtataggttttggtcgacgtgggattgcttgtccctgggagccagaacgagggctccgagggctctagagggaacagtgtttgcaggcggaatggctgatgctcttccaaagccaaggaaggctcagagcattcccctcattcgaaggatcaacaattagagtgacgagatttctcaacaaaacgggagaagccagaagaccataaatggtttccaaaatatccaagaaagtcaattgccagtgtagactccgacagccagtggtactcccgtggccttcagaacgaggatgacatgcaggccagccactccagacccgagctgtgtcggcggtggagggtatttcagggggaagacaaggccaagggaaaggagtgcagagatggggagagacaacgctggcaggaaccggcgtcccagcgacagggaggtcagaggctccctcgggaaccagcgtgggctgccccacatggcatcccaggaacagtggggtcagaggctcccgcgggaacccgtgtgggctgccccgcatggcatcccaggaacagtggggtcagaggctccctcaggaacctgtgtgggctgccccgcatggcatcccaggaacagtggggtcagaggctccctcgggaacccgcgtgggctgccccgcatggcatcccaggaacagtggggtcagaggctcccgcaggaaccggcacaggctgcacagcatggtgtcccatcgtcagtgcaattagaggttcccgtggtctcagcgccctggggagtggtggtagttctcactatattggacggtgaggttggagaggaatgcagagctaacactggtggagaggcaggagggcaggcaggacggcacacacacaggacgtttaaaacacacagagtagatccaaaagaaggcaaaacatgagagaaaaaggaatgcagaacacgtgggatgaatagaaactagggaataaacagtagatttaggtcccgatacatctacaggtgctgtaagtatgacgagggtagatacatccattgaaggacagacattgtcaatgggatatggctaaaccatgtgccgcttacaagagacgctccccgaacgtgagggctggagaggtcgaggcacccagaggctggtgtgggtttgggtgtgtgtggagtgtgtgtatgtgggtgtgctgagtgtgtgcagtgtgggggtgtgggtggagtgtggagtgtgtgcatgtgggtgtgtagtgtgggggtgtatagtgtgggtgtgtgtggagtgtgtgtggctgggttgggtgtatagtgtggaggtgtgagggggtgtgtggagtgtgcatatgtgggtgttgggtgtgtagtgggggtgtgtggagtgtatatgtgggtgtgtagtgggggtgtgaggggtgtggagtgtgcatatgtgggtgttgggtgtgtagtgtgtgagggggtgggggtgtgtggagtgtgtgtatgtgggtgttgggtgtgtggtgtggggtgtgtgtggagtgtggctatgggggtgctgggtgtgtagtgtgggggtgtggtttggtgtgttgcgtgtgtagtgtgggggtgtggtttggtgtgtgttgggtgtgtagggtgtggtttggtgtgtgttgggtgtgtagtgtgggggtgtggtttggtgtgttgggtgtgtagtgtgggggtgtggtttggtgtgtgtgtgttgggtgtgtagtgtgggggtgtggtttggtgtgtgttgggtgtgtagtgtgggggtgtggtttggtgtgtgtgtgttgggtgtgtagtgtgggggtgtggtttggtgtgttgggtgtgtagtgtgggggtgtggtttggtgtgtgtgtgttgggtgtgtagtgtgggggtgtggtttggtgtgtgttgggtgtgtagtgtgggggtgtggtttggtgtgttgggtgtgtagtgtgggggtgtggtttggtgtgtgtgtgttgggtgtgtagtgtgggggtgtgttttggtgtgtgtgtgttgggtgtgtagtgtgggggtgtggtttggtgtgtgtgtgttgggtgtgtagtgtgggggtgtggtttggtgtgtgttgggtgtggagtgtgggggtgtggtttggtgtgtgtgtgttgggtgtgtagtgtgggggtgtggtttggtgtgtgttgggtgtggagtgtgggggtgtggtttggtgtgtgtgtgtgtgtgtgcaaagtatatcctggagtaagaaacatggtcaaaaataaatgttcattgagacaacggagcaagtctaccagagaaattgagtaattctacatttctatgcatctaatgagatagcctcaagatatgacaagtgaaaaattggcaaagtgaaaaagaaaaacacaaatcaatcattatagggggactttcagcccagggagatctgaacagcaggtctgacaggcgtcacctgcgaaggtctccaggccacgtccccagcatcgggaccggggtctgccccagaggggcccaggctgggctgaaagcaggcctggcttccaggaactgtgaccccacgagtgcagtagaagcaagtgggaagtgcccacagggcagtggtcttccacgtggctcaggaatccaggagaagcaggtggaagtcagaaacccctgggagcttaggtgcgtccagggcatcctcagccctcacactgcagccgcaggggccttgccctgcacaatccccggtctcccaggtggtggggcctccacagccggtcacctccctctgcagaaggacccccaggggctccacagccggtcacctccctctgcagaaggacccccaggggctccacagccggtcacctccctctgcagaaggacccccaggggctccacagccggtcacctccctctgcagaaggacccccaggggctccacagccggtcacctccctctgcagaaggacccccaggggctccacagccggtcacctccctctgcagaaggacccccaggggctccacagccggtcacctccctctgcagaaggaccctcaggggcctccgcagccggtcacctccctctgcagaaggaccctcaggggctccacagccggtcacctccctctgcagaaggaccctcaggggcctccgcagccggtcacctccctctgccgaaggacccccaggggctccacagccggtcacctccctctgcagaaggacccggagcagggcccagcccgagagggagcacgggtcctgacagcagcagtgacctccaaccccagggacggctcctgtgggatggggggccctgggggtgtggagccacgtgctccaaagcttctgggttacagggcatgcctccaggggtgaggtggtccccaccccggtcacggtttcaggggaacagtcacaggagaaggtttgcccagggccgtctaaggtcccacctggaaggagaaggggttttgtcatctccgttgacaaaattacagctttaagtagtacctgtttctacacatcagcctaagatgttaaagaacaaacagcatttaaagaacaacaaacagttatttgatgaaaatagatgggaagaagtattaaacatcaaaaatgagtgaagagaaattgcgtatgttttatatataaaaatagcaaggatcaagaaagtccaaaaatccaaagttaattctttgcaaaggcgaacaacattcctgcacctctgccgggactgaggaaaaggagagaagcagcaacaagcagggatttcagcaaagggctcctccgtggtctggaaggagccacctggaactgccacagcttcacccttggagagggtggagggaccctcaagtcagggccaagacacagctgcctgcccaccctgggaggaggcagaggagagatgggaagggcaggacgctgggaggaaagaagcgcgttgctcttttctcagcacgtctcccacgtaagccccacaagtggatctgcaggtgaactctcaggatgagtaagtcaatgtaccgaagtcaccagatggaagggcagtctagaaaaaccaccaccgagtcctaagcaattaaaaatgaagttttaaaaaggcaccattgtgaataatgtcgcaataaacatacgtgtgcatgtgtctttatagcagcatgatttatagtcctttgtgtatatacccagtaatgggatggctgggtcaaatggtatttctagttctagatccctgaggaatcgccacactgacttccacaatggttgaactagtttacagtcccaccaacagtgtaaaagtgttcctatttctctacatcctctccggcacctgttgtttccttactttttaacgatcgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtggcacatatacaccatggaatactacgcagccataaaaaatgatgagttcatgtcctttgtagggacatggatgaaattggaaatcatcattctcagtaaactattgcaagaacaaaaaaccaaacaccgcatattctcactcataggtgggaactgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacatcatgcacatgtaccctaaaacttaaagtataataataaatttaaaaaatttaaaaataaaataaaaataaaaaggcaccattaacaaaaacatcagaaagtatcggttaactaggaagaacctaattaaatacgcgatctctaccgcgaaatggctagaagggcctcaggcaaacccaccagtgctgggggctgcagagggaacccggcgctgtcagacaccacctcagcgagaccccgcctgtctctctcttgcagggcagtttccgtttgactttcttcagttggaggctgaaatgaaggtgggtgacctccctgtggggttgggggcccccaaggtcctgtacatcccgctgggtggctgctcccaatttctcgccccatccggcccaagcccccttcctgttcagccctgcgaggggcgctggctccagagggtgtcgagggcgtccctcaggatgttcctgtccccggctcagtttttgggggactcggctgatgcagtgggaggtggggagtcgagccctattctatgcagccagcagctcccaggcctgggctccggaagcttctgactgcccagccctggctcggggggatgggaggccacctgtggcttgtaggggttcagggctcccgtgtaacaagtgtttccgtccacagggggagaagggagaccgaggtgatgcaggacagaaaggcgaaaggggggagcccgggggcggcggtttcttcggctccagcctgcccggcccccccggccccccaggcccacgtggctaccctgggattccagtaagtcccagcctgtgcaggcagagcccatgtcccaggggtctgggtgcaggagccgagggcaggtccagcccggccttcgacacccgcgaaggccggagctgcccctgcaagctcagcagccccgacatgtccctgtccccgtgtggggacgcagcaggccacatgggtgtgggtgcactgaccccggacaccccccgtccccctgcagcgttccatggcctgccctcctgctggggccacgtgcatccacctctgctcctgggccgggtcaggtcagatcagggtttaggcccatcagtcctgaaagactccagagagccatgggccccagctactgcctgggggcccacactgttgtcaggtctctgctggtctctcccccgggatcgcacccccagggaagaaggggtgatggtgtgggggtttctcaggctatggcgtgggcagggaggggaccggtgactcagaggctgcgctcgccaagggggtcttggcagctgcagccccacaagcttgcccgcccccagtccagggcacgaggtaaccaggaagcgtctcttgtcgccgtccgtagggtcccaagggagagagcatccggggccagcccggcccacctggacctcagggaccccccggcatcggctacgaggggcgccagggccctcccggccccccaggccccccagggcccccttcatttcctggccctcacaggcagagtaagtcagtggggagtgggccccgggcagaggccgcctcgtgtggcttcgtgttcccaccttggtttctctcctgcagctatcagcgttcccggccctccgggcccccctgggccccctgggccccctggaaccatgggcgcctcctcaggggtaagtgtctgggcagccggctgggcacctgcgtcccgtgccctggctggttctgcagcccctgcccctcagagacactctcccacggaccccacagggagatatacaggaggccaagatgcggtttccagggtggaagcggggccaggccatgggggaatcaggtggacccaggaggacgaccaccagccgggaagtgcccagggcctgtacattgtccacggaggcgcaggagctggcggcaggcaggggtccccatggtgctcatgggggcagccgcctcagtccacacctgtccaaagccctgcggcccctgcccagcaccctgaaacgggcattccttccttccgcccctgccccccgccctccccgccaagccccacacctctgcatttggtcccagcaggtgaggctctgggctacacgccaggccatgctgggccaggtgcacgaggttcccgagggctggctcatcttcgtggccgagcaggaggagctctacgtccgcgtgcagaacgggttccggaaggtccaggtgagcgctctgtgtgacgggttctggacccgtggaagggccgaagccgcctcctggggcttaaggaaggcgagaggctcaggccccggacagggatgggagcaggtggcagccagcgcttcttaaactttcaaacttttggtaaagtttagtaaaatacttttgtgagcagttttgggtttaaagaaaagtgagctcaagcttctgaaagtggatgaacacatggcgtgtgaggggctcctggtgggtcatgtcacagtgaacgtttacaaagataaatgtcacctcacacacccgataataagacaaggcgcctgacgggacgaggcggcaggggggctcaggccctccagggccacgtgacgtccacagcacggccccggctggggggcaggctgtcccgtggctctgcaccccgcgttataaacaccaaggtgggatgaaatgcatcctctctgcttagcacgggccttgctcaccagcctggctcctcagacacacctgggattgccccttccaggacaggccagcccctttcctgctttcccaaaatggtctgggtggcaggagtggccgctctgatccaggtgggtgcggccatgcttgcagggccccgggaaggtttaccttcgtgtggcaaaggtgaggacgggtagaagccccatgccgccgaaacggcctgtgacatccgtgggagcctccatggcagaacactgcacactgacacagccctgactcctggagccctcccaccttccaacacacccaccttccttctagagccctcccaccttccctctggaaccctcccaccttccctctagcactccctccctctcgccaccggccccctcctaggcctggccagcccctgcagcaccccagacagtgaatcccactccagtcccttcatctggccagggagaggctgccagtctcatagcagatgctgagctggtgcccactgtgtgccaggtgtgcttgtaggcacccggatgcagccccatcctaactttcaggggctttggtcctgacaggaggaggcaggggatggcatcctagcaaacgcgtgctgggagggctgggtgctgggcagggagggcaacctgccgtggactgggagggctgggtgctgggcagggagggcaccctcctgtgggctgggagggccgggtgttggggagggagaggcgggtgctgggcagggagggcaccctcctgtgggctgggagggccgggtgttggggagggagaggtgggtgctgggcagggagggcaacctgctgtggactgggagggccgggtgctgggcagggagggcaccctcctgtgggctggcagggccgggtgctgggcagggagggcaccctgctgtggactgggagggccgggtgctgggcagggagcgtaccctggcacaggcttggaggggcaggtgctgggcagggagggcaccctcctgtgggctgggagggccaggtgctggggcgggagagtcgggtgctgggcagggagggcaccctggctcaggcccagccgcaggtcctgggtgaccctgctgctttcttccagctggaggcccggacaccactcccacgagggacggtaaggagccttttttctgttgagactggtgggtggtcaggacatgagggggtatgtgctgtcccctgtttgaggaacaacacgtggtcctttggagtcctggagctgaacatgtggctcaccatcagcccctgctgcagaaactggtgcaggacaccccactacctctgtctcagcgctggccccccagtacctccgtctcagctgctggcctcacgagggagcccctctcatccctcaactttcccagttgtgtctgccgctcattgccctcctcaaggtcaaaatccttggggccaaaatccacatcttgtgtctttgccttccctcacccaaagtgccagacacaagaatggatatctctaagagtggtgggtgactgggtgggtgaatcaatggggaggtggatggatggatgggtggatggagaggtgggtgagtggatacgtaggtagatggggaggtggatggatgagtagatggtggacaggtgggtgagtggatggatggtggtcaggcgggtgagtggacgggtgggtgggtggatggaaaggtgggtgagtggataggtaggtagctggggagatggatggatggtggacaggtgggtgagtgtatgaatgggtgggtggatagtgggtaagtgggtgagtggatggtggacaggtgggtgagtggatgggtaggtagatggggaggtggatgggtggttgctggacaggtgggtgagtggatagatgggcagatggatggtggacaagtgggtgagtggatgggtggatggatggtgggcagatggatggtggataggtagatgagtggatgaatgggtggatggatggtgggtaagtgggtgagtggatgggtggatggacaggtgggtgagtggatgggtgggtggatggatggtgggtaagtgggttagtggatgggtgggtggatggatgggtagaaatattttcgttttcctaagtgttgcgtccagctgctgtcggcccctccttgagtagaggtcatgattccttaattggctcaggagtgaggcctgatgtggagcagtgtcaggggctccacagcggcctgtctcctcacagggttcagcccagtctgctctcactcatttgctgattcattctttcattcagccagtcaatagtcatggcccctcctgtgtgccgggtggccatggatattgccctgggtaacacacagcctggccctgtggagcagacagtggggacagccatgtggacagggtgcaggtggatggcaatggcagctgggtcaggaggggctgagggccgtggggaaaggtgcagaatcaataggggcatccggactggggtgcaggcctgggggctgggatttctagggtggaggtcacctctgagggagacagagcaaggccctgggagattagaaggtcgaaggtcgccgtgttgaggtcaggggccctgaattggagccgcggcaaaggagagggcaggtcagggcacgtggtgagtgattgctgcggcttctgagcacggctgggtctgtggggcctgagcagaggtgacccgcgatccggcgccacggcaggcaggactccccacccttgctgctgcctacacccccagggcagccccagagtcgggggcgcagctccctgcttgccagttcagagcccagcccctctcacccagcccagaggaggacacagatggaggaggggcacccggagggtccccccgccgacaggccccacgtctcccacctgcaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtggtgagtgcccccccaaagtgggcttggctccatctagcccctcggctctcggcagcagaagagggcccagcccctgcagagctgctgggggtcccaggcttcggccatgggtgggggtctggcggctcagggccactcagggcggcttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgctcagcgcccctcggccgtgcctgtccacacaggtgcggggccggggtggtgcgcccggggcctgggtgcagggggcagcgtgggacacagcccgtgacgcgcccctctccccgcagctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggtgggtcagtccagtcctgagggcgcgggctcctcggcccccacttgacctctggggtgaactcccagcggggagctcccctctagggcctctggaggccaccatgttacagacactggcgcctaggctggcgacttcagggcaggctccgggtgggtcacacccctccaggctcaggccaggcctctgcatccctgggcactgccacgtcccccagggcatcccatgaggcccccccgtggccccctgaccccccgctcccccggcagtgcccctcagagggtcccatgctgctggaccaagtgtccacacaggtgatagggctcacatacaagcctggaatcaggaaccgtcctttgggcctctagtgccatgcgggctggtggcccctctgccacagcacccatgtggctttattctgtggccccttttcgtgcactgggctgtggcttctgggtgccccggggagcacccacattccccagaaccaacagcagaggggtcagagacccagggctgggagcaggcggctgtggcctggcgttaggggacagggtcccctgccttagccaaggcctcttggggtctgcagaggctgcctggccaggcctggctcccccgcgcttgttccctggcaggacatgcccaggggctgcagaaccccaccccccaaaaaaacacacacccacacacacacatccacaacaccccacatccccacaccccccccaaacacccacacccatccacacccccacacaccacacacacatacacacaggtttctcttccaggacgagctgctgtttcccagctgggaggctctgttctcaggctctgagggtccgctgaagcccggggcacgcatcttctcctttgacggcaaggacgtcctgaggcaccccacctggtaggttcccagtgccgtgtgagcagctctgagagccccagccagggaaggcgggcgggcgggctcctatctgcagtttccccccgagtttttggacaaatcttatacatgctcattactttaaaattacaaaatccaaaagagcattgagaaaaatgagaactgctctgagaagtcatcattagcaatgcgtttgagagccaggtagttgtaagaaggccccgaaggtgcccccggccctctgctcatggcggatagactccatgtctcccggatgtcaccaagcctgtggtcagccatgtaagcagcgcagcgagtttattcaccgagaataaactcctcaaagggcaacacggagtccgagcatgtgtgcccttaaaatgttgacagaaatttccagggtatctagaagaacgcttcgtcccaaatgtcgctgtgccctccccacgtgagcgccgcgattcttccaacactcatgcatttaggggtgtctcggggtgccacacagcgtgtccccagcagtgcctggccatctgctgtaacggagatgcacctgccaagggtctctgacaggagtgctgtgggcagggctgggccccagggaaggcctgaaagccaggagcccgggaggcggagctggttcctagcgaggcagccacaggaagcctctgctcagcaggcatgagggccaggttcacccagccaggccaagccctggcccctctcccctctgccgtgggtgtgtctggcagaagcagcatggggggcagtctgggagatgcagccccctccacaggcagccagcagggaggccatgtggccctccaggttgtgggagcctctgcagccccctggtaaccccagggctggcctcctgcctccacctttcctgcccggggagcggcctctgccctaagcagagcaggtctgggtttgactgacggcccggcgcgtcttacaggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgactcttggtttgcaagcagccttcactgtcacaggaaggacacaattctccaaaaggagttctcaggagtcttttatccctggactgccccactggcagatcccgagtgtgcacaggcacgcacggttacatggggtatgcatgcatggccatacacaggcgtgcagttgtacacaggtgtgcaggagcatccatagtgtgcacaggtacacaggcatgcacgggtgtgtggacacacaccaacactcttaggtctctcctcacagcaggacctgacttgctcccagcaacactacatcctgacagccatccctgtcctggtggacgggtgagtgcaggactcagaggcaggcaggcagtgggtgcagtgagcaggctgcggagggagcaggccctcaggttggggaggcgctgggaggaggattctgatggcggtgtgggcctccccagtgacgctctagcccatggcacaggcccagcccacctccacccatcacatcctgctagatctacgagcccaggaaatggctggtgcagacccccccccaagcagggtccccagggtggccatgacagagcccctggatgcacctgggaccatggccctgtctgactggcaccatccactgactcgggccatcttccacgtgcagcctctgcctcaacccagggtaccccaa

SEQ ID NO: 14081 - DNA, 8025 bp, Human
ggccaacatggcaaagccctgtctctactaaaaatacaaaaattagcctggcatagtggcacacacctacaatcccagctagtcaggaggctaaggcacaagaaacgagagtcgcttgagcccgggaggcagaggctgcaatgagccgagattgtgccactgcactccagcctgggcaaaagagtgacactctgtctcaaagaaaaaaaaggaatgaagtactcatatgttctacatcatggatgaaccttgaaaatgatgctgaaaacagccagacacaaaatgccacatactgtatggttctgtacacatggaatgtccagaattggcaaatccatagattttaaaaagtagattcggcagggcacagtggctcacgcctgtaatcccagcactttgggaggctgaggctcacttgaggtcaggagttcaagaccagcctggccaacatggtgaaaccctgtctctactaaaatacaaaaattagctaggcatggtggcaggcacctgtaatcccagctactcaggagactgaagcaggagaattgtttgaacccgggaggtaaaggttgcagtgagcccagatcgcaccactgcactccagcctggccatagagcgagactctgtctcaaaacagcaaaaaaaaaaaaaaaaagaaagaaagaaaaaaaaagtagattcgtggttggtgggggaggggaggagtacatgctaatgggtttcttcttggggtgatgaaaatgtcctaaagttagacagcagtaagggttgcacaaccttgtgactacactaaaaaccactgaagtataactttaaaagggtgaattgaatggtatgtgaattatatctcaagaaaacaaactcagctggcatcagcccctgccccaccctgtggtaaagctgggtccttgttggctggtgagggctctcctaatctgcaccccctcctcacctccagacccacggcattgctgctcctggaaccccagccgtcccctgtgctctgctcttctgttctccgtgtgcccagctcttccccccacacctaggtacccggcccctcccagccttcacctgcgcctttacagaggccccatcagaccaccgggccccccaccctccacacgcccaccccgtgaagagactccctttcccctggctcttctgaatttctggcatactatacgatttccttatttttccttatttttattttttaatagagacggggtctcactatgttacccaggctggtctcgaaccccttgtctcaatcaatcctgcctcagcctcccaaagtgcgggcattgcaggctgagccaccacggccgccacgaccttctcttctggagcgtgtcgcttttgtaattatgatgtaaactccgggcacgcggggaccctcgcgcttcgctcactaatttgtccccagaccctactacctggcacagtaggcgctcaatactgttgattgaataaacgactgctactttggaaatcatgtattatttaaatcacatgtttaaacgcacataaacttctgagtagtgttttctgcacacacaagatgtctccaggggcaccaaagaatgcattttccacgtttgtccctaaacgttaatgcataagtaaccttggtcaccaacagatgtgagggcacgtgacgttcgggctgcgccctccccgccccggccctgcacacagtagggccgcaccgcgctttgcaaacaggtggactcggcagaggcgcgaccgccctcaccgcagagagctgggccacctgcaggctctcaggacacccaaggccccacctcccacccggaaaagagacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatcccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaaggtgggcgcggggccgggccgggggagccagggcctggtcgcccggctgtaggtgctgcgaggctcctccggttggcctccaggcgcctcccctttgccgggtttgatttgcgtgggttttctccgtacagccctggttttgcagatgggagagccagaaacgcagaaaagttaacttattcgaggttgcagggcgtggacacgcacagtcctttttcctccacccacttctgcccgggtaaattagaaaactcactgaagaaaagatgagtcagagaaggtgtgggggaggggcagaggttgggtgagcctgcctcgcatcatttcctttctgtctcggaatatgcttttcacggctgtctgagagtaatactagcattcagtaactcctacccaggggcttacagtgtgccgcttacccttgtaactgccaaatacaattttcgcagtagccctgtggcttagatactgttagctatcactgttcccattttacagaggacaggactgtggctcacaggttaagtggctttgtcgaaatgcgcagccgataactgacggagctaggcttgagccaagcagtccggcctccggatgggtagtgttagccactacactgcctctctggtcaagttcattgtggagtggcttcctgtcctgctctcggtcactccctctccaccctcgcctgtggattgcagcagcttccaggataaaaaagaaaccctgagtacagcagagtttctcagccctaccccccttgttctcagagtcgggagaggcttgggagtgctctggggacgcctctcagaggcttcaagctgtagcttggaatcagccattcagtcaccaatcagatagggcctaaatgtgtcaccatgggtttcactctgtaaagactggtgcctgttggggacaggatggacagaacagctctctgcctgagagcagtcaagtccagattttaaaaaaaatcagtactgaacaaacaaaacaggacgtagaaaaatcgggttttatggatatttaatgtctggaaaaacactgataaattgcattttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgtccattagcttccctgtgcctcaatttcctcatctgtacagtcatggtaacacagtgcccagcccacagggctgtcagagctgcgggagctggtacacctgccaacggtgtctcagaattgccagtagtccaagcagcaccctgtcctgcctctcctttcctctcttcacattccagaagcggccttttatggtcttgtgaccagctccctgatctcagtggtgacgtcagcagatgaggagtatggtagccagggactgaagactggtggtcactcggggcagctttctaaataacaattggagtgcctactagtttcctgtgattgccataacaaatgatcacaaatctggtggcctgaagcaatagaaatctaccccctcaatctggaggccagaaatctgaataagcagggtgccacagaccggcacaccctcggaatgctgttggggaggctccttccgggtctcgtccgctttgtggtggctccaggcattctttgacttgtggccgcttcactccaggctcacacggccttccctgtgtgtctcctgcaaggatacctatcattggtgcatccaggtcatccaggatgatctcctctcaagaccctcagcttacctttgcaaagatgctttttccaaagaacattcatggtttcagcaatttcacgtgaacataccttggggtgacatcgttcagcctgctgtagggcaggatgtgggatcaaccctattttcttccctcccacaactccccagcccctccctcagtgtctcctgctctaagtaggtagctccactacaacttcctttggcacttgagtcttcagtgggccacgcctcctaggacagtattagagagcagggggtttggctgaggtggaatcaggccactcttgggcatttggtgcagcccctttgctgccaggcgactctagcctctacagaggacctcgtgtaggcacctctgtccactcagcacttggcgtctgtgctgaaaagccctagggaggattgtggggtcgcttgtctccaaacctatggtaaaccgttctgttctttccttcccagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaattttctattcctgttggtggttctttcattttggatatgctggatattcccagtacagccagtttgaggatccctgtcaagggctccaacctgggaggggtggctggatttcctgacagctcgctagctgctcatgagcagtgtctgcccttagcaaacagtggtctgctagggtagcttttgccgctcttagaatttgcctgcaccaccaacagtatcagaatcaaagccaagtggctattctctgtcccagttcaccagctatgaccttgggaaagtccagtgtgccgtcccataggtgggatcttagccaaggccgcaggacactgtccccagtaagccgtggaccccggcctttaagcccctccacaccttcacctgacgcttccaggtgccagactccttgctaggagcaaaggccataggagtgaatgggacagaagtgtagccctgccctgttggcctcagaaacctagcagaaacaagctttaaccagttcatcactagcttggggtgctgccgtggcgctgagctggttgctatcccaaaacagcgtggcctgacctacacactgtacacccccgacccggcgcatgcctgctctcaaggcgcaggtcagggtgagttctatagagaatagacacatcgcccctcactgtccctaagtgtgagcagcttggctttggggaagagattttcttggggtgcgtgggaaagtattcttttttttttttttttttgagatggagtctcactctgttgcccaggctggagtacagtggcatgatctcggctcactgcgacttccacctcccaggttgaaaggattctcctgcctcagcctcccaagtagctgcgactacagatgtgcactaccaagcctggctagttttttgtagttttagtagagacagggttttaccatcttggcccggctgatctggaactcctgacctcaggtgatccacctgcctcggcctcccaaagtgctgggattacataggcgtgagccaccgcgcccggccttggacatggatttcttaaagcaacttgaaaaaacaaattctatgttcattttttttacaatcaggtagaatttgtgtttctggaaaaggtacgcacaaatcttgggcttacttgaaagctggaggtaacagccgtctcttgctctctgactcctttttcccctaagacagaagagggaagacaagtccaaacgtctgtgctttgcgggagacttcaggggaatttgatcaagcgtttcctggaacaaagggtcaaccctctggtcttcaggttcccgcagcctcccagctgcctgcccttctgccttctgttacacagtgccccctccacgccacactcacactcgctcccagattctcacagccacccctctccaggactcactccctggtgctcctgagaccacaccccacacaaactattcttgctgaagtcacaggctgctgcagcatttttgttctacctgaatctctagggcctctgacaccttccgtgaccattctctccaggagctcttctccctctccgctgtcctcctctcaggtccctcacaccctcccccagcctcagcctcacccctcctctagggagcacagccctttcttagcctcacccatcctaggtccctggtacctgccaggtatctctagcccagatctttctcttgccccagaccccaactgcctaggggcagcctcacagtggctgctatagcaaactaccacgtacttaccgccttaagcggcacaagtttatcttatggttctggaggtcagaggtccaaaatgtctctccctggtctacaaatcaggtgtcagcaagctggttcctcccggaagacctagaagagaatccgtgtcttgccttttgcatcttctagaggctgcctgcattctttaactcatggcccctccctccatcttcaggcccacagatgagcatct

SEQ ID NO: 14082 - DNA, 11433 bp, Human
gggaaatggctgcagaatgagataccagctacaaatgcaagcattggtgatgggggtgggagtcggctatgcacacccaagccctgcaccttcccttctcaattatcacagccgaatgatctactccaggttataagtaatgaggggaagataggagacgggcagatccatgaagctgagtggaagaaagtagagtttgattttctgtgtatacaaagtcttcagaaaaacgtgcaaaagcttagtaaatgcagcctgctcagataataaaactatatagaaaagcattgaggcaatttgcaccaaagtgaggctaggggatcgtttgggagggagtggggtgtggccaataagaaggagaaacaaatgagcagcgctggggactttgtcaatgtgccatttctaggagggggctcgttgtatgtaaatcactgaggtcttctttgggggttgtttttatctatatttcttatatttaccccccaaaaaatgtttcaagaaaattgacctgagtctaaggaggctccgcctcccaggatcccccttaacttcttcccagcccccagccacacagtttaaaataatctgttgaggccaggcacggtggctcacacctgtaatcccagcactttgggaggctgaggtgggtggatcatgaggtcaggagatccagaccatcctggtcgacatggtgaaaccccggctctactaaaaatacaaaaattagctggatgtggtggcgtatgcctgtaatcctagctacttgggaggctgaggcaggagaatcgcttgaaccagggagtcagaggttgcagtgagccgggatcgcgccactgcactccagcctggcgacagagagagactccgtctcaaataataataataataataataataataatcatcatcatcatcatcatcatcatcatcatctgttgaattcaggtgcacatttcttctctcaagaaatcctgcccatcgctgaaggtgcacaccccagggctggtgtcctcgttccatgacacctgttcacctggacccctggaagcagagcctgcaggagcaaagccccagggctgacagaccccgcctgctgtgcagtaaccaggggaagtgtggctgagtaagatacgggtggtgaagaaacccattctgatacccagatagctgcaacaaagggagaagtgtgtgcccttttcaaattgaccctttcccttctgacatttctcccttccaaaccccacagtacaacagttacagcctcagtttcccaggcctcctgcgagccaggcttccccccgccccccgtccttcgtgtgtatcaacatgcagaatcctcacctccacagccccgtgtccctctgctcaggcctcctgagactgaacccctgacctaggggagaacgaccccaccttgcctgtgccccccactgaagctcccgtcctggggagctcagacgtcaggagcctccgtgtctcccctctgcacagtgactccttgaggacagtgtctggctctgctctgttgacctcgttgtgtaaagaggaggtgcccacttcgttgctgctgagagagggaggagaggctgcctgctcacctcacctgcaccccagtctctcatggccctgagttccacctttggctggtatgacctccacaaacagtgacagccccaggggtgattcaggggtctggccagatgggacccaatttcaccttgcagaaaatgttacccaaatggaagggcaagtccgggaagcaagaaagaggttgggccctgcatagggtgggaatctggatgagtttctcaccctctctggcctcagggttcccaggagtggaaatggggtggtggacagtggatctcccaggactgacccggccctgacagtgtctgtgtgtgaagttcctcctctgaggaggtcacttttctgacttcacccccaacctcctgcgggacctcccctaagtcttgagacctcagtttctgagagaagaaccctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacaggtaaggcacgggctccagcacaggccacaggggaaggtcatgaggggctgaaaggcagggctgggatggggcctgggagggggttgggattgaaataagtcggtctccggggaggagctggaccagagcttgagcttcctccagggctgcacctgaaatacctcctcctgatcctgtgtccccatcttcaccagccctgacccataggcctgacatcctcatcctagggaccctagagtctggccactccaggaacctgacctgctctgtgccctgggcctgtaagcaggggacaccccccatgatctcctggattggggcctccgtgtcctccccgggccccactactgcccgctcctcagtgctcacccttaccccaaagccccaggaccacggcaccagcctcacctgtcaggtgaccttgcctgggacaggtgtgaccacgaccagtaccgtccgcctcgatgtgtcctgtgagtgctggaccaagatgcccaggtccctcatgggttgggaggtgttcctgagggcaggggatggggttcaagcctggacactgggttctgggtcccagaatctgggctgggagtggggtcaggagaatgccgactccattttccctgtatttgcagctcctgggaagacagggccaatgtccccagtccttatagtaatgtgggtcttcatgtctttctgtcccagaccctccttggaacttgaccatgactgtcttccaaggagatgccacaggtaggacagagccccctccctggggttgggggagcagggccttcagctcaggatggggctgggtctctcctcatcctggaatcactttgggaaacagagctgccactgtgcgtgagcccagggcacaagagcccacatctccagcccgcgtgaccatctgagcccctgtccccatcctgtccctgctccccttagactcctccacacaccccttccttggccccacagcaaggacagggtgacattcacacagctggatcagactcccaatttttttggtttttgttcgtttttattttgggaccagactttcaagtttcttgtcaggcatctcctgaatacttcctctgtctgatctttctgttttcccagtagtttcgatctaagtacttctgcccagatgatacagtcacatgggcagaaattcaaaatgcacagcaaagtctgtcctccagtgcccatccccctccacggaactgaccagcgtccgtccaggctgccctgagtcttggtttgtgcacctggaggatctcagaggtggtttgacatcgtagtgagactgtccaccccgtcctctaggaccgtgtgtgatttcactgcacagatggactctgactttgtggcatcccttaaggaaaatcatggcacaaatatccttccgcagaaactgtgcagtggatagtcttgtatctacttccacaggaatatctaagtgtatgggataaattcctaaaagcaaaatataccagtgtcgtatgttgtttctaattttgaaagatgcagtgaagttgttctcaattaaaagtggacaagtttacattcccagcactgagtgtgcgttttcctgcacttcagtctatgtctgtgtgtcagtccctctcactagtctctttctgtgtccttcctctttctctggatccatttgtctctctgaccctctgtctccttttattattattattattattatactttaagttttaggatacatgtgcacaacgtgcaggtttgttacatatgtatacatgtgccatgttggtgtgctgcccccagtaacttgtcatttagcattaggtatatctcctaatgctatccctccccccaccccacaacagtccccggtgtgtgatgttccccttcctgtgtccatgtgttctcattgttcagttcccacttatgagtgagaacatgcggtgtttgtttttttgtccttgcaatagtttgctgagaatgatggtttccagcttcatccatgtccctacaaaggacatgaactcatcattttttgtggctgcatagtattccatggtgtatatgtgccacattttcttaatccagtctatcattgttggacatttgggctggttccaagtctttgctattgtgaatagtgccacaataaacatacatgtgcatgtgtctttatagcagcatgatttataatcctttgggtatatacccagtaatgggatgaccctctgtctctttctctgcagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggtgggtaagggaggggctggaggaggagaacacacctgccccaccctcatggaccacccactgcccctgagcttcaagggggagctcagctctggtctgtgctcagctgtgaggcctggaacttccctgcgacccagagcatcactgtcctctccccgccaggaaaggggtgcggggtggggagaggggaggagtgggtcttggaggggaggagctgggacccggccaggtgtgtttggagggacaagcgccttgctttgcagtgcttagactaggatgaggcacatgaggcacttgccttggcaccaaatttaagaagccaaagaaaaacccaactcagaaagcaagtaaagtaatattgcaatgccatgatcttttgaaaaaactaaaattgaatgcaaaatgattccacaagaacacaatatcaaaattgtaaataaaggcaagacaagctgcatccagcactctcatgcctcactggcctcagaagtagtctcctttcctccctcccattcgtattctgtgtctgggaaggagaagaggggaatggaagtctagggccctgcagacagtgggaggggaagagacccacttctccgtgatataaatccccaaagcaactccaatccatctgcaggcacctcaagacctgtatcacaagtgacactggcagcagtcgggggagctggagccacagccctggccttcctgtccttctgcatcatcttcatcatgtgagcattgaccctggggagggagagagagacctggggcagggcagaccgggaacagaatccctgaagccagagctggaaggacctggatgggtccagggcttggggcaagaatgagctcacgggtgcacggtgagcatttcacgagcgtccttgtctgtggggctccacatctgtagcaacctcgggccccaccatccatgaggcaggagcctctgttttcaccgttggggtctctggaactggaccaccgccgttgcgcctcggtcacccctcaagcccccagtaggaaatacagggcaggggttggtctgcccactgcaccccgatctgaccacactgaaaggctctctggtctcttcactcagagtgaggtcctgcaggaagaaatcggcaaggccagcagcgggcgtgggggatacaggcatggaagatgcaaaggccatcaggggctcggcctctcaggtgagtgatgtgggcttctccacaccgagcatccagcctggacacctctgacaggatggcccccaggatcgctctctttggtatggccaaagtcacttcctcgtctcctcctccttcccacaggccggcttctacaggactcccccatcttgctgacagcatggcagtccctacccccaatttttcccaggccaggcactgagtaggagttatctcctctctgtcctccttttcttctctatagccccgattcaccatctctcctccatttttcctccccaagaatagctggcatctcttctccctggccccagccatcctgacccctctcattatttttcctattggcgggacctgatttctttgaccggcttgtcatccttacgccactaacctgtgagcttccccaggtcaggtatcatgtctcaattaaggccctgtaattctctctcatttactctcgttttgcccgttgtatcataatttacatgtagatactcatttcttatttttatttttttctcgaggcagaatcttgctctgtcacctaggctggagtgcagtggggcaatctcggctcactgcaacctctgcctcccaggttcaagcaattctcctgcctcagcctcccaagtagccaggattacaggcacgcgccaccaagccaggctaatttttgtatttttagtagagacggggtttcaccatgtcggccagctggtctcgaactcctgacctcgtgatccgcccgcctcagcctcccaaagtgttaggattaggggcatgagccaccgcacccaagctgatattcatttctttaacagtcatttgttgccacctccctcaattaaagactgagctgccactttgggaggccaaggtaggaggatcgcttgagcccaggagtttgagaccagcctgggcaacataatgagatcccatctctacaaaaaaatgcaaaacttaaccaggcatggtggtgagttcctgcagtcccagctacttggggggctgagatggaatgatcccttgagcccaggaagtggagggtgcagtgagctgggattgcaccactgcactccagcctgggcaacagagccagactctgtctcaaaaaaaaaaccaaaaaacaaaacaaaacaaaacaaaaactgagctgcaggaggtcagggcccacacctaccatgtccatcatagtttatccagcaccggctcagggcctcacacacgggggcctcagcaggactccaggctttggggtcagaaggaacagatggattgggtcctgctgcaacagggactttgggcgcagtgctgactgtttcgacctcagttttcatatttataaagtggagataataataatatctcactatggagttgttgcgggaagttaatgagattagtaaacaccaaacaggtgctcagtaagtgttaaatgttggaggaaagcatgaaagacacttcgacaaaaatgcaggtgggatgaatggaggacggacctcctgggcctccttcctggactctccctgcctcatcctggccccactgctctgttctgactcccttctctctctctgtccagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcatagaacaagaaccctctagagccccatgctatgcagtaggtcaccagggctccctcctcctgtctaaccaaaacttggaccaatgtctcccctttccccggctaccagggacccatccctgcctctagcttctactacccaccattctcctctcgacctctctgaggttgactattttagattccacatagagatgaggtcatgtggtacttgcctctctgtgtgtggctcattttacacaaaaaaatatcccctaggttcatccatgttctctcaaatgacagaatcaagcactgaatatttttttttctttgagagatggagtttcgctctgttgcccaggctggagtgcagtggttcaatctctgctcactgcaacctccacctcctgggttcaaacgattctcctgcctcagcttcccaagtagctggtactacaggcgtgtgtcaccacgcccagctaatttttgtattttttagtagagacggggtttcactataagtgggccaggctagtctcaaactcctgacctcaagtgatctgcctgccttggcctcccaaagtgctgggatttcaggcatgagccaccgcacccagcttgcattgaatattttcaaggagctaaaagaagattttaaatggtctcacaaaaacagataaatatttgcacagatgggtgtgctaatcattgtgccttgatggttccacgatgtatccgggtgtggaaatctcactgggtctctctcaaggccactcggctactcaggacagggctggaatttaaagcctgtccgattctgaggtctcttctctcatctagcactgagtcaagcaatcagcaggctgggcaccccttagccataagttttcaggaaataaattccttgagggcattgacttttacaaaagagggagcagcaatggcctagagtctcaggaacaagacaggtgcactgaggagatgaaggccgggaccccctgcccaacctgtatggcgggtctgtacttattttgtttacccccaatttaaaacgtttttttttattgcaggttgtttgtttgatatggtttggctgtgtccccacccaaatcttatctagaattgtaatcagaattataatccccatgtgttgggggagggacctggtgggaggtgataggatcatgggggtggttcccccatgctgttctgatagtgagtgagttatcacgagatctgatggttttgtaagtggtggtttcccctgctcttctctcttgcctgccaccatgtaagatgtgcctggttccccttccgccatgattgtaagtttcctgaggcctcccccgccatgtggaactgtgagtcaattacacctctttcatttataaattactcagtctcaggtatttcttaatagcagtgtgaaaacaggctaacacattgttctttgaaatttaaaaatagcgttagcttttcagttgaatcacgcagctcttacatgtgccatgccatgagtgttgccaaacatgcacccctgtgtaaccagcttctcaatcaaggatagagaaattttccttcactccagaaagatcctggtgtccttcccagtcaatccctagccctgagagccaccactttctgattcctatcaccagatattattttccatgtcccttgaacttcatataattggcatcacccaatgtgtattcttgtgtcttttgtttttcactcagtgttgcgttgttgttgttgttgttgttgttgttgttgaagacagagtctcactctgtctcccaggctggagtgcagtggcgtgatctcggctcactgcagcctccacctcccgagttcaagtgattctcctgcctcagcctcctgagtagctggaactacaggcgcacgccaccacacccagctaatttttgtatttttagtagagacatggtttcaccatgttggccaggatagtctcgatctcctgaccttgtgatccacccacctcggcctcccaaagtgctgggattacaggcatgagccaccgcacccggccgcattgcatgttttgagattcatccatgctgtgtgtgtcagtatcttttcctctttattgctgagtaggacaccattgcattgtatgagcaaatcacaattcattcccttattttttcctattcattgatactgttttggttgtggcaattatcaagacagctgctgtgaacatatttgtatgatagtgtattgagatgtttccatttctctctaggatttggggcagggctgagataggaacaatgaggttggattcccatgctggcctttcgagagtatccaggatgtcctgtggagatgacattcagcagctcaggagggacagagggaggggctggagatggacacaggaaacatcagagggtctcatcatcctgataatggagttgttgtgggttgaatcttgtcccccagagagatatgttcaagtcctaactcccagtatctatgtctgtggctttatttggaaatagtctttgcagatgtagccaagctaatattaggaggtcatactgtatgaggtgggccctaagtgccatgactggtgtcctaatgcaataagggaaattgaacacaagacacacatagggaggaaggccacgtgacagcggaggcagaggttggggttttgctgccacagcccccagaagctagaagacgccaggaagagtcttcccagcactttccgagggagacagcccaatgacaccatgacttgggacatttggccttcataacgtcaaagaataaatttctgtggctttaagtcaccaagtttgtgggaatttgatatggaagccctaagaagccaacacacctgacaccaacacacctgctggcacctgctatgcactgggaactggacccatcctgtctctgcaggcctcagagtgactctcaagagggctggctctacccaggtcacagaggagcccgggtaagctgctcagcaccacacaggccagcaagtagagggtccaggtcgaatccaggcagctgccccaaggcacaaagggtgccttaatcaggggaacagaggcacctctcacccagcactcactttatgtttcctttagtttattatttatttatttttatatttgcttacattgttttgacctggttataaaacaagcaagaaaacaaacaaaaacacaaaaatcaaagctcactgttgggaaaattgggaaatacagaaaagcacagcaaagccttagatttccaggtgccctgtttccacttttttcatttggttttcctgctcaggacctaatttttattttgttttatttttttgagaactgtcatattggttacttctatttccta

SEQ ID NO: 14083 - DNA, 199471 bp, Human
  misc_feature (1)...(199471): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgcaataaatcaaaattggcaacttcagtttattctttgtactagtgtcatctatatttgcaagcccttttaataccagtgcttactttctccaactttctatttttaagacatctcacatatgaatacctgtaattatgtgcagagtatggagctaatcagtacggtgttcatgtaggggttaattggctttgtagagagaaaagttctgttctgtgggcctagactgtacttttagtcttagaaagttgtttaaagatgtaccctgtcaggcgaaagtggaaccgggaagatcacaagatggcttagggccaactaacaatgatttagaaataacgttgttattaatggtaaacacgacaggcatatcttatggaaaagacaatacattttctattttattccgccattgtttgcaaaggaccttagtcaataaatctcaaaagaaaataaaactagccggtttgtggttttgcttacaaagaatatggcctgagatttgtacagtttaagtattaatcttgtcattaaatgtttgtcactcattggaaatatttacatgttcttttccatatattatttcatttagattgaaaaaatattgggaaatatcctcagggatagaacaaatgttatgatatggtcttctgtaatttcgatttcctttgattatgagttatcccaaggtggttgaataaagcaggcaattacttgaaaattgtcttttacattccacaattttaatatcattgtgatttctttgtttaaaataggaacatttaagttctcctgggcttttcttaaaaatgaaaatcctcttgaaaggcgaaacatctaatgaagaactccttgaaggtatgatctctgtatgtgaagagcacaccattttgaaacatcactacaatttgttaaatataagatcttttgtagtatactaacaataggtgtaatttgatggtggctgagaaggaaaatgatcacccaggaaagggaaaatattgtcacccaggaagaaagagagaaagaagaaaaaatagtagcaaatttaaaaggtgtttttttttttaaaaaaagctgaataaaagcaatcagttttcttttagtccagcagagaactgtagctacccaacccttctgaagttgtctaccaccatgaagaaagaaagattacctattaatgggaaaagcctttgtaatgctgtgatttttataattacttgtttataaacattgctatttatttttcataattctccaaggaccagaatgtacactgcacaaaagttggtcattgggcaagtcacttaactttgctttgtttcttcatttagcaaaagagatattattattatctacctcatcatgttgttttgagaattcttgtgagaaaatgtgtataaagcatttaacaccatacctggtgcatagtgtgcaatatatgttacctattactgtagttattattattactgttattactactatatagatgcattacatgaagcaaaactatgcacactagcccttaacatttcagttttgtttagtcataaaaattatttactctaattcttttaatgttgtacatgcttttcagtaatctttaagagctgcattatttgtactatacaaaattatatgttagtatagttactgattatccaataaataataacaatttgttatagttagaactaaaattcaatttggcagtagccctaaatttagtactactgaatctttcggcggcctctagaattttagccaatcacttaagagacctcagaagctcaaatgtattggggattctgcatctctaggcaacagtatcacctcagcatacacagattgaaaaatgttagaaaccaggaagacaactctacttttttgcattgggggaataaacaaaccaactaaccaactaaaataatacacttactccaactaagacaacataggaagaccagagagatgattggagtcaccaagttgaagtacattagtttgggatgataattccttatgacagtgtttatccaaatgtaggtaagaagcagagtttaaaatgaaattgttctttattcacagattgcttttacttaactcaatctagatactcccgaagttgcaatgtcagtcatagtttgattacagattaggaggctaacccaaatccaagttttttatatttaaaaatactagattttgcattgaaagaatatatgaaacttgcatttttatattctgtttgttgctttgctggtgaaaatactttactcttaaaatggtcagcctaactgctggcattattgcactgatattttttgtagtagaaagattgaaatttaaaaataaacatttttcattgtgaaaggatagcacataataatttaagacatttttggaaaatactaaaaattctcatggtcctaccatccactagaagctccttgacagcaggaatatttgttatgttttatccactgctaggttctcagcacaaagcacaatgcctggtacagataatatgctcattaaatatttgtcaaataaatagaatctaaacacaatcacttttagaaatttgatcacttattttcagtattttttctcttagtttattttgcttttattacagaattgtaactatatagtacataaaagtttgctttctaatttttcacttactaatcttatacatttttcatattagtgtatattcattttttccactttatttcatactcaacagttttaatggttgcacaatagtttattgctaccctgtaatagacatacagtgtatacttcttttctattattattataatctacactgcttttaatatttttgttcataaactttccccatatttattccaggtgacttttcagaagcacaatttcttaaagggaataataatagcagctgccatttattaaatgcttactaagtgctaggttctttgctatataatttccatacattatctcaggtaatcctctcaacaaccctgagaaattggtggtatattctccattttacaggtgacaaaactaaggtatagagagcataacttgcctatggccatacaagtagcaagtggtttcaaatttagatctgtctgacttcagataccaagctctctaccccagtgttcttagcgtatagtattgccaagttgctttttgaaaggattgcaccagattactttgctatctgtgcaagagtgcttgtgtcatgacactctccagcactggatgttaatactttaaaagaagattttgataaatttttaggcaaaacatggtatatggcaaacatttagtaagtagattttgaatagaggaaaattattgaaaataactaagcttcctcaaaaattaaactgataattatttcattttttcatcttgttagctgtcatggaaatactacatcttgacatgcccttagacttctgtctgaacattgctaaactgctgatggatcatgaaaggtacagaattgatttccctttctctaaagactgacagtttttggctaggcaccagtggctcacacctagaatcccagcacttggagaggctgaggcgggaggatcccttgagcccaggagcttgagaccaaccttggcaatatagcaagaccccatctctacaaaatattttttaaaaaattggctggtatggtggcatgtgcctgtagtcatagctactcgggaggctgaggcgggaggatcacttgagcccagcagttcaaggttacagtgaactatgatagtgccactgcattccagcatgggcaacagagcaggactctctcaaaaataattttaaaaatttagtccctccttcacactagccatgtatcaaatccaaatagctgcatgtagctaatggctgccttattggacattacagattaaaaaaatttccattgtcacagggaagttctattgggcagcactgttttagaccctgtatttcttttaatgcagacaacatttaaaatagttcttttctggcagctacatcatatggttaatttcctggacttatgaaactatatgcctcatatcctccacttttatggttaagaacccattaaccatactttataaactattaaatttcagcctgattgttacagcctattttttcagttcttctgatctttgtgaatttcacttctatcatgcagtgtattaactattcctcccagtttgtgtcatcttcaaatttggtattgccacctgtcttcatctaattcaggggtctgcaaacttttcttacaggttaagatataagtatacattttgggcttgtgggccacacagtctctgtcacaactagtcaactctgccgtcgtggtgcaaaagtagccgtagactaatcataaacaaatgtgtgtggcttttattccagtaaaactttattcataaaaacaagcagagcagctggactgcaggccatagttttctaactccagataatttgacaaacagcaaaactgaggccagaaccttcgtggcagcatagattaatctccaggttaacagcaatccattaattgatactttttagtgtacaatcattgaacctgttataaatccacctaattatagagctagatgacctaatttccttcatgttgttcacaaaaatttcatggaacttaatttttattttttaaagttttggttgcttttatccttccttcttccaaaaagaatttgaaacttcttatattcaagtgtataataaagctctgaaaattgaaatagacaatcaaaaccctgaaaaggaggaagcaaacacaccaaacacaatggctaatatagttgctgtggtagagcattcaatttaatggtaagctttcttgcagccagggagaaggggcaatgtgatattttatacaattttcattattaaataacaaaagctaacatttactgatacttgctttttactaggcactattctaaattccttacattataaattatgaagtacctctaacgtaatttgattaaccccattttgcaggtgagaaaaatgagggttagatagaaaaagtaatttgcccacaattgcatagctaggaaggagcagagctggaatttaaatatgtttgcagagctcacactttttattactgtagtagaaggaatacattcaatactacattccaaatcaattaatcactagaaaaagtttacaaagtggtggactatgggctgggtgtggcgagagatgtgttgcatatagttgaattagttgccaacattaaacattcaggaaatttcacataaaaatatgggtttcatatatatatatatattatatatatgtatataatatatacatagaaaatctgtgtaatgaaaaataattcaagaaaaggactgaaatttcaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatccaggggtcctgaacacttttatggcaactaagttacttttactcctaaccttggactttaatcctcttttagaattttgtatctatttaaaaaattctacaaacatgctatgactgtaatgaaaaatttaaaacaaaaaagatcacatctaatattattatcctaacaatctgcttttagttttttctttcctttaattccttatgcgtattggtgcataatttttcctagttacaatgttaacatttgtcatttatgttgttattggtgaaaggcgtcaggcccccctttttttttgatgctgattaggtaagcttaatcagttactgtttattccagtgacaagaatactaaatcaaataaacaaagggatcttgaattgcagttagactaccaagatagaatcagaaacccagagatagtgatctaggaaagtcaatgcaccaaataaaaatacagaacaagaatgtgggagatcagattgacattgccaaactaaaatgaagaagagaggagagcagcagcaggcttgtgaagtcaagatcagaatccttggaagtcagataagagatacagggaagcaatttgttcaggctcatcaagtaaaaagaaagaccagaaagccttgcatcttaaccattttattcccagctttcctgttgcataaagcctgatattgttttattaatataatagtttttgaacacactgttgaatgttataataaaatatttcagagctatctagattctacacattaaatgagttcctgaaaagttctgttcagagaaaatttgatatggtattatttttccataaacttacactatacaaataaaatgatttacctccaaaaaatgtttggctctaagatatgataaaattatacttaagaatgtagcagaattttacaattatatgtttaaatgaaatacattcttatgataatgtaataatacgtacttgaggtgagttgcagaaatggcatgctagctgagtgagaatatcctgataatatagaaaaagagataggtacaatattgaagacctcatactcaataataattcctttctgggatagatctaaaaggttatcagccactgagaaataaaagcaaacatcaactgacccttgagattttaattaatcatgtttattcagatattcccatgtaacagccactatctgagctcagtattggtgattggtatcaccctagatctttctcttctcctgcttcaggttgaatatccctgtaatgtattttgtaggacattcgtattttttgttgtaatgaacattacattatgagtttattttcaggaatcatagttccagtctgtaggaagtgaaggtggtacagaatacacactcagttcctgaatcttcagtatagataagttttgttgaaatagataagtttgtaggttttttccctagggggattggttttagggttcttgagatgggaaaaggagttttttttttttttaattatttcaacttttattttagatacaagggacacatatgcagcctagttacatgggtatattgtaccctagtagtgagcatagtacccaataggtagtttttcaacccacatgcccttcacctctcccccctctactagtccgttgtctattattcccatgtttatgtccatgtgtgctcaatgtttagctcccatttataagtgagaacatgtggtatttggttttctgttcctgttttaatttgcttaggattatggcctccagttacatccatgttgctgcaaagaacatgacttcattctttttatgactgcatagtattccatggtatatatgtaccacatcttctttatccaatccaccattgagggacacctatgttgattccttgtctttgctattgtgaatagcacagtgatgaacatatgagtgcatgtgaggttttttttgtataatctgttttcctttgggtatatacccagtaatgggattgctgggtctaatggtagctctgttttaagttctctgaggaatctccaaactgctttccacagtggctgaactaatttacatttccattaatagtgtataaatgttcccttttcttgcagcctctccagcatctgttgttttctgactttttaataatagccattctgactggtgtgagatagtatctcattgtggttttgatttgcatttttcttgtgattagtgctgatgagcattttttcacatgtttgttggcagcttgtatatcttcttttgagaagcgtctgttcatgtcctttgcccattttttaatgaggctatttgttttttgcttgttgatttttttaaaaaatcacctttctgacaagcttgttgatttttttaaagttccttatagattctgggatattatacctttgttagatccatagtttgtgaatattttaatattcttttgatagattttttttatgctgtgcagaagctctttagtgtaattaagtctcacttgtcaatttttggttttgttgcaattgcttttggggacttaaccaaaaattatttgccaaggctaatgtcaagaagggtgtttcctaggtttttaaaggttggttgctcctggagaaagagttcaattttccttacctcattgtgtgcactgacattcattttatcaacaaaaattgtgcctagtgcaacatgttgtctagggtctggttgtagatacaagaaatataacaaacacacatttccctagtgaatttatagcctactataataaattaagcatatatatgcttgatcagttgagtaacaataaaattcagaatatgagaaatgtatggtataggcaaaaacagtatatgaattcagagagagtgaaagatcactgttagctctattagtcagggaatgcttgatggaggaggtggggtcttagaaatggataagatttgcataggtgaaggagtaggaattactagcaggaagatcagagtgagcacaaggcaggtgtggggacaataatttagtccaataaagtatttagtatcgtttatgcaaagggtaccatgtggaaaacataggcaccacttgcaaagaatttacaagtcttactggaaagagagtatatgtaaagataataatataagacagcacatggaaaatggggataagtgacaaattggtataggaattcagaagaagcctagaccatcatggactaggaacatccgaaagtcttatttgaaggtgaggtttgagctggcctttgatggtagggtaggatttagaatagtggaaaggaagagttaggacacctgtggtagggactatagcataagtagatatggggacaacatggtctatttagaatatgatgactaatgaatccgagaggatttagcataagttttatataaggagtataatgaaatataaagttagagaagtaaattggagtcatttattaaattccttgatactgggttaaaggactatatgatataggcaaatggggacccactgaaggtttccaaataggatagtgacatgctaatagcaataatatgcaagaatttgagagatagggagattaattgagttgttgtaagtagctcaaatatgaagtaataagagcctgaaactaggttgatagcagtggaaattcattctttcacgtttgagttcctacaatgtaccagtcattttgttgctaggcattgaagatgcagagataaaataatatgcatgtccctggtggtctcaaggatatcactacttaatggggaagataagctcaaaattatgaaacaaatacaatcacagaatatttttataccataaaagggggggttagaggataatttatgaagacaaaactattctacctcttgcctacctatttggcattagaattaatacagttttgactgacttgccagctgcacactatccttaggacctatctttttttatatatactttaagttctagggtacatatgcacaaagtgcaggtttgttacatatgtatacatgcgccatgatggtgtgctgcacccattaactcgtcatttacattaggtatatctcctaatgctattccctccccctcctcccaccccacaacaggccccagtgtgtgatgttccccttcctgtgtccaagtgttctcattgttcaattcccacctatgagtgagaatatgcagtgtttgattttttgaccttgcaatagtttgctgagaatgatggtttccagcttcatctttgtccctacaaaggacatgaacccatccttttttatggctgcatagtattccatggtgtatatgtgccacattttcttaatccagtctatcattgatggacatttgggttggttccaagtctttcctattgtgaatagtgccgcaataaacatatgtgtgcatgtgtctttatagcagcatgatttataatcctttgggtatatacccggtaatgggatggctgggtcaaatggtatttctagttctagatccttgaggaatcaccacactgtcttccacaatggttgaactagtttagagtcccaccagcagtgtaaaagtgttcctattttttcacatcctcaccagcacctgttgtttcctgactttttaatgatgccattctaactggtgtgagatggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtaacagggtagcatgagggatatctttgtggtgataagaacagttcttgtttgccatggtagttgcatgaatcttcatgtgtgacaaaatgacatagaaactatatgcaggcaaacatctcagcaggatatgcatttggttccagtaacactgcaataaagcaagtattgcaataaagtgagtcacacaattttttttatttctcagtgcatgtaaaagttaggttactatatactgtagtctattaagtatgcaatagcataatgtcttaaaaaccaaatgtgcatactttaattttaaaatacgttattgctaaaaaaaaataataatctgagccttcagtgagttgtaatctttgtgctaatgaagggtcttgtcttgatgttgttggctgcggactgatcaggatgatggttgctgaagttggggtggctatggcaattgcttaaaataagtcaacagtgaagtttaccacattgattgactcttcctttaatcaaatatttctgtgcagcatgttgtgctgtttgttagcatttcacccacagtagaacttcttgcaaaattggagtcaattccctcaaaccctgccactgctttatcaactaaatattataatatactaaatcctgtgttgtctttcaacaatgtacacggcatcttcaccagaagtagattctatctcaagaaaccactttctttattcatccataagaagcaacttctcatccattcaagtcttatcatgagattacagcaattcagtcatatcttcaggccccagttctaattctatttctcttgctatttccgccacatctgcagttacttcctccactgaagtcttgaacccctccaagtcatccttgacgactggagtcaacttcttccaaactcctgttaaatgttgatattttgaccttcttccatcaatcacaagtgtttctaatggcatctagaatggtgaatactttccagaatgttttcaatgtactttgtccagatccatgagaggaataactatctatgcagctatagccttgcaaaatgtatttcttaaataacaagacttgaaagtctaaattactccttgatccatggatgttgtattagcaggcatgaaaacaacattaatctccctctgcatctcccttagaactcttgggtgaccagatgcattgtcagcgagcagtaatcttttcttctgagcaatggttctcaacagagggtttaaactattcagtgagccatgctgttaacagatgtgctatcatccaggctttgttgttccatttatagagcacaggcagagaagatttagcataattcttaagggccctgggatttttggaatggtaaataagcattggtttcaacttaaagccaccagctgcattagtctctaacaagagagtgagcctgacctttcaagctttgaagccaggtattgacttctctctagctataaagttctagatggcatcttcttccaatgtaagaatgtttcatctatgttgaaaatttattatttagtgtagccaccttcatcagtgatcttagatcttctggataacttgccgcagcttcttcatcagaacttgctgctttacattgtgcttttatgttacggagacagcttctttccttaaaccacaagaacgaacctctggtagcttcaaattttgcttctgaagcttcctcacctctctaggccttcatagaatgaagagagttaggacgttgctctggattaggctttggctcaagaacgtgctgtggctggggttgatcttctatccagaccactaaaactttgtccatattagcaataaggctgttttgcttttttatcatttttgtgttcactggagtagtacttttaattgccttcaagaactttttgtttgcagtcgcaatttggctgtttggcacaagaggcctagctttcggcctagcttggctttcaacatgccttcctcaccaagcttaatcatcactggcttttgatttaaaatgagagatatgtgaatattccttgtacttgaacacttagaggccattgtagggttattaattggcctagtttcagtattgctgtgtctcagggaataggggtgcccaaggaaagggagagagatggggaataattagtcaatgaagcagttagaacacacacatttgggcttagtttatggtaccccaaaacaattacaatgttgacatcaaagatcactggttacagttataataataatgaaaaaaattgaaatattgcgagaattacttaaatgtgacagagagacacaaatagagtgcatgctgttggaaaaatggtacctgtagacttgacttgcttgattcagggttgccacacatcttcaatttgtaaaacaaacaaacagaacagtatctggtggcacgtgcttatagttctaactactcgggaggctgagactactcaggaggcttgagccaggagatcaagacggcagtgagctatgatcacagcacttcactccagcctgggtgacagagtgagaccctgtttcaaaaacaaacaaacaaacaaaaaactagtaactgtaaagtacaataaagagaagtgcaataaaatgaagtatgcctgttcacacatcgtaccaatgctgtttcctgctttgatattgttctatagttatataagatttaactataggaggaaactgggtgagggtacatgggatttccttatacattttttttttgcaatttcctgtggatctatagttatttcaaaggtaaaagttaacaaagttttgatgaaattaaattgtcagccttctttttttatgacttgtggattttgtgtcatgcctagaaaggccttttgtaaaccaagatgataaaaggtatctcaagcaacaatctattagaaaatgatgatgatgatgatgatgatgatgaccataaacagatccagtgcatggtgacaaacagtttaaaggcttttatcgtttgttttctacatttactttctttcctcatgggtcactttgttcattttggtgcttctctttaaggttgttcattttcttcaaatgtctagtttcttcagatgatcttgattctcttcatatttttaaaagaaaagatctgctaccaatagtttgtggtttgatcctttgacatcctttggaataacttcccacatgagtgttccggctagccgcgggtgtctccactctgtcatgtagacaggtgggatttcgttgggtctttgggttatctattgttgtgtagcaaaccaccctaagatttagcagtttgaatcactagtttattattatctcatggtgctgtgggttgattgggctcaacttaggtggttattgcctggagtcttacatggttgcagtcagatagtggctggtgttagagtcatctaaattttagattctaaaggcttggatgggctgaacactctatgttttcttcactcatgtgtctgttgtctaggctggaagtcactggatgctacccagacatctctgtctctttcttcatgtgtctaggttagaattcctcccagtgttacatcctcagggtagttggacttcttactgatgattagcttcatccaaagttccaagagaccaggcagatactgcaaggcttatgtcttattagaagtcatgcattgttaaaagcaagtcacagagccagtctagattcaaggggagaggactacaagggcatgaatactaggaagcataatttattgggagtacatctttagagactagttattacagtgggctagagacactagcccccacctccatcttgatatgcaaagtaggaaattagttctcttgccatataaggattttcactactgtgctgattgattttcctctttactccttttctcatatctacagtcttcctgtcccttatgctcaagctgggaggttcccataactgatcccttaaatcatttagaaggtttgacagcagagcctggggtcaaacatcaatggcctctactccttgcatgcacaacagagaattggaatagtttctgcagttcctctaggatcatcacaaatttttcctgtcccctactaattaatttctaattttgtggagtttcctagggtgttttttttttttgctggggggaacctatctatttcttcaatggcctcctttttggcttctgttgggtttcaggattctcacctcttgatttttccatcagtctgattgcttttaattatagaaattctttaaagtttcttaccaaagacaatatattttcctgctctctggctctactatagatttattcttacattcattctatttttttgaggtaaataactgtactcaatctgctgttttaaactgaaggttagatagatggaataaaatctagcattcagtagcacaatagggtgactatagttagtaataatttattgtatatttcaaaacaactaaaagtgaaattgggacattcacaacaaaaagaaatgataaatgcttgaggtggtgggtatcccaattaccctgaattgatcattacacactgtatgcttgtgtcaaactattgtatgtaccccataagtgtgtacatactatgtacttataaaaatgtacatattatttacttataataataaaaaataaaaataaaatgtaaatctaaacaagcttcttcagaaataaataaataaaaattaactattcatccagtatagaataattttaaaatgtggactttggcgtcagattacatgttttcaagttcttgttcctccactttgcagatgcttaaccttatgcaaattatttaaactatatatgcttcagtttactattcatgaatagtacttacctgttggggttttctgaagattaaataaggaatgtaaaattcctggcatatgataagcattcaacactttagctgttatcatttctggaaaagtattagaactaatacaataaacataatatttcattccaagttgagctgtatgtctgtggaatagaattcaaatccatcattttacataaggttagtattcctggacaagatcatgctgcatttagcttctttagcagttttatcagcacttgtgagctatgtctaagagtaaattgcaagacagttttactaacactgagcccatttacaggcattaaagtgatgattgctaaaacaccatttagcatgagcagtgagtatatgttagcaagaggtgacatgtggtatattggaacgagtccttgctactaactaaatgaccatgcgacctcagacaagtcatttagcttctcagggccagtgacaagcagaataatgtccccaaaggggcttccatgccctaatctctggggctgtgagtatgttaccttacatggcaaaattgattctgaatatgtaattaaagtcactaaccagttgaatttaaaatagggagatcatcctggattatctaggtagccccagtataaccacacaagctcttaaaagcagaagaggaatacagaaaaagtagtcagatagattcaaagcacaagaagtatttagcacaccattactggctctgaagagagaatgaaccataagccaaggaatacaagtggcctctaggagctgacacaaatcccagccaacagccagcaaggaaatgggacctcagccctagaatctcacagaactgaatttcgtcaatagcctgaatgagcctagaaatgtattctcccccaaagcctccatataagagcccaggatggccagtatcttgcctttggccttgtgtgagcctaagcctgaatggatttctgagctacaaaattgggaaataataagtgagtattttggggtttttttgttgtttgtttgtttgttcgtttgtttttgagatagagtcttgctctggcacctaggctggagtgcagtggcgtgatctctgctcactgcagccttgacttcctgggctcaggtgacccttccacctcagccttctgagtagctgggactacaggcgcacaccaccatacctagctatttttaaattttttttgtagagacagggtctcactgtgttgcccaggctggtcttgagctcctgggctcaagcgatcctcctgtcttggcctcccaaattgttagaattacagacatgagccatccacctggtgagttttgttttaaatcactaagtttgtggcaatgttttacaacagcaatagaaaactaatatgaggccttagttccttttgtaaatgatggggtaggaggcagtgtggaggaagtcagaataaatgaactttaaggttccttctagctctaaattctgtgattgcaagattcttattcagctgctagtttgtgagctaaagtccagcaaccataagtagtatggacacacacacacgtacacacacatatatacgtgagcactttcaaggatacatatgaatatggcaaagctaaagttttaggggactccatagtggcagatcaaccagatagatattggagtgggttttgcaactgcaaagcaaatggttgcaaccagggttaaggtttttcaggtagatcctgaaactaagaatcaatgaaaaagtgactttatatgtgcacagttttcataccctgaaatggaaaaatgatcattattattaaactagaaggtcagtggtgtctgtatttgcgttataacaatttacagttcttattcttttaaagaatcaattatgtaccccatatttctaatacatagtgaattctcacaatttgctatatttggcaaacatactctttgttttctatgaaactaactccaaggagctgagattccagtaaaacctggaaatgaatagtatattccttagagatgtaaacctctttagagcaatctccagggttctctatgcaagttgacactaaatttataatgataattctagctggccttcccacccacctctagcaattatgcaaagaaatgcccaattttatgttatattgttgttttttaaaacagctttatgaaggtgtaatcaacctacagttaaatgcatatatttggaataagtgtacaataagctttgattacacatacatacttatgaacccattatcgcaatcaggataataaacatatttaccacccccaaaaggttccttgtggtcttttgtaatctctccctacctctccttcatcagacagccattgatcactgaatgtcactatagcttcatttgtattttctagatttttatataaatgaaattgagtatactttttagtctggcttctttaactcagtatgattccctgaggtccacctatgttgttgcatatatctgtatagtttatacttttttattgctgagtagtagtctgttgtatggatagcctacaatttgtttatctattcagctgttcatagacattttgattgttttcagttttaggacattacaaataaagctgctgtgagcattcacgtgtgtctctttgtatggacatttgctttcatttcttttggtaaatacatagaagtgaaaagtctggtttggatggtaggtagtgctatggtttggatatggtttgtccccagcaaaattcatgtttaaatttgttctccaatgtggcagtgttaggacttgggaggtgtttgggtcatggaggtcatgaataacttggggctgttcttgcagtagtgagtgagttctcgtttcaagaggctggatgagtccttacagggatgaatcagttctgaggagagtgggttgttataaagccaggatatcacttgggttttgcctctttgctcctatccgcttcccctttgaactttctccaccaagttatgatgtagcacaaaagccctcattagaagtcagggccacgctatcatactaaaactgtgagctaaataaacttttctttataaattacacagtcttaggtattctgttacagcaacacaaaatagactaatacagtgctatgtatttaaattttcaagaaattgccaagcttttccaaagtagttacaacattcatttaacattcctaccagcagtgtttgagagtttcagtttctccacatcctgacccacatttggtatagtcagccttttaaataggtatgatgtctcattgtggctttaatttgcacttttataatgactaataatgttgagcatttttttcatttgcttttcatgtgtgtatccctttttgtgaaatgcctgttaaaatcttttgccctgttttgtttgtttgttttgttttgttttgttttaagtattgagttagaaactcctttcaggccaggcacggtggctcacgcttgtaatagcagcactttgggaggccaacgtgggcagatcacgaggtcaagaggttgagaccatcctggccaacgtggtgaaacctcgtctgtactaaaaatacaaaaattagctgggcatggtggtgtgcgccagtagtcccagctactcaggaggctgaggcaggagaatcacttgaacccgggaggtggaggttgcagtgagccaagatcgcaccactgcactccagcctggcaacagagtgagactccatctcacaaaaaagaaaagaaaagaaaaatgaaactcctttcaatatttggggttttttttaacttttattttaggttcagaagtacatgtgcaggtttgttatacaggaaaacttcctttcaatattttgtaaacaagatcctttttcaactttattgaagtataattgaaaaattgtatacagtcaaggtgaacaatatattttgatatatgcatacattgtgaaatgattaccacaatgaggctaattaacatatccatcacctcacatagttacttctttgtgtggtaagaatacttaagatccactctcttagcaaatttcagtacataatatattattgttaactatagtcaccatgctgtacattaggtcaccagaacctattcatcttgcataactgcaagtttgtaccctttaactaaaatcttcctacccacccctcaccccagccctgccactactgcccttggtgaccaccattctaccttgtttcaatgagtctgactttttgagagaccacatataagtgaaatcatgcagtatttgttgttctgtgtctggcttatttaacttaacataacatccctacaagttcatccatgtttttgtaaatgagggaatttctttctttttaaggatgaataatattccattgtatataaatatataccacattttttaaaccattaaccactaatcatcaaggaaatacaaatcaaaaccacatgagatatcacctcacacctattaggatagatactttttttaagaaaagataacaagtgttggcaaggatgtagaaaagttggaatttttttttttgagatggagttttgctcttgttgcccaggctggagtgcaatggtgcaatctctgctcactgcaatctccttctcctgggttcaagtgattctcctgcctcagcctcccaagtagctgggattacaggcgtgcaccaccatgcccagctaatttttttgtatttagtagatacggggtttcaccatgttattcaggctggtcttgaactcctgacctcaggtaatccacctcggcctcccaaagtgctgggattacaggcgtgtgccactgcaccctgccagaagttggaatttttgtacagtgctggtgggaatgtaaaatggtagaacccctgtggaaaacagtatggcagtttctcaaaaaattaaagatagaactaccatatgatccaggaattctacttttgggtatataccccaaagaactgaaagtaggatctgaaagagatatcttcactcccatgttgattacagcattattcatattcactaaaatgtggaaggcaacccaagtgtctattagtggatgaatgggtaagcaaaatgtgatatatatatatatacatatatatatacacacacgcaaacgtatacagatacatatatatgatggaatgttattcaaccttaaaaagaaggaaatcccactatttgtgacagcatggatgaacctcgaggacattttgttaagtgaaataagctagtcacaagacaaatactgtgtgattccacttctgtgaggtatctaaaatagtaaaactaatagaaacagaatagaatggtggttactaggggctgggaggtgggggagagggggtattgttgctcaatacgtataaagtttcagttacacgatatgaaaaagttctagagatctgtacaatgtagtgcctgcagctaacaataaagtattgtgcactcaaaattgtgttaagagggtagatatcatgttaagaattcttacaccaaaaaacaaaagaaaaaaagcacagagacccaagggagcttttggaggtgacggatatatttattacattgattgtggtgatatcttgagtgtgcacatatgtcaaactcatcaaattgtatacattaaacatgtgcagtgtttattgtatattaactataccacaataaaaataaaaaatatagccactcctacttttgattaatggtttcatggtatatttttttccaaacttttattttcaaccctcctatatcagtttttttgaagtaagtttcttgtacacactctacagttaggacatgtttgggactttcccctacctttttgagatataattgacaattaaaaattgtgtatatttaatgtgatgttttgatatacctacatattgtgaaatgattaccacaaccaagctaattaacatatccacttcatggttacctttttttatagagaggatacttgagatctgttcttagcaaatttcaagtatataatacattattattaactatagtcgccatgctgtacattaagtctccagaacttaatcaatttttaacttaaagtgtatatcctttgaccagcatctcccccattcccccacccaatgaaactctggtaaccaccattctattatctattactatgagtttaaacttttttttagccttcacatattagtgagatcatgtagtatttgtttttccgtgtctgacatatttcacttagcatagtgtcctccgcgtttattcactttgttgcacatcacaggcttctttcatttgaaggctgaataatattccattgtatgtatatacatcacattttactcatccattcatctgtcaatggacacttgggttacttccacattttagcacatgtgaataatgctatgaatatgagtgcacaaatatctgttcgagaccctgctttcaattattttggatatgtacccagaagtgatattgctgtgtcatatggtagttctatttttaattttttttgagaaactgccatattattttccatagtggctgtaccattttacattcccaccagcagtgcacaagagttccaatttcttcacatcctcaccaacacttatcttttgactttttcacaatagccatcctaacaggtagttttcatttgcatctccctgatggttggtgattttgagcatctttttaatatcttttggctatttgtatgttttctttgggaaaatgtctgtacaagttctttgcagatttttaaatcaggttgtttgatttttttccccttgagttaaatgagttccttacaattttagatattagcctcttattggatatatggtttgcaaatattttcttccattctgtaagttgccttttgattttgctgattgttttcttggtgtatttttttttagtctatgctgccaatttctttcttttaattggcatatttagaccatttacattatttgtaattattgatgtgttacagcttaagcttgccacttaaatttttattttctgatctatatacacttttaaaacctttttaaaaatatttatttattagagacagggcctcactcttagcacccaggctggagtgcaattgtagctcactgtaacctcagactcctggactcaagtgatcttcctgcctcagcctcctgagtagccaggaccctaggcacacaccaccacactcagctaattttctttttctttttaatttttttgtagagacagggtgtcttactatgttgcccaggctcgtcccgaacttctggcctcaactgatcctcctgtcttggcctcccaaggcacggaaattacaggcgtgaaccattatacctaacctctgctttatattttagtttacttttagttttacagaaaaattgggaagatagtacaaagagttgccatatacactctacacagtttcccctagtattgccatcttatatagtacctttgtcataagtaatggaccaatattgatacatcattattattaacctaaaatcaatggttaattccaatttcctttgttgttacctaatatcctttttctattccagaatcttacctgtgatatcacattacatttagttgtcatatctccttggacttcatttggccatagtagtttcttagatatatttttctttttgatgattttgacagtcttgagactacccatcaagtattttgtaggatacctatgtattagattttttctgatatttttctcatgattagactggggttatgggtttggggaggaagatcactcagataaagtaccattttcattacatcgttatcaagggtatatactgtcaatatgatttatgtatgttgatattagccttgattagttggctgagtattcatcaagtgtttacaccttgaagttatccatttttcctttttacatactatattctttgcagttgtggagttatgctcccctgcttaaaggcatacttatctagataaattattttgaattcttctacatgggaaatttgtctcttctccctaattcgttaatttgttcaaccatttttatatcaatacggacttgggaatatgtattttattctttaggttataattcaatactacatttttgttgttcagattgttttagctttggccattgggagctcttttaattgactcctgcacccttttgacataccccaatcagtgtgggtggttttgttttttataagcaattcctttctttctgacaacacagaatgttctaggttcatcttgcacatttcttgccccaatcctggaatcaaccatttctcctaggaggtctagttcctctcactggcaaagtatattagtaaccaagatctgaatgttagttgtgcttgttgctactggggtgtcatttcttctaggccttattagttgacggagcaaagaaaatatatgtgtgtatactaatctgagtatatagacatatatatataaatattttggtatgtaaacatctgtatctatattaagttaaacgtaagttattactgatgtttcctattctaattcattagcacttagatcattctagccttgcttgcagattacccttgcttatctgttcccaatccaacagtgggaaacctggctcttaccatccatcattcatttacttaattttttaattgttcaattttagtatacatgtaaagcagtatcagaattgttcacctgtaccctcatgagaaacaactttgtcaactagagtacagtgcttatgtgcagttctttttgcctttattcttacagactctacttatttccagagttacttaggtcagtatctagtcctcctatttcctttagtgaagttgttccacacatttgttagagtctcttgtcacagtctctattatatctgaggattcccccaacctcccaaattatatatatatatataaaatatcaaattatatataatatatataatacctagttatatataactatatatataatttgtatgcattgagattgacttgttgtgtggtaaagtcctgtggattttgacatgcataatgacacgtatctgctattatagtatcacacgtagtattttcaccatcctaaaaatcctctgtgcctcatctcttcatcttcctgagatgctggcaaccacatcttttcactctctatttttcttactggctcttctttttgcttttgtgccatttctgcaatgtcacataattggaatcattcagtatgtagtctttttagattggcttcttccacttagcaatatgaatttcaggttcctctatgtcttttttgtgactgatagctcatctctttgtttatctatttacctattggaggacatcttggttgcttcctgtgtttggtgattatcaataaagttgctgtaaacattcacgggaagatttttgagtagatctaagttttcaaatcaagtgggtaaattcctagcagtgaaatggctcctgtaggtaaggtatcatttctctttctgtgcattcaagatttttttctttgtcttaggatggaatttgactatgacatgtcttaggatggaatttctttggatttatcatgtttggagtttgcaccgctctttgaatctctaggtttatgttttttcccaaatatttgagacattatttctttgaatatttatttgttctgccctacctttcttctcctcttccagggttctgatgacataatgtacattttttgttgtcttacacgtcgctgaggctccatgcagtttttttttcagtctgttttctctctgttgttcagatgaggtaatttctacttttttatttttccttctccttccttccttccttccttttctttctttttcttcctttctttcctttctttcttttctttgaaacaaggtctcactctgttgcccaggctggagtgcagtggtataatcatagctcactgcagcctcaaacacatggactcaagcagtcctcccacttcagcctgccaaatagctgggattacaggcaccaaccactgcacataattctgctttatttcaaattcacttattctttcctttgtcctctccattctgctgtaagctcatctgttgagttatttttaagattttggttattgtatatactagttttctgagtattgtaacaaattaccacagatgggatgacttaaaacaacagaaatttattctctcacaattttggaggccagaagtccaaaatcaaggtatttgttggctttttttttttagattaaaaagacttagatattttaatcaattgaaatgtatgaatcttattcagatcctgagtcaaacacttaaaatcaataatgtatgagacagttacataaatgtgaacagtaattaaatacttaagaatattgaggatatcttgttaagttttaaactgtaatgatagtattatgtttatgatttttacaaaaaatagtttctatctttaagagatagataattaaaatacttggaagtggattaataggatgtcttgaatttacttcaaaagcatgagtgtgtgtgtgtgtctgtgtgtgtgtctctgtgtgtgaatgaggtggaaagatgggttaaataaaattggctttgatgttgttacagcctgataataatgatgtgtaggttcattacattattttctccactttggtatatatttgaaatttgtgtagcagagagttaaggaaatacttattgattcaaagtaaaccgatctaatcataacccttgcaaatggatgtctacctatgtataaataaggtacttctttttttaaaactatgggtctctttttattaaggcgagatctcttgcaactggtgtttcatgaatagagttgccagataaaatacaagactcggttaatttgaaatttcagataaacaatgtctagtattttagaataagcacatcccagctattgcactggacacactaatactaaaaaaataatttttgtttatcttaaattctaattttactggggcattctgtatttttttttttttttactttaagttctggatacatgtgcagaacgtgcaggtttgttacataggtatatgtgtgccatggtggtttgctgcacctatcaacctgtcacctaggttttaagccccacatgcattagctatttgtcttgatgctctccttcccctcaccctcacctcccgacaggctccagagtgtgttgttcctttccctgtctccatatgttctcattgttcaactcccacttatgagtgagaacatgtggtgtttggttttctgttcctgtgttagtttgctgagatgatggcttgcagcttaatccatgtccctgcaaaagacatgatctcattcatttttatggctgcgtagtattccatggtgtatatgtaccacattttctttatccagtctatcattgatgggcatttgggttggttccatgtctttgctgttgtgaatagtgctgcaataaacatacgtgtgcatatatctttataatagaatgatttatattccttgggtatatacccagtaatgggattgctgggtcaaatggtatttctgattttagatccttgaagaatcaccacactgtcttccacaatggttgaacaaaagctgaaattgacaaatggggtataattaaactgaagagcttctgcacagcaaaagaaactatcatcagagtgagcaggcaacctacagaatgagaaaaaatttttgcaatctacccatctgacaaaggtctaatatccagaatttacaaagaatttaaatttacaagaaaaaaaaaaccttgtcaaaaagtgggcaatgaatatgaacagacacttctgaaaagaagacatttatgtggccaacaaacatatggaaaaaagctcagcattactgatcattagagaaatgcaaatcaaaaccacaattagataccatctcacaccagtcagaatggcaattattaaaaagtcaaaaaacaacagatgctggcgaggctatggagaaataggaacacttacactgttgatgggaatgtaaattagtttgacttttcattttattgaagttttctttgcagtgcagaagctttttagtttgacatagtcccatttgtttgtttttgctttaaaaattttttttgcctttgcttttggtgttctatacaaaaaaatccttaccaaggccaatttcaaagagcttcttccctatttttttcttttaggagttctacagtttcaagtattacatttaagtttttaatgcactttctgttgatttgtgtgtgtgctgtaggatgtgttcaatttattcttttgcaggtggatgtccagttgtccaaacacatttttttttgagacagagtctcactccaacacccaagctagagtgtggtggcatgatcttggctcactgcaacctgtgtctcctgggttcaagtgattcttgtgcctcagccctccccgcatagctggaattacaggcatgtgccaccacatccagctaatttttgtatttttagtagagatggggttttgccacattggccaggctggtctcaaactcctggcctcaagcgatccaccaacctcggccttctgaagtgctgggattacaggagtgagccactgcacccagcccaagcacaaaagagactgtgctttttccattgtgtattttgggcacctttgtcaaatactagttggctatatatacttggttttttggggtttttttctgggctctcgattctgttccattggtctatgtgtctgtttttatgccagtaccatactgctttgattactatagctttgtagtataatttgaaatcagaaagcgtgatgcctccaattttgtttttgtttttaaggttgctttggcacagagtcttttgtggttccatacaaattttaatattagcttttctatttctgtgaaaaatgccattggacttaagatagggatttccttgcatttgtagatcactttgagtagtgtggacattttaataatactaattctttcaatcaatgaacacaggatatctattttatttttgttttcttcaatttcatcaatgttttttagttttcagtgtacagatgtttcacctacttggttacttttattcatatatatttgagatggagtctcactcactctgtcacccaggctggagatctcggctcactgcaacctccacctcctgggttcaagtgattctcctgcctcagcctcctgagtagctgagattacaggcatgcaccaccatgcccagttaatttttgcatttttagcagagacagggtttcaccatgttggccagtctggtctcgaactcctgacctcaagtgatccaccctcctcagcctctcaaagtgctggaattacaggcatgagccactgtgcccaactattttatatatttttgatgctattgtaaataggattgttttcttgatttcctttttggatattttattgttggcacaaagaaacgcttctgggttttgtatgttgattttgtaacctgcaactttactgaagtaatttattagttcttagagttctttggtggagtctttagagtcttccgtatataggatcacttggtcccatggaaacagttttttagctcttccatttgggtctttgatccattttgaattaatttttgtatatgatatgagataagaatccaatttcattcatttgcatgtggaaatcccgttttcctagcaccatttgctgaaaggactgtcctatcaccatttgctgaaaggactgtcctatcaccattaaatggtcctggcacctttgtcacaaataatttgatgatatataacaagatttatttctgcgttctctattccattccattggtctatatgtctatctttatgccagttccacacattttcattactatggctttgtaataagttttgaaatcagaaagtacaaatcctctaattttgctctttgttttcaagtttgtttagggcttttggggtcccttgagcaaagtccatattaattttaggatggattttttccatttctgcaaaacacatcattgggattttggggtttttttcagacagggcctcagtctgtcgcccaggctggagtgcagtagcccgatcacagcccactgcagccttgacctcccagggtcaggcagtcctcccacttcagccttgctagtagctgagactacaagcatgcgccatcacagctgccaattttttgtagagacaggcttttgccatcttgcccaagctagtctcaaactcctaggctcaagcagtctgcccacctcagcctctcaaagtgctgggattacaggcgtgaaccaccacacctggcctgggattttaatagggataaatatctgcaaatctgtagatcactttgggaatatcaacacattaacaatatttagtcttccaacccgtgaactgtttacatttttaaatagaagatactagtgtattatttgtgtaatcaaacataaacaagtttttagaaagaggttttggccgaggaactagtaaatttctcatgtcttttcatgtaacttcactggatctcggtaaccaatttttaaagcttgcaatcagttctgggaaaaacataaattagatattaggagagaaatgattatctgactataggtgttaatagaaaatgtttatggcttaataaactgaaattaaattaaatcatgtaatattgacaaattaagcttatttagacatttaataacattacctgagttcagatatgcttttatctggcttattttgctcacactgaaatacattttagtcccattgatcaataaccagtttttctgttcgcattgcttaaaattgtgtctcattgtacagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttaggtcagtaggattttcgcaagtgttttagaaacgtattaatttgtgtataattcttagatgtcagagtaatagcaaaatcctcaagtcaatggatttcttccacttcctttttttcttcctccctaatggtcttttaacagtaacacctcacctgtccacatcccacaaattgggcaagtggaatgagaaactaagcaaaaataagaaaccatcattgaaaacagacaaacttctgagcttaaagctcacatgtggtggaatattgtgaggttacaagcctaatttaatatctctagtttgatctcaatttagctgtgtacctttgaacaagtcaaaggaccttgatttttttttcaactataaaatgatgattgtgaactaaactcctggtttctaacttcttttcagcagcagcatccttttgtgatgcaatcttatatgaaccccaccctgaatgaaatagattagagtttttctggttaaagcagagatgtagagccaaatctgctcagcattcccctaatcctctgcctccctgcagaacttctgtaccctgaagaacacagatagtaagatccctttcttagaaaattctcttcaccacttcgtccttccaactaagtgcatgtagagatataattggagtgatagtcactaaatgttaactctggggtttattctgaatggtggcattttaggtgacgtgttgctttcttctaaatactctaccatattgtttgaatttttataagcacaattcatgtttctataaaaacaaagtcattaattttttaaaggaagtcatctgagtagatgatctctaagagccatattttactgataacaccctccctccaggcatttaccaattatttttagacccagttttgataaacttggttatccggttttcctactcttaacattttaatggtagcactttgcaaatagagaaaaggtttaaagggaagtatacagatagcctgaccatagggaggaaaaaaaactctaccaattttataaaacagattcaaatttttaatacaacaatctgtactgtataacaactcccaaaggcatcactgtgatatattaatagtacaataaaataaaatagttgttaatgttgacctcaagtggtcaagaaaaagttgaattatgcttaagaaaactaggaagtttgtttactttttagaaaatttaagaactttcatgaaaatattcagactttttaaattcagaagtgatttttatttaaagaaagtaaactgccagttgaccagaaaacttgattacacagaattactcattttcctaaaattccacttagactgttctattatgacatctaagttacacttacactctcaaagtattataatatttcaagtagatacatttagtagctgtttactctcatgtgagtatttttaagtaagtcatggaacaaactacatttgctgactgggctagagggtcagagattcctaatgttctagtcaagacttttgtggaaattgatagtttatgccaaagggcagaagaggaggtgcagaattctattatagtttagactttaccttaatgtgctaatgtatttgaactctgtaaatgtctagaccagaaacaatcaacgcaagttaagatttaaagtaataaagtttatgtgtaagcatggtcttaaagtattttacaaaggctttaaggcataattggcctttcttgtgaacttgatctgatctatttagcacataatagtataagcacttcttattaatgatttctggcattgctgtctgctcattcacaataaccttattaaggcaccagatgatgatctaatttggaatgtggaaaatcagttaaaaagagagtaggctggaaaactatcacagattgatgggagaattactgtgattctagcaaactctgattgcattatattatcaattatggtagtaaacctaaaattgatgatgaaaacctgtctgaatttttttgtgtgtagccattacttaaagattataggttctgagtatagttagctctctttacttaatgtaatagaccgagattctttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagatagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgaccccccccacctccctcccggacggggcggctggccgggcagaggggctcctcacttcccagtaggggcggccgggcagaggcgcccctcacctcccggacggggcggctggccgggcggggggctgacccctcccacctccctcccggacggggcggctggccgggcggggggctgacccccccacctccctcccggacgggcggctggccgggcggggggctgacccccccacctccctgcctgacgaggtggctgccgggcagagacgctcctcacttcccagacggggtggctgctgggcggaggggcttctcacttctcagacagcgcggctgccgggcggaggggctcctcacttctcagacggggcggttgccaggcagagggtctcctcacttctcagacggggcggccgggcagagacgctcctcacttcccagatgggatggcggccgggaagaggcgctcctcacttcctagatgggatggcggccgggcagagacgctcctcactttccagactgcgcagccaggcagaggggctcctcacatcccagacgatgggcggccgggcagagacgctcctcacttcccagacggggtggcggccgggcagaggctgcaatctcggcactttgggaggccaaggcaggcggctgggaggtgaaggttgtagcgagccgagatcacgccactgcactccagcctgggcaccattgagcacgggagtgaacgagactccgtctgcaatcccggcacctcaggatgccgaggctggcggatcactcgcggttaggagctggagaccagcccagccaacacagcgaaacctcgtctccaccaaaaaaatacgaaaaccagtcaggcgtggcggcgcgcgcctgcaatcgcaggcagtcggcaggctgaggcaggagaatcaggcagcagtaccgtccagcttcagctcggcatcagagggagaccgtggagagagggagagggagaccgtggggagagggagagggagagggagagggagagggagacaatagaccgagattcttattttcagagcttttttttttttcagctcaccaaacaggaagacaactgacagcagaatcaatgaactggttacacaacattctgtggagacaagctgccagtagttttgaggtttgagaataatctctttttcattctttatttctccactgcaacaaaaaatagtgcattcactataaaaataaaagagcatcaaatacttcaataatctctgtctgtttagataccatatatttattaaatattcacaatatagagtgttaatgagcattgtgcaagagtttattaaaaataataagacatgattcctctccattgagagcttacagtgtagggaaatgtcatcgctgatattaagatataagaatgtaatttttttaacatgagggctgagaaagagttttattccctttaaaaacttaatggtgtaataaaaaatggaaaaaaaaaacctttacaagacaactcaggtttcctgtaaacctaaagataagtttttttaaagcaaagaacaatcatttataattttggtatatttccttctaatctttgtgtattatacatttgtgtccctgtgtatataaatcagatgggacgtaccattaaaaaaaaagttgtgtttgcttccacttgcaattaatatgtagtaacagggactgttttatgtcccttcttgaacaacaagcccctctccacaaaggacaagacaaaatagacgaaaagaaaaaaaaaggcttttatgaccctgaacatcaggcaatgaaggagaatggtccctgggagataagaaataaagcgagcattggccgggcgtggtggctcacgcctgtaatcccagcaatttgggaggctgaggtgggcagatcacaaggtcaggagatcgagaacatcctggctaacatggtgaaagcccatctctactaaaatacaaaaaattagctgggcatggtagcacacgcctgtagtgtccgctactcaggaggctgaggcaggggaatcgcttgaacccgggaggcagaggttgcagtgagccgagatcgcgccactgcactccagcctggcgacagagcaagactccatctcaaaaaaaaaaaaaaaaaaaaaaggaaagaaaagaaagaaagaaagtgagcattacaattgtgcagcttactgctttgagtttccagggtatagcacaagaaggggatctgaagcagagcctggcaagcgtcctgatttgagatgcagctgagtctgaggagaccaaggcagccagaatttataagacaaagtactgaagaggaccacatagcgtagattaggcattgtaaaagaaaagattgataaacttgaagtcagagcaaagaagctattcaaaattaaacacactgaataaaagacttaaaagagcttcagtgagatgagggtcctcttccaatgtttaacagagttctgatcaggacatacatgaagcaaaattacctgaagctaggagaataaccatctaaaaatattagcgggaacagtgcctagcactcacatggggttgagaataaggcctgttcttatcacccagtctggaaaacctctaattcatggggcattgggaagaaaactcagaagggtcttgtctcagaagaggggaataattagtcctacactaagtcctgctccagaactaccttaaaaattataaacctatggtgtgaaaggatcaaattgatcccaaggaacttaattgcttcccagagcagagttcaagaatatttataggaatataaaactgtacagcacccaacaggataaagtttacaatgtctggcatccagcaaaaaaattactgagcatgtgaagaggcatgaaaatgcaacctataatgaggagaataagcaatcaatcgatactgacccagaactgacatagaagttagcattaacagaggacatctcttataattgtatttcatgcattcaaaaagttaagtggaggcatggaagatatgtaaagacccaaatcaaacttataaagatgaaaactctgtttaggatgagaagcacattggacagtattaacatcatattagacattgtagaagaaaagactgatgaatttgaagttatagcaaagaagctattgaaaatgaaatacacagggaaaaaacccttaaaaaaattaaaagagttcagtgaggttagggacaattttaggtagcttaatatacgggtaactgggattcccaaatgaggatggagataataaatatttgaagaaataaaactttcaaaacttaatgaaaactctaaatgcacagatagatagaaaaatcttaacaaaccccaaacacaagaaacacaaaacgacaccaacgcacgtaatcaaaattctcaaaaccagtgataaagagaatgtcctaaaagcagccagataaaagtgacaccttatatacagaggaataaattaaagagaacgtcagatttcttgttggaagtaatgcaagcaagaactcagtggagcagcatctttaaaataatgaaagaaaattaaaacctgtcagccaaaatttctgtatccagcacaagtattgtttaaaatgaaagtagttggtacaaatgtaaaatagtgtagccactatggaaaacagtatggcagctcttcaaacaattaaaaatgttattaacatatgatgcagcattttcacttttgcttgtatatccaaaagaattaaaagcaagatatttgcacacccatgtttatagcagccaaaaggtggaagcaacccaagttccatcaacaaatgagtggataaataaaatggggtatactcaaacaatgaaatattacttagccttaaaaagcaaggacttctgatacatgctataacatggatgagccttgaggacattatgctaagtgacataagcctgtcacaaaaaacaatactgtgtggttccacttacatgaggtacctagagtagtcaaatccgtggagaatgaaagtagaatgggccggatgcggtggctcacacctgcaatcctagcactttgggaggccaaggcgggtggatcacttaaggtcaggagttcgagaccagcctggccaacatggtgaaaccccgtctctactaaaaatacaaaaattagccaagtgtggtggtgcacgcatgtagttccagctactcaggaggctgaggcaggagaatcacttgaacccaggaggcagatgttgcaatgagccaagtttgtgccactgcactccagcctgggcaacagagcgagactctgagaaaaagaaaagaaaagaaacagaaaggaagaggggaagagaagagaagagaaacgagaagagaaagaagagagagagagagaggaaaagaaaagaaaaagaaaaagaaaagaaagaaaggtggtttccaggggctaggaggaggggaaaatgtggagttgtttaatgagtatagagtttcagttttactagatgaaaaagttctggagattggttgcagagtagtcaattttatgctatgtgttttttaccataataaaaatatgtttttaaaaaatgaaagcaaaatagtcttccagacatttaaaagctgaaataactaatcactcaaagatctacattacaaggaagtcctctgagcagaaggaaacttacaccagatggaaatatgaatctatacaaatgaataaagaataccagaaatggtaattatatgagtaattgataagatttttttcatattattacaatctctttaaaagatagtttattgcttaaacaaaaataataacattgtattctgcagtttataacctgtaaaagtaagatgcatgacaagaacatataggccaagaagagagaaatggaagtataccataagtgaggtggtataacatcacttgaagatagactatgataagttaaacatgtatactatgtaccctaaaacaaccattaaaatagcaaaacaaagagttttttttaaaaatgagataaaatcaaatcataaaaatattcaaataatctaaaataaggcagaaaaaggaaagacggatcaaaaaagatggcacaaatagaagacaaatagcaagatgatagatttacatctaagcatatgaaaaaaaaatcacattaagtgaaaatgacctcaagaccccagtgaaaaggcagagattgtcaaactggataaaagagcaagacccaagtttatgtactgcttaaaagaaatgtactttaaacataaagatacaaattggttataaacaaaagcatcagaaaaatatagagagacaagattgttctaaaatttatatataaaacaatggaatgaaaatagccaagatacattattaaaaagtcaaaaaataatagatgctggcaaggttgtagagaaaaaggaacacttatatactgttggtgggagtgtaaattagttcaaccactgtggaaagcagtatggctatttctgaaagaactaaaagcagaataccatttggcccagcaatcccattactggatatatacccagaggaataaaaatcattctatcataaagacacatacatgcaaatgttcattgcagcactattcacaataggaaagacatggactcaacctaaatgcccatcaatgacagactgaataaagaaaatgtggtacatatacaccatagaatattatgcagccataaaaaagaaaagatcatgtcttttgcgggaacattgatggagctggaagctatcgtcctgagaaaactaacacaggatcagaaagccaaataatgcatgttttcacttataagtgggagttaaatgataagaacttatgaacacaaagaaggaaacaacagacactggtgtctacttgagggtggaggatgagagaagggagaggagcagaaaagataactattgggtactaggcttaatatctgggtgatgcaataatatgtacaacaaacccctgtgacatgtgtttacctatgtaacaaaccttcacctgtacccctaaacctaaaataaaaattataaaaagaaaatagccaaaacaacctgagagagaatagaacagaaagaattaccctattcaatttcaacactttttatatagctacagtaatctagactgtgtggtatcattagagacatagatccatagatcaatggaacagaatggaaaaccaaaaaataatcccacacaaatatgctcaactgatttttgagaaagcacaaaagtaattcaatggaaaaagatggtgttttcaactaatggtgctggagaaattggacatccatagaaaaaaaaaaacccttgaccttaacttcacattttatacaaaaattaaatagattataaaattagatgtaaaatgtgcaataaaaatacataggagaaaatcttcaggatctaggccaggtcatgtgcagcctattccctgcatgaactgcacttgatatgtgactaaagacaaggatgttaagaagtttatcattcaaaatatggtagaaagccaagtgtggtggctcctgcctgtaatcccagtgctttgagaggctgaggcgggaggattgctcgagcctaggagtttgggaccaaccagcctgggcaatataaaggagcaccatctatacaaaaataaaaaatttagcctggtgtggtagcatgcacctgtagtcccagctactcaggaggctgaagcagaaggatcctttgagcccaggagtttaaggctgcagtgagctgtgatcatgccacttcactccagcctgggtcacagagcaagatcctgtctcaaaagctaaaaacaaagaaaacaacaaaacatagtagaggccacagctatcagggacatagctgaagccagtgtctttgatgtctatgtgcttcccaagctgtttgtgaagctacattactgcatgagttgcaccattcacagcaaggtagtccagaatcaatctcgtgaagccggtaaggaccaaacaccccaaccctgatttagacctgtgggtgctgcccaccaacctccaccaaagcctacatatggagctgagtccttaaggactgaaaaaaaagctatcctctgaagaaaataaagtgaaaattatactttaaaaaaaagagatcctgttgaatagatgaaaaaagctagagactgggagaaaaattttcagaccatgtatacaataatgggctagtagctaaaacatagaaagaactctctaaactcaatgtacaaagaaaaacaattcaaaaattagcaaaggatatgaacagacatttcaccaaaaagggatatatgcatgaaaataagcacccaaaaaagatgacttatgagtcattagggaaatgcaaacgaaaaccccaaggagataccaatacataattcttagaatagccaaaatggaaaagattaaccataccaaatgctgacgaagatgttgaggaactggaacttcatggtggaaatataagatagtacagacggtttggaaaatagtttggcagttttctaaaatgttaaacttgcccctatcatgtgatccagccatttcaatcctatgtatgtactcaagagaaaaggaattatttatccatacaaaaacttgcatgtaaaagctgatagcagctttatttataatagttaaaaactggaaacagccaaatgtccatcaacaagtgagtggataaacaaactggtatgtccttcaatgaaatactactcagcaatgaaaaggaatgaactattgatagatgcaataatggggataaatctagaaactgttttgctgagcgaaaggggccaggcaaaaaagtattaatacatattagatgattccattgtataaaagcctataaaataaaaattaatagttatagaaagttatagaaagcacatccataactgcttggggtatgagagaccagaatgaactggattgagggattacaaagaaaaaatggttgtgatggatgtgttcactccgttgactgtgttgatggttttagctatgtgtgtgtgtatatatatatatatatatatatatatatatcaaaacaattgtacagtttaaatattcatagtgtttcatatgtcaattgtacctcaataaaactgttttccaaaaaatgttatggtaggttttgtaggagaaagatgtgaagagaaaaaagggaacaaaatctgagaaacaaagaattagacccaagagaaggaaagagaatcccttataggagcatgtagaaacctaggtcttatggttaggtaccacaagatagaatgatattcgtattctcttttagaaggcctttatttatttttttactgaataggtgaagaactacttcagaattcccattcttctattgattctttttctttcctctcattttccagtcttgctgaataattttcttaaaacatccacttccaacactggagaggaatgtaatcttatttctaattgactatttctaatatgacatatttctaatctactatgactaatgtaatagtcaaaggcagtgttttacctatttagcataattgtttctagttgaagagggtgttttattccttgaaggtcctaatggctcctattcttaattgaaaaatatgaagcttcttgatagggtacaagggaatcatttaccttaccttggtttataagcagtctcagttttcttagattaagaaataattatccaggttattcctatcagattttccctagctagcttcttaccattgaaaattttaaatttactcaagagaaaaatgtatttttatatacaaatacagcagcatcaattacaatagtaaaaaccctgcaaattcactaaatagctaacattaagaaaatcattatatacttgattaaatgttatgtatctcctaaaattgattactgtgaagactacatagcaacatagattaatatgtacaaaacaaaattaaatggaaagaatagaacatgaaattctatataagctacgattacaactaggtaaatatacaaaagaatacagttaaaattgaacatagataaatgaaaatagctgcattagcatggtgaattatgggtgttctcttttaaaatttttgtcgttgttgttttaataacttttaaaatagattttaagttttctggggtggtttactacactcttagactcttcatcctatgtgtgaaatttctaatgtgtaggaaaaagaaagaatactgattgccaccttatctaaaacttatgttgaccaagactgataataaaatgcacttagaaccctatataaaggatattgtgttttgattgcctaaaaaagaaaccaacagcatcttttatttgtttctagaggtgacttgggaaagatagggtagcgacatcgctgtgattttgttgtttctttttaaactttaggtacaaaattacactgatgccctacaatggtactattattctctgaggttttattcaactgatgaaatggatctggacttcaccaagctgcagaggaacatggcttgctgttacctgaatttgcaacaacttgataaggtcctttgatttatctattttcagaggtagcaaatgttcttatgtgcagtggcagagagatagatgccatgctgtgacttcctggctgttagtttaggatgtctgagagttccctcatatagaacaaggtcaaattgacattttcttgatttgcacactgtaaacatagagtgaaacttcccaaagaaagagagaatttggaataccattaattctattacttaccctttatttttcacacctattctgaaaggtaatatatcattggaactcctgaacaaagttatctgctactaaccatctgtaatattgtcctttgcagcaagctaaattttgaagtacacacttttgtcaagcattcattgagaccaaatacttgaatgaagtggccattctttcactttctaggttgttatctcttgcctttccaaccaccctagaaaatgttctttaactgatttcttatcaggacaaaattctagaaggtaaagaagataaaagcttgtttaaagatagaacggaaatactttccaaagcaattaggacatttcttcctttggttatcatatggtatgcacgtaatgaggggtattggctcttagaaggacaaagaactagaaggacaagtgtgaacccaaatgaaatatgaaggtttttgttgcctttcaagttttaatgacaggtctaacctttgttcacctaggtgattaagggtaatgattccagatgttttctttgaaggtttatttttgaagagttgtttatctgacttaaatactttagattttctttcaagaaaatatttgctatttagtttatatgttataaagtcacagccctggaagagaacttgaaatgttacttaattcatcataatgttgtacaggctagcatttaactgtttcagaaaatagttacctacagtttaagatctaaaaggaagatgatcatgtagattttgttacctaattctgcacaggacagcactatttcagaaaggtagttgcctactgtttacttaaagactaataaagaaggcaatcacagagcctttataacttccatgatttatgacacagtgagctaggcagcttgggaaggacctatatctggatgtagacatgctagttggggaatggatgcatttgcaggccaagggaggatatctaatcagccagtcaggaaagaaagaaagaacacagtaccagacattatgctaggctctgaggttacagagatgaacaaagtatagttgccttcaactcactcaagcagctgacatcatggtatcctaatgggcagataagcagagcatggcaatgagagaaatctaaatgttggaaatagtccgtaagtcaggcacacaggtggttggcatcacataaacataacagcagggaacagggtttcaatcacagatatttggactctgagacagtacacaaatctttgaggaataggagtgtgtgcagacatactagaaagagcaaagtagatctccacaactaaaggggccaggatatgaggctgtttttaagagcagatcccctgcatagggagccaaactgggaagcaatgaccagaagaggaatacaagttgactagatacagttttctgagacttaagcaatgctacttacatctcttctaatgtcaagtttggtcctagagcctagtatagcactgactttataattggaaattcaaatggtattaatagtgaggttaggaagaataggagaacagtaaaccaggtgtattttaatggtgcgtactcaatatgtaactgtatcatttatggccagattagtggtgaaaccaaaggatattttgaatatattcaaggtaactttgttggttactgttagtatatttctccatttcatccttgtcttgaatttagcagacattgattggataccctccatatacaatgaatatcctcttatgcactaggacagacagaaaggtgaaaaaaatacacaatccatcatattttaataatcccacctcgccagtgtctaacctttgttagctttcattgtctttcttcactccttcctttgagttgcttgagcattgttgggaaaatttatgaaaccatgtttattgggtttgctaaaatttcatggtttttcagctaggtagtcaataatactgactcttgttgagtttttatcacattccccacagtgataattccaaaacattttttttctgtccttaagcacccatgctttctcctttgttgtagcaaaagatcttatcgtgtgatttgctgagcttgtagccactgacatgaacttcatcaatttctcacctcttcacccatcctttcttttctcttacctacgagaaagaagtaactttgtctggggaccttactctacagatctcaaccctagctgtttaatcattctctactgtttcttttttattttttttttttgagacagagtctcactcttgttgcccaggctggagtgcaatggtgctatctcagctcactgcaacctccgcctcctgagctcaagcaattctcctgtctcagcctcctgagtagctgggattacaggcatgggccaccacgcctgggtaattttttatatttttagtagagacagggtttcacctttttggccaggctggtctcgaactcctgacctcatgatctgcccgcctcggcctcccaaagtgctgggattacaggcgtgagccaccgcgcccggcctactgtttctttctcctgtcactataattaccttgaagtcttctttatccaaaaaccttccttcaactttgtaatcctcctcaaacttcagttctgtgtccttctttttgttgccaaactttctaatccaattttttagtgttcattcattcaaaaatatttatttattgtctcctatgtgttaagtactgttctaggcattggggatatagtaatgaacaaaatatataaaaacctttatccacatggacaaatactgctgtccccattattttccactaggagaggcaaacaataaaaagataaataagtattatgttatattataggggtcaacaaactttctgtaaagaaccacagtaaatattttaggttttgcaggccatacagtctgtgctgaaactaatcaactctgttgttgtgccttgaaaatagccatagacagtatgtaatcaaattggtgtggctgtgttccaataaaactatgttttggaatactgaaatttgaatttcatgtaatttttgtgtgtcataaaatatgattcttttgatttatttcaggcacttaaaatgtaaaattgttctaacttatgaactgtacaaaaaatatggtgagccagattttgcccaaaggctatagtttgttgactcctggtatattaaatattgataagtgctaaggagaaaactaagcaggaaagggtgatattaaatgtttcagaggcggatgaatggttgaacttttagatagggtggtcagggaagtcctcactgagaagattgtttttaagtagagacctgaggaaaaagagcattccagatggagggaataacaactgcaaaggccctagggtatttaaagaatggcaaagagacctttgtggctggagctgagggaacattaggagaattaggagatgtgatcagggaagtagtggtgtcttagtctgtttcgtgttggtataacagaatacctaagactgagtaattaataaagaaaataggtttatttaagctcatgattctgcaggctgggaagttcaagggccatggtgctggcatttgcttggcttctggtgagggcttttgtgctagatcaaaacatagcagaaagtcaaagggaagtagactcatgccaggagacataatccaaggggctttctggctttataacaacctactttcatggaaactgtttctgttttatttccttgtatactatgtttgtcctcaactggagtacttgctgcttcctagccatgatctatgttttctacctcagtatcttttttcatgcttcttcattgcaaattacctctttcctgcatccctaaaattcccttttcaaagcctagcttaaaattccctttttcaaagcctaactcttaatgacattcttagcttcctgaggaaatttccttgtcttgcctttcctccaagactttgtaacagttctgtttatccctagatacttgttttctcattatattttagttatttctatacctgccttagtcatctattggactgtcagtcacctccttgaggacagagaccatatcttatctttatttgcccttgtacccagcatagtgcctaatgcatagtagatgctcattacattaaaaatagttataaagactcaataaatacctgtcaatcaacttcttctgatataggaattccatttcctcatgctatttctgtccttgctactatgcataatttggaaattaatagtgattaagatctgtgagtgctctttgattatcagaactgaatgagattatattattaaaaatcatcccactataactttctccagctcagctcttttctcttttgagggtgagaacgcattttattttgatttaaaatgaaatattgaatcataggtcagaagttaatttgggcaggccaatggagttgagaaatagactcccttgaactttttagtagattaggttacagattcattagctcgcacacttggcaacctctttttgagataacaatgccaattatagatcatttctttggtttgttttctaaattgtataaataaaaattttttaattgctattatccattcagatatcttcagtactttgcatgagacaatattaaacaatgttgtttcatagatatcaactctgcctttgaggtgtttgtagtgccttaagcctggtatcctgattttgctatattatttttgaggatttaaaaatatttggtttgtgcaagtcataggtttgaatggattaaggatgaaggaaatgagcttgggttctaaatacagaagcagtttatcacaccttgatataatgggattttgctgcaaaccataataaaaccttaatgttagttgacagatggataatgacttgttttggtgatagtctgtgtaagttaatgggaatgcacaattgggtactctttaactcagtacagaagtcccatcctcagcttgcaactgcagtttaggtacatgaatgtcattagcactactatagtttgataaaactgaaccacactctcaaaccacagaatggctgtaagacttacaacagacacaaagatgagactattcatagaatatttatgtgacctaaagtgaagacagttatgtctcatgtgctggttatatattgtttctctttaccatataaagttcgaaaaatgagcttgggaccagcagacataaactagtgatattcactagatggcactgtggcctctgtacttcatcagcttgtgcttgactgattctgagggtttttttttttttttttgtaattcttaggtagatgtacctttcccacaaatgcatctatatggatgcaaaaaaaaaaaccactaaagaaacataagatgaaggtcagctgtgactcatttgatacagctatactgtaaaaataccctgactgagattccaactcaacaaatattaaatgcctaatctgtgccaagcactatagaataagtagaagacatgatctattctgtaagtgagcctaaaatattaatgcagaaacaatatttacatatataaaataattagaaaataataaaaggctgttcaatcacacatcattgtgtggtatgtaccatatgaacttagaataggaatatatagatgaggacgtttgtgaatattgattgaatgtacatatgatgtgaagctgaaaagggtaactgatttgttagaagatagagtcagatctgaagggaccttaataggttgaaatgatgagcctattctagcaagacgaagacaaacaggaaacaacaaaacatcctataattggatcccaaaaccaattgtacaagaacaaagtagataaaatatggctctaaaagcagcatatgtgagtcacttggtacattttattgactataagcactgcataagccaaaaatactaagaaagtttactcaaattaggttgaatcaatagagatttaatgtatagaaggagaaaaagtggcaatcaccctctattctgctctggttagaatatatctgaagtacagattcaatcaaacgcagactgaaaatattcagaaaaaagcaatttagaaaatagcaatacaacatagaaaataatgcaaatataaaacaatacagtgtaactactatttacagaacatttacgttgcattaggtgtaagtaatctagagattatttaaagtatacaaaaggatgtgtgtaggttatatgcaactactataaggaacttgagcatctgcagattgtgatatccgagggtgtcctggaaccaatcctctaaagatacgagggaacaactgtatagacagcccttgacttacaagggttcgatttaggatttatcaatcttatgatagtatgaaagcaatactcattcaataagctcctcaagttaccatggggttatgtctggataaatccgtcataggttgaaaatgcactttctatttaggatattttcagtttaccatgggtttatcaggatgtaaccccatcattagttgaggagcatctgtattgtattggattgaggggcaccacttataaaggaggatattgacaaacccaagtgtgccaagaggaaggcactgaggatggtgagagcactaaaaatcatctaatttgaagaataaaggaagtgtggatgttaaacttgggaaatggaagatttacgagaaacacgatagctttcttccaatatttgaatggctgtcagggagtaaagaaattaaatttatttcatgagtgtttccatgggtgagacctacaaggagtgagattttggattatcataaggaaaccctttcttaattatttgacctaccaaaacaatgaaatggattttcttaaaatagagtgaattctgtcttcttgaatatatttaagtaaagactgaatgacttggtataaatgttatagaggagattcaagcatcagaagaattttttgactaagagaactttgaggtatcttctgcccacatttttctgaaatatcagtataacctgataaaatgtattatagtcaaagaggattttgtgggggactaggcttattaatcactgaatttgaaaactaaaggaacccttgcaagtcattactaatttattttaaaatgaatttataaaaatataatttacatacaaaaatgcattcattttaggtatagttcaataattttgacaactttataccccaaatttacccactaccatggtctagatatagaagacttccattatcctgagagatttccttgtgttccttcccagtcaatcctcacctccactcccagccccaggcaatgactggtatgctttctatcactataggttagatttatctttcctagagtttcatataaatggaattacacggtatgtactttaccttttttttaaatctggcttctttcactcaattttagaattttagagaatctcttctggcttgtagagtttctgccgagagatcagctgttagtctgatgggcttccctttgtgggtaacccgacctttctctctggctgcacttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaatttggttgcattctccccgtcactttcaggtacaccaatcagacatagatttggtcttttcacatagtcccatatttgcttggaggcttttttcatttctttttattcttttttctctaaacttctcttctcgcttcatttcattcatttgatcttccatcgctgataccctttcttccagttgatcgaatcggctactgaggcttgtgcattctccacgtagttctcgtaccatggttttcagctccatcaggtccttgaaggacttctctgcattggttattctagttagccatttgtctaatcttttttcaaggttttttacttatttgccatgggtttgaatgtcctcctttagctcggagtagtttgatcgtctgaagccttctctcaactcgtcaaagtcattctctatccagctttgttccgttgctgatgaggagctgcattcctttggaggaggagaggcaatctgatttttagaattttcagtttttctgctctgttttttccccatctttgtggttttatctacctttggtctttgatgatggtaatgtacagatgaggttttggtgtggatgtcctttctgtttgttagttttccttctaacagacaggaccctcagctgcaggtctgctggagtttgctggaggtccactccagaccctgtttgcctgggtatcagagcggaggctgcagaacagtggatatcaggcaaatgttgctgcctgatcattcctctggaagttttgtctcagaggagtacccggctgtgtgaggtgtcagtctgcccctactggggggtgcctcccagttaggctacttgggggtcagggacccacttcaggaggcagtctgtctattctcagatctccagctgcatgctaggagaaccactactctcttccaagctgtcagacagggacagttaagtctgcagaggtttctgctgccttttgtttggctatgccctgcccccagaggtggagtctacagaggcaggcaggcctccttgagctgcggtgggctccacccagttcgagcttccgggctgctttgtttacctactcaagcctgggcaatggcgggcgcccctcccccagctttgctgccgccttgcagtttgatctcagactgctgtgctagcaatgagcgaggctctgtgggcgtaggaccctctgagccaggcgtgggatacagtctcctggtgtgccgtttgctaagacccttggaaaagtgcagtattatggtgggagtgacctgattttccaagtgccgtctgtcacccctttccttggctaggaaagggaattccctgacccccttgcacttcccgggtgaggcaatgcctcgccctgcttcagctcacgctcggtgtgctgcacccactgtcctgcacccactgtccaacaatcctcagtgagatgcacccagtacctcagttggaaatgcagaaatcatttgtcttctgtgtcgctcacactgggagctgtagactggagctgtttctattcggccatcttggttccatccctaatttttgtatttttaatagagacgggatttcaccaagttggccaggctggtcttgaactcctgacctcaggtgatccacccaccttgacctcccaaagtgttgggattacaggcgtgagccacctcgcccagccttttattgctattttagagtatataaaacaaaattataaaacaaaattaactgtaaaacagcctcagacaggtccttcaggaagtattccagaagaaggcattatcatagtaagtgacagctccatgcatgttattgcccctgaggactttccagtgggacaagatgtggaggtggaagacagtgatactgatgatcccgagcctgtgtaggtctaggctaatgtgtttgctcatgtcttagtttttaacaaaaagtttgaaaagtcaaaaaagattttaaagtgttaaaaatcaaaaatcttgtagaataaggatataaaaaggaaatttttgtacaactgtacaatgtttgtattttaagctcggtgttattacaaaatacttaaaaagttttttaaatattaaaaagtttataaagttaaaaagttacagtaaactccattattgaagaaagaaaaatatccttttataaattgagtgtagcctaagtatacactgtttataaagtctacagtagtatacagtaatatcctaggccttcacattcactcagcactcactgactacccagagcaacttccagtcctacaagctccatttatgtaagtaccctatacaagtgtaccattttttatgttttataccctatatttactgtattttttctaggtttagatatgtttagatatataaatacttaccattaaaattgcctacagtattcagtacagtcacatgctgtagagatttgtagcctaggagcaatgggctataccatatagtcatgtatagtaggctataccatctaagtttgtgtaagtacactatggtgttcacacaaagatgaaattgcctaatggcacatttctcagaatgtacccctgttgttaagtgacacatgactgtaccacattttgtttatcctttcatctattcattggacacttgggttgctttgacattttggctattatgaataaatacttctatgaacatagatattacaagtatctttttgagttcctgctttcagtttttttgagtatttacctaataatataatcattggatcatgtggtaattctgtatttaacattttgaacaatcatcctacttttttccacaatggttgtaccattttacattcccaccagtaatgcacaagtgttccaatttctccacatcctggtcaacactcactgtttttaagttttttgataaaagccatcctaatgggtttgaagtgttctcttattgtgtttttgatttgcatttccctaatgaccagtgatgttgaacatattttcatgtgcttattggccatttgtgtatcttctttggagaaacatctgttgaagtcctttacccatttttaattgggatttgtattttatagtggttgaattgtaggaattatttatatatttcagatattaaccccttaccaaaatatgattagcaaatatgttttcccattctgtgggttgtctttttcttagtgtcttttgaagaacagtagattttaaaaaatttttgatgaggcccatttatctgatttttcttttgttgactgtgctttgggtgtcatatccaagaagtcatttgcaaatccgatgtcatgaagattttcgcatgtgttttcttctaagacttgtatagttttagctcttatgtttacacctttaatccatgttgagttaatttttatgtgtgatataaggtaaagatccagcttctttcttttgcatgtggatatcctggtttcccagcaccatttgttgaaaagactgtccttttcccattgaatagtttgggaacccttgtcaaaaaccatttcaccatatatgtgagggttcatttctgggctctctattatatgccattggtctatatgtcagtccttatctcagtactatactgttttgattactatatcttcatagctaagtcttgaaatcaggatcccttgaaacttcatatgaattttaggatgggtttttttatttatgaaaaaaaaatgcccttggaattgtcatagggattacattgaatctgtagatcactttgggtatcttcatttttcagtgtttatcttttactgtggtaaaatatacattatcttcattccttcttaacttcaaattttttcttgtttttgacttttagtctcttttggcattattggctgtatttatttacttttgactttcttcttgttagtcttcatttctgaaatgacttcttttacttctaatattttccttagctctaccacctcatttctgagtttttctaattattactatgggtttttttgtttgtttgtttgtttttttgagactgagtctcgctctgtcgcccaggctggagagcagttgtgctatctcggctcactgcaacctccgcctcccaggttcaagcaattctcctccctcagcctcccgagtagctgggattacaggcacccgccatcgtgcccggctaatttttgtatttttgtagagatgaggtttcaccatgttggccaggctggccaggcggaactcctgacctcaggtgatccgccctcctcagcctcccaaagtgctgagattgcagatgtgagtcacgacgccccaccgctaattcttatttaggttgatctttcatatcttgtatcattttttaaatttttattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtacctacaaaggacatgaactcatccttttttatggctgcatagtattccatggtgtatatgtgccacattttcttaatccagtctatcattgttggacatttgggtttgttccaagtctttgctattgtgaatagtgccaaaataaacatacgtgtgcatgtgtctttatagcagcatgatttatttttaaatgtgtttagctcatttttaaatagtcggttatgattttgacctgttttttgagcacatttttctgacatgctttcattttctgtggggatactttgctgctgctgatgctgctgctgcttttttttttttaattttttacaactttttagggtatttaccttaaagctttactgtttctcattttgatgtgaaattagttttccttaacttataaaaaggtagacatttagaaagtgttactacttcacagagctcccttttttgtttttggtttggtttggtttgttagtgtttaaaaataaggcagcttttattctgagatttcctggctctgcttctctctgtcttttggtgtacacccacactgtccaatatgatagcaatgaggcatgtgtggctatgtacgtttaagtttaaattaattaaaattaaataaagttataaaaatttatttcttcaattgcagtagccacatttcaagtgctaaatagccatgtgtggctaatgactactctattgaatagcacaaatatagaatatttccatcatcacagaactctattggacaacactgatctatactttttctttcatctttgttgtcactgtcctgttcagttttttattgtactctcagcagtttctccttagtgtggagcctctcagaggggagctctagtgggtaagctttaagggttcatagggcctagactactatcgcttctttagtacatctttgatatgaggtccttgcactcactcaataatggagaaagcaaattatctcccaatttcaactgctgttctccagtttccccatcatgctattcagttgatttctacaagccaattttggggtcctccttttctatatagtccattagacgcttccctattacttccttttttttcttcatcctgtacagatgctgacataatgcaggtcttgtagctgttgttgctttttctccacccacttgtgtttcttaatgcctcgggatattttgtcactcagttttgttataaacgctgtctgtggtttttggttttgccatctgcatgctcagttgtttttcatgagaattcagagaaatgttacctctaccacatatttccagaatcattttgtatagtttttttttcttcctacctacctaccgacagggcctcactttgtcacctaggctggagtgcagtggtgtaaacacagctcacagcatcctcaacttcctgggctcaagtaatcctcctaccttaacctcctgagtagctgggaccacaggcatgcaccaccatgcctggctaatttaaaaaaatttttttgttgagacgggggtcttactatgttgcccaagctggtctcaaactcctggactcagatgatcctctcacctcagcctcccaaagtgctgggatcacaggcatgatcagccatgcccagcctcatatggcatatatatatatatatatacacagctacctttgctaaagtctcttaataattgtaataatttgcttataaattcttctgggttgtctacatattcaattatacaaattgacaattgtgtttcttctttttcaatatgctttatatatttcttgtcttattttgtctaataattcaaccactatgttgaattaaagtggtgttttggatttaaaagggaaagctaccataaattgccattaaatatgatgtttgctttagggtttttttgtgttgttgttgtatagatacggtattagtttcctagggatgctataacaaagcactacaaactgtgtggcttaaaacaacagaaatgtatacacttatagttctggaggctggaagtccaaaatcaaggtgtcgataaagctatgctctctctgaagactttagtagaggattcttcctagactagatttgcttaatggttaggtaaatggtcactttttgtaaatattctgtgtgtgcttgaaaaaaatgtgttttctgcagtttttaggcactgtgtatgtacatatatgtacagatgttccttgacttacgatggagttatatcccaataaattgatcataagttgaaaatatcgtaaggtgaaaatgcagttaatgctggcaaaatggcaggcatctacaacttatgatggtttaacttaatggtattttgattttataatgatgtaaaggcaatatacatttagtagaaaccataaccctgtcataagttgtaaggagctcccagacttacgatgtggttacatcctgataaacccgtggtaaagtcaaaaaatcataagacagagaccacctatatacacacatgtataaatttagattaagtttgttcattttatttgaatcttctgtatcaaaactcatattttgtgtacttactctatcacttactgagatgaggtgctggaatatccctttatggtttgaattgatctatttcttcatttaattttatcatttttgctttatatattttaggccatactacttatacatacaaaattagtactgtaatatatttgtttgttgaagttttattgttatgcagtgatcttctttatatctagtattattttctgccttaaagtcatttttgtctgatattaatatatccacactttggttaatattttccagatagatcttctctaatccctttactttgaacttttaatacatttatattttaggtgtgccacttctaaaaaacatgtagttacatatttttaatccagtctgaccatttttgttttttaactagggcatttcgtgtttatacatttaatacaatattggtatatctgagtttaaatctgtaacttactttatgctttctatttgtcatttctttttttttttttttttttttttgagacagagtctcactttatgcccaggctggagtgcagtagtacaatctctgctcactgcaaactccgcctcccatgttcaagtgattctcatgcctcagcctcccaagtagctgggatcacagatgtgtgccaccacatccagctaatttttatatttttagtagagatggggtttcaccatgctggccaggctggtctcaaactcctgttctcaggggatctgcctgcctgagcctcccaaagtgttgggattacaggcatgagccaccgtgcccggcttctatttgtcatttctatcctgtttctttttctctcctcacttgccttcttcgggatcaatgtttctaaataatagactttacttgttacagcagttttaggtttacagaaaaattgagtaggaaatatagagagttttcatataccccctcacggttcttcacatactgtttcccctgtcattaacatctcgcattagtgtgctatatatgttacagttaataagccaatattgatatgttatttttaactaaagtccgtagtttacattaggatttagtctttgtgttgtacatcatatgtggtttgatgaatgtataaaaaagtgtctaccattataataccatacagaatagttcaaccccctgtggttcaactattcatcccttcctccctctcactgaactagtgtcaaccactgatctttttactgtctccatagttttgccttttcagaatgtcacataattggaatcgtgcagtatgtagccttttcaaataggtttctttcacttagcaatatgcatttaagattccttcatgtccttttatgggttggtagttaattttttttagtgctgaataatatttcactatctggatatattagtttatacactcacctatggaagaacatcttagttgcttccaaattttggcagttatgaataaagctactataaatatctttatgtagatttttgtgtagacataagttttgacacatttgaataaataccaaaggtgcaactgctggattgtatggcaagagtatgtttagttttgtaggaaactgccaaactgtcttccaagttggctataccatttttcattcccaccagtgatgaatgagagttcctgttgcaccacatccttgccagcattatatgtcgttaaagtgttttgaattttagttattctaatagatgcatagtgatatctcattgctgttttaatttgcaaaaccctaatgacataagatgttaagcatcttttcatatacttatttgccatctgcatattttatttagtgaagtgtttcttcaggtcttttgcccattttatacttgggttgtttattttcttattgttgaatttgaagaattcttcatacatgttgaataccagtccttcattacatatgtgtttggcaaatattttttcccaatatgtggcttttatcattattctcttaatgctgtctttcacagagcagtttttaattttaatgaagtttaacttaccagttttttcttttatagatatggttttggtgttgtgtctaaaaagtcattgccaaagttcacctaaaatttctcctatgttatcttctaaaagttttatagtttgggtttttatatttaggttataatccattttcagttaatttttgtgagaggtttatggtctgtgtctagctctacttttttacatgtggatgtctagttgttccagcaccagttgttaaaaatactattttcattttttttttcattgcagtcttccccttctactagtgtgaaaattatttactgcttctaatcttttagtggctatcctagaaagtatagaatcctttcttaactgtcttccatgtttgtaatcgctctgtgctgcattttggctattttattctttcagcccactaattttctcttcacctgtttctaatctgctattaaacctgtctattatgttttaatttgggtaattgggtttttcatttcaaaaagcttctttgtttcagatccccaaggtcacattttatggtctctgtttcctactaacttcactgatatgcaaagtatttaataactggtatggcacaggtaataatgagacagaatggataccatctagaaacaaccactataactgtattaatttgtaccactgtgtatcaacccacatacatatattttgaacatacattgtatttctttagactttgaaaacataggtgttttataaccagtttttcataattctagtatctgcatcttgagggtctgcttctgctatctcgtttctgctgtttatggtaccttgtttccgagtgtgctttgttatttttgtaacgtgtacaactcatggttcttgaaaaattatttatggaaatatttcgaaggctgacataaggtgctttcccccagagaagatttacatttgcttctgtagatgcttgggagctatctaaactaaattctcagctttaggtcttttagcttcctgtataatgtagtttgggtcagtgaatacatgagtctcctagtattacacctcatggattgtttccctccaccccattgtgctgccttctattcagtactaaggtaactttatttgcagttttccagggatgtgggtaggagtgggtttacttttggcttgtccctagtctaggagtgtgatcccttggaacttgatgtcttttcccctgacctagtgatgtccctcaaaactgaagttaacatttgcttacatttgcaaatgcttaccagataaaagcgactttacttttctgtttacctctctgagacctcagttttccttagattttgccttggtaattcttttgctatttgtcagttgctcttttgttctttctggaaaaaaattaatatatcatccaatatttttggttgttttcagcaggagggttggtctgacatatctaacttactctatttccagaagtataactcactgttgcattagcattctagaagagcacttctgcaaatatttttcttagattcatatattttcattgtgagtatccctcagccattttgactaccttaatgatattagtaaaatatggtaagtccttccttgtagattttattaaaatgacccagtgtttttctttccaggccaaagaggcagtggcagaagctgaacgacatgaccctaggaacgttttcactcaattttatatattcaagattgcagtcatagagggcaactctgaaagaggtataaattttatttgtcacttatatttgactattaacacaaagaataaataatcctcttcaaccacagtgggaaaaaaacattgtttttaagacaatagaattgaatatatgttctgtctttcctatgtaaaggtgatacaacaatgcaaaaagaaaccgtggaaggttatataaaagtaaaagaacagtggttacctattgagggaataggaactgggcaaacgcgggacaagaattaggggaaagtcttatcactatgtacttttttatacttttatttaaaccaacctattcaaaaattaaatttaaaaagctgtgtgtgggtgagattatactaaaaacccatatcagttaagaattgtcttcaaaaaatgaaagttggggtaccttttgattgttttcacttatttgggaggtgattggtgagagatttggccttgagatggagtttctctccacagagtagacagtcttggaatttcacacatgaccctcatcccattaatgttgaggcctttccattaagttaagcatagtttcctagctggtgtgtctgcatgggcacatatatgttgaattggttatagatatgcctttgctcagatattaatgccttcagccctcaggtagctgaattaatcctgaaggagtctgagctccagactggttgccatttgtttggcagaagttaagaaacttaaattaatggatccaaacaaaatgtatacgaatccaattaagcaactgtttttggacacctactacgtacaaaggactctgttattcactccttaagaaaaaagatcatttattttacattaaaaaagaaatgttccagaatagtaaagtatacctgtataataattaaggaatagtaaattagaggttaatattgctgtcatgttcatcatcaaagttttcattagagacttttaggcatttgttttacttgatatactgtgtttaagggtaaaataacttgaagcttttttgccagtaaaaatggcaaaaatattagtaattttcctgttaaatcttttgttttaacattattttttaaaaattattttactttttaaatacaacatcagatcaacccttttatttcttctccagttgtctgtgaccattttttaagtcacgtatattgaagatacatataataaatttactcttgctagtgtatggtcctatgaggtttatatatgttaaaaattctgagttttgaagtgcatacagtcatataactaccaccacaatgtagaaaaaaaatacctcagggccctttactgttactccttctcaccactttcagccctggaaatcagtaatctcttctatctctatagttttgtcttttccagaatgtcatataaatgaaatcatatagtatgaatctttttgagcttctttcacttaacttaatgcatttgaaactcacccatattgtgtttatccacagtttgttcttttttattgctatgtggcattccatagtatggaaataccacagtatggaaaaatgcattcaccagttgaaggatatttgaatggttttcagggttttttttcacctctgagacaagttcaaagttttcagttttgacaattgtgaataaaggtgctgtaaaacatctctttacatattttctgtgataataatattgtttttttgagatggggtcttgctctgtcacccaggctggagtgcagtggcatgatctcagctcactgcaatctccacctcccaggttcaagcgattctcctgcctcagcctcctgaatagctgggactacaggtgtgcaccaccatgcccagttaattcgatgataatattttacttctgtagggtaaatatctaggagtgggactgtggacttatatggtaaatacatgtttaactttattagaaactgcaaaactgttttctaaagcgactatacaatttcacctgtgaaccagctatgtttaagagttctagctgatctacatcctcatcagcacttgaaattgtccacttaaaaaaatttagccattctgggagattattaaaaagtcaagaaacaacagatgctggtgaggctgtagagaaataggaatgcttttacactgttggtgggaatgtaaattagttcaatcatagcggaagacagcatggtgattcttcaaggatctagaaccggaaatactatttgacccagcaatcccattactgggtatatactcaaaggaatataaaccattctattataaagatacatgcacacgtgtgttcattgcagcactattcacaatagcaaagacatggaaccaacccaaatgcccatcaatggcagactggataaagaaaatgtggtacatatacaccgtggaatactatgcagccataaaaaggaataagatcatgtcttttgcaggcacatggatgaagctggaagccatcaacctcagcaaactaatgcaggaaccgaaaaccaaacaccacatgttctcactcataagagggagatgaacaatgagaacacatggacacaggaaggggaacaacacacactggggcctgttgggggcggggaggggagggagaacatcaggacaaatagctaatgcatgtgaggcttaaaacctaggtgatgggttgataggtgcatcaaaccaccatgacacacgtatgcctacgtaataaaactgcactttctgcacatgtatcctagaacttaaagttaaaacaataaaaaagaacaaaaatttagctattctgatagtgggtagtagtgttttactgtggcattagcatttccctaatgtttaatattttattaaaccatgtatgtttttgggttgtttgtacaaatctttttcccagtttaagatagggtactttgttttattattactgatttttgacagttctttatatattctggatacaagttgtcttttttaaaaacttatttttttaattggcaaataaaaattatatatatattgatcatgaacaacatggtgggttttatttatttatttattttattattatactttaagtttcagggtacatgtgcacaacatgcaggtttgttacatatgtatacatgtgccatgttggtgtgctgcacccattaactcgtcatttacattaggtatatctcctaatgctatccctccccagtcccccatcccacaacaggccctggggtgtgatgttccccttcctgtgtccaagtgttctcattgttcaattcccacctatgagtgagaatatgcggtgtttggttttttgtccttactatagtttgctgagaatgatggtttccagcttcatccatgtccctacaaaggacatgaattcatcattttttatggctgcataatattccatggtgtatatgtgccacattttcttaatccagtctatcattgatggacatttgggttggttccaagtctttgctatcgtgaatagtgctgcaataaacatacgtgtgcatgtgtctttatagcagcatgatttatacttctttgagtatatacccagtaatgggatggctgggtcaaatggtgtttctagttctagatccctgaggaatcgccacactgacttccacaatggttgaactagtttacagtcccaccaacagtgtaaaagtgttcctgtttctccacatcctctccagcaacaacatggtgttttaaagatatgtatacattgtggaatggctaaatcaagctaattaacatatacattacctcacatcctttttttattttttatttttttgaagcaaggtcttactctgtcacccaagtggaagtgcagtggaatgatcacggctcattgcagccttgacctcccaggctcaagagatcctccacctcatcttttttattattttttgtatagatggagtctcactatgttgcccaggctggcctcaaactcctgggctcaagcaatcctcctgcttcagcctcccaaagtgctaggattacaggcatgagccatcacacccaaccctacctcacatacttagcattttttttgtggtgagaacacttaaactctcagtgatttttaagaatagaatacattgttataatctatagtcaccatgttgtacaatagatctcttgaacttgttccttctgctcaacggaaattctgtattctttcaccatctccctaatctccccgactccttagtccctggtaaccaccattctactttgcttctatgaacattctattctgcttctatgaggtcaacttctttagatttcacatatgagatcatgtggtatttatttttgtgtgcctggcttatttcacttaatataatgtcttcgaggttcatacctttttttcataaatgacaggatttcctccttttattgaggctgaatagtattccattgtctatatatacaccagattttctttatccacttatccaccgataaacagttaagttgattccataccatggctattgtgaataatgctgcaatgaatatgggagtgcagatatctctttgacatattgatttcacttcttttttatattctactacgtagtgggactgctggatcatatggtagttctactttaatttttttgaggaacctccatactgctttccatgatggctatactaatttacattcccacctacaatatgcaagagttccctattctccgcatccttgtcagcacttgctctcctttgtcttttttataatagccattctagcagatgtggggtgatgttatcatcgtggttttaatttgcgtttctctcatgagtagtgatgttagacattttttcatatacttgtggaccacttgctcatctccttttgagaagtgtcttgtcaggtcatttgcccattttaaaatcaggttatttgtttccttcctattgaattgtttgaatttcttatatattttggatgttaaccccttctcaaatgcctggtttgtaaatatattctcccattccatacattgtgtcttcactctgttgatggtttcttttgctgtgtggaagctttttagtttgatgtaatcccatgtgtctatttttgtgtttagcaatgtcgtggaacttttcctctatgttttcttttagtagttctacagtttcatgtcttacgtttaaatctttaatctattttgaatagcttttttatatattgtgagaaaagggtcaaattttattcttctgcatgtgggtatccagttttaccaacactattggttgaagaaactgtccttttctcattgtgtgttcttgacacctttattgaaaaccaattgactgtaaatgtgtggatttatttctgggctctctatttccttccattggcctatgtatctgtttttctgccaataccatgctgttttgattagtatagctttgtagtttattttgacttcacatagtatggtgccttcagctttcttatttttgctcaagattgcgatagctagtcagggtctttttgcttccgtggaaacgtcagtatttttttttttatttctgggaaaaaatgtcactggaattttaatagggattgcattgcatctgtagattgccttgggtagtatggacatttaacaatatttttccaatccgtgaacctgggatatctttccatttctttgtgttttcttcactttctttcatcagtgttttatagtttttagtgtacatgtctttcacttcaacattaaatttgctcctaaatatttttgtagctattgtaaatggaatcatgtttttaatattttttcaggtagtttgttgttagtatgtagaaatgctactactttgtgtatattgattttgtatcttgctacttaattgaattcacttattggttctaaattttttttcattgcctctgtaaggttttctatatataagatcatgttatttacaagcagacaatttaacttcttcctttccaacttagatatttctcatgcctaattactctgactaggacttccagtagtatgttgaatagaagtagtgagagtgggcatccatgtcttcttccttattttagaggaaacgctcctaactattcaccattgagtatggtgttatttgtccattggtcatatatggcctttattgtgtttttttttttaaatcatggaatgatgttgaattttgtgaaatgatttccattttttggaagaatttgagaaggattggtattagttctttaaacgtttggtaggagcagtgacaccatcagatcctgagcttttcttagatggaagattttttgttattcatttaatctccttattcattatttgttcacattttctatttcattatgattccatctgggttttatatgtctaggactttatctttcttctagattatccaatttcttggtacataattgttcatagtagtcgcatgattttttatatttctctggtaccagctgtactgtcttctctttctttttttattttatttatctttttttaattttttttattatactttaagttttagggtacatgtgcacattgtgcaggttagttacatatgtatacatgtgccatgctggtgtgctgcacccactaactcctcatctagcattaggtatatctcccaatgctatccctcccctctcccctcaccccacaaaagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttgatccagtctatcattgttggacatttgggttggttccaagtctttgctattggtgaataatgccgcaataaacatacgtgtgcatgtctctttatagcagcatgatttatagtcctttgggtatatacccagtaatgggatggctgggtcaaatggtatttctagttctagatccctaaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctattcatgtcctttgcccactttttgatggggttgtttttttttttcttgtaaatttgtttgagttcattgtagattctggatattagccctttgtcatatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctacgtcctgaatggtaatgcctaggatttcttctagggtttttatggttttaggtcgaatgtttaagtctttaatccatcgtgaattgatttttgtataaggtgtaaggaagggatccagtttcagctttctacatatggctagccagttttcccagcaccatttattaaatagggaatcctttccccattgcttgtttttctcaggtttgtcaaagatcagagagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatgctcttttatttccttgagcagcggtttgtagttctccttgaagaggtccttcatatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattaccgtggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctgatctcataaaatgagttagggaggattccctctttttctattgattggaatagtttcagaaggaatggtaccggttcctccttgtacctctggtagaattcggctgtgaatccatctggtcctggattctttttggttggtaagctattgattattgccacaatatcagatcctgttattgatctattcagagattcaacttcttcctggtttagtcttggaagagtgtatgtgttgaggagtttatccatttcttctagattttctagtttatttgcatagaggtgtttttagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaatattttgaaggcttttttgtgtctctatttccttcagttctgctctgatcttagttatttcttgccttctgttagcttttgcatgtgtttgctcttgcttttctagttcttttaactgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgtcttcatttcgttatgtacccagcagtcattgaggagcaggttgttcagtttccatgtagttgagtggttttgagtgagattcttaatcctgagttctagtttgattgcactgtggactgagagatagtttgttataatttgtgttcttttacatttgctgaggagagctttacttccaagtatgtggtcagttttgcaataggtgtggtgtggtgctgaaaaaaacgtatattctgttgatttggggtggagagttctgtagacgtctattaggtcctcttggtgcagagctgagttcaattcctgggtatccttgttgactttctgtctcgttgatctgtctaatattgacagtggggtgttaaagcctcccattattaatgtgtgggaatctaagtctctttgtaggtcactcaggacttgctttatgaatctgggtgctcctgtattgggtgcatatatatttaggatagttagctgttcttgttgaattgatccctttaccattatgtaatggccttctttgtctcttttgatctttgttggtttaaagtctgtttgatcagagaataggattgcaacccctgcctttgtttgttttccatttgcttggtagatcttcctccatccttttattttgagcctatgtgtgtctctgcaagtgagatgggtctcctgaatacagcacactgatgggtcttgactctatccaatttgccagtctgtgtcttttaattggagcatttagtccatttacatttaaggttaatagtgttatgtgtgaatttgatcctgtcattatgatgttagctggttcttttgcccgttagttgatgcagtttcttcctagtctcgatggtctttacattttggcatgattttgcagcagctggtacccgttgttcctttccatgttcagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagggtttctgccgagagatccgctgttagtctgatgggcttccctttgagggtaacctgacgtttctctctggctgcacttaacattttttccttcatttcaactttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcactttcaggtacaccaatcagacatagatttggtcttttcacatagtcccatatttcttggaggctttgctcatttctttttattcttttttctctaaactttccttctcgcttcatttcattcatttcatcttccattgctgataccctttcttccagttgatcgcatcggctcctgaggcttctgcattcttcaggtagttctcgagccttggttttcagctccatcagctcctttaagcacttctctgtattggttattctagttatacattcttctaaatttttttcaaagttttcaacttctttgcctttggtttgaatgtcctcccgtagctcagattaatttgatcgtctgaagtcttcttctctcagctcgtcaaagtccttctccgtccagctttgttctgttgctggtgaggggctgcattcctttggaggaggagaggcgctctgatttttagagtttccagtttttctgttctgttttttccccatctttgtggttttatctacttttggtctttgatgatggtgatgtacagatgggtttttagtgtggatgtcctttctgtttgttagttttccttctaacagacaggaccctcagctgcaggtctgctggagtaccctgcagtgtgaggtgtcagtctgcccctgctggagggtgcctcccagttaggctgcttgggggtcaggggtcagggagccacttgaggaggcagtctgcccgttctcagatctccagctgcgtactgggagaacccctgctctcttcaaagctgtcagacagggacagttaagtctgcagaggttactgctgtctttttgtttgtctgtgccctgcccccagaggtggagcctacagaggcacgcaggcctccttgagctgtggtgggctccactcagttcgagcttcccggctgctttgtttacctaagcaagcctgggcaatggtgggcgcccctcccccagcctcactgccgccttgcagtttgatctcagactgctgtgctagcaatcagcgagactccgtggggtaggaccctccgagccaggtgcgggatataatctcgtggtgcgctgttttttaagcccgtgagaaaagcgcagtattcaggtgggagtgacccgattttccaggtgccgtccgtcacccctttctttgattaggaaagggaactccctgaccccttgcgcttccccccgccgagtgaggcaatgcctcgccctgcttcggctagcgcacggtgggcgcacccactgacctgcgcccactgtctggcactccctagtcagatgaaccgggtacctcagatggaaatgcagaaatcacccgtcttctgcgtggttcatgctgggagctgtagactggagctgttcctattcggccatcttggctcctccaatgtcttctctttcatttcttgttttatttatttgagccttatctttttttcttagtctaaataaaagtttgtcaattttgttcatcttttttttttttttttttgagacagttgctctgtctcccaggctggaatgcagtggcgccatcttggctcactgcaacctccacctcccgggttcaagcagttcttctgcttcagcctcctaagtagctgggactacaggcacatgccaccatgcccagataattttttgcatttttagtagagatggagtttcactacattggccaggctggtctcaaaattctgacctcaagtgatctgcccacctcagcctcccaaagtgctgggattacaggtgtgagccaccatacctggtgattttgtttatcttttcaaaaaaactaactgttagtttctagtaagacaagtctgggtggcaatgaactccctcagcttttgtttgtctggtaaagtctttatctctccttcatttctgaaggatagctttactgggtaaagtattaattggcagggttttttctcttcggcactttgaatatatcttcccactctttcgtggcctatatttctgctgtgaagagcactgctagctttattggaactcctttatatgtgatatgctgcttttctattgttactttcaggatcctctcttttatgttgatttttgacagtttgattataatatgtcttggtgttgtcttgtttggattgtatcttattggagactgatgaccctcctgtacctgtatatttatctttccccaggttcggaaagttttctgttgctattgattgaaatgtgttttccagaccttcatatctcttttctccttattgaactcctataattcagatatttgcccttttgttgttgtcccataagtccctaagcttttttttttattgaggaagatctttttttaatgttattttttttttatttccagcttgtaagttcagggggacatgtgcaggatgtgcaagtttgttacataggtaaacgtgtgccatggtggtttgctgcataaatcatcccatcacctaggtgttaagtccagcatccactaactgttcttccttatgatatccctcctcccagcccccaccctccagcaagccccagtatgtgttgctaacccccatgtgtccatgtgttctcatcattcagcttccacttataagtgagaacatgcagtatttggttttctgttcctgcattagtttgctgaggataatggcttccagctccatctatgtccctgcaaaggacgtggtcttgttcctttgtatggctgcatagtattccatggtgtatatgtaccacattttctttattcagtctatcattgatgggcatacgttgattatatgtctttgctattgtgaatagtgctacaatgaacatacgtgtgcattatttttataacagaatgatttatattcctttgggtatatacccagtaatgggattgccaggtcatatagtatttctgcctgtaggtcttcgagaaatcaccatactgtcttccacaatggttgaactactaatttacattcccaccaacagtgtaaaagtgtaaaagcattcctttttctccacacacaaccttgccagcatctgttgttttttgactttttaataatagtcattctgactggcatgagatggtatctcattgtggttttgatttgcatttccctaatgatcagtgatgttgagctatttttcatacatttgttggccatgtgtatgtcttcttttgagaagtgtctgttcatgtcctttgcccactttttagtgggttttctttttttttaatttgcttaggttccttgtagatgctgggtattaggcctttgtcagatggatagattgtaaaaattttctcccattctataatttatttgttcattctgatgatggtttcttctgctgtgcagcagctctttagtctgggaaggcactttattggcctatcaaggaactatgggtaggctgttttgcatggttcacatgtgtgctgactcctggagtcctttggcagcctggccttgttcctggattagcagctgggtgggcctggatgcctaggtccatggggttggatctggagcctatatccactgaggtggacttcttgattgggtctgaaggattgggcttggagcctgtatccaatggggctggcctgaagtttaggcccccattggctgaccaaacactaaagtggtgagtctgaatctgcaagagccagccaggtgggaatgggccttgtgcctgggtcccctgggataggcctggagcctgagtctgtaggggttggcctggcactggggtgggcctcaagcctgaggactagggcaggcctcagtcctaggtcagtgggtgctggcctggaaccttggtttgtaggggtggttttagagcctcagtccatgggggctagcctggcacctgggtctactggggtggtactagacccttggcctactgcagcaggcctggaccctgggtctactggagcttggggccactgagacagtcctagagcctggagctggcctggagttggggcagatgtggagcctcgggccacaaggactgccttgaagcctgggattgttggtactaaattgctatttggagacacactggctggcctagtgtgtggggctgtggggacctgcctggggcctgggtctgtgggggccagcctgggggatggatgtgtgtatgctagcctggaggctaggtctgtgaggtctgacctgggtcctggagctgcaggagctgtcctggaacctggctgcataggggaagtgctgaggctttgatccatgggggccagcccatccctagggtctaaattggcttggacccttggtctgctggagcagacttggaccgtggctccactggagtgtggagtgacataagcaggcgtgaaggctgtgttcatgagtgccagcctcgtacctatggccaggggtacagatctggtattggggcaggcctgtagcctggggctgtgtgggctgacctagctctgaggtggtctgaaaacctggggtatgcctggatcctggggctgcaggggctggcctggcactgagtaggcctggatcctatatctacaaggagcagcctagaggctgggtccatgggtgctgacctgatgactagggctgtggggctggcctagtgctgaggcagacctgaagcctggggctacgggggatccagcttcatactggcagcaatctggtgcctggaactactgatgtcagcctcgtcctaaggatagagactgcatctaaagcctgagtctgttaggactgctatggcactgggacaggcccaaagcctggggctaatgggtctggtccagcactggggccagtctggagcctgaatccgctggggttggcctggtgatgtggcagtcctagagatcaagtccttcgggcaggtctggagcctgggtctgcaggatatgacctggagtctggggccatgggggcctgcccagtgatgagttttactgccgccagcccattgttgtggtctgaggtaaattccagtactcactttcctcttcttcccctaagtggaggatatctgtcttcatgctctatggcctggggttgggggaggggtgacatgggtattaaaaagctgttgttcctacactcttcaatgcatcttttctatttctgtgccacagccaggtgctgcaatctctcacctagttttcctagctcttgtggaggtatttccatgtgtggatagttgttcaaattgatgttcttgtggggaatgagcgctggaaagtcctattccaccatcttgttgatgttcagtggacacaagctctttatcagacatgtattttgcaaattttttctttttattaacaccgtctttcatgaacagaagttttaaatttcgacatagtcctatttatttttcttcttttatggattgtgcttttggcattgtagttgagaaatctttgcctactgcaaggtgacagaaaaggtctcatgttttcttcaagaaattttacagttttaggtttacatttatgtctatgaacaatttttagttaatttttgtatttggttcaaggtatggattgaaaatttttttttttttttgcacatgactatccaattgttccagcatcatttgtttaacaaactattctttctctgttgaattgcctttgtgcctttatcagaaattagttgtcatatatgtgtggatctctttctggactctattccattccattcttctattcatccatccttacgctattcccatactgtctttatcagtgtagctatgtaataaatttgaagtcaactttaacaaatccatccttacactattcccatgctgtctttattagtgtagctatgtaataaatttgaaccccaactttgttctctttctaattgttttggctattccaaggcctttgtatatccatatgaattttagaatcattattttaagttttgcataaatgaattttgattcgtattacattgaatctatagatcagcttggggataactgacatcttaacaacgttgctgagtcttccaaaccacgaacaacttacatacctccatttatttaggtctttaatttctctcagcaatgttttctacttttcattgtacctgtcttctgcatcttttgtcagatttatccctaagtacactatattttatgctattttaaatggcatttttaaaaaatttggtttccgattgcttattgttgatatgtagaaatacaaatgatttcttgtatattgatcttatatcccacaactttggtaaactcacttattagttgcagtacagtaccttccctgtagattccatcagattttattttatttttgttttgttttgtttgtttgtttatgagacctgttctgtttcgagacctgttctgtcacctaggctggagtgcggtggcatgatctcggctcactgcaacctccacctcctgggttcaaacgattctcgtgcctcagcctcccaagaaactgggattacaggcatgcaccaccacgcctggctaatttttgtatttttagtagaaatggggtttcaccacgttggccaggctggtctcgaactcctggcctcaaggaatcctcccaccttggcctcccaaagtgctgggattacaggcatgagctactgcaccagccccatcagattttctaaatagacaatcatgttgcctgtgggtaaagataatttcacttctttttcaatctgggtgcaatttatttttttcttgctttgttgctcttgttagattctccagtaaaatttgagtaaaactgatgagagtggacatccttatctttttcctgattttagggggaaagcattcagtcttccaccagtaagtatgttagctgtaggtttttcacagatatcctttatcaggttgagggagttccatttggtggtgggaggggtaaggaatggatgttgaatttggttgtatggttttctgcatctgttgaaatggtcaatttttaaaaaattgttaatatagtcagttacattaattgattttcaaatgttaaaccaatgctgtatttctggaacaagccccacttgatcatgatgtatactcctttttatataatttgatttgctaatggtttgtttagaatatgtgtatctatgttcatgaatgaaattggtttgtagttttatattcctgtaatgtttttggttttgctatcagagtaatactgacttcatagggtgaattgggaagtatattctccttttcagttttctggaagagtttgtgttgaaatgatattatttcttcctcaaatgtttttggtagatttcaccagtgaagccatctgggactggagttttctttatgcaaaggtttttaattataaattaaatgtctttaatagatatagggctattcaagttatctattatttattgatttagctttggtggtttgtgtctttcaaaaatttgtttcatctaagttgttgaaattatgggcctaaagttgttcataatatcccccatattatccttttaacacctgtaacctttcttatttctgatatttgtaatttatgtcttctctatttttcttcctggtcagtgtaactaaaggatcaatcagtgtagaaggtcaattttattgatcttctcaaagaacccagcttttggttttactaatttttctctatcagttttgtttttgtttttgtttttgatagagtctcaaaaaaacgaacacagctcactacagccttggcctcccaggctcagtttatcctcctgcctcatcctcccgagtagctgggaccacaggtgcatgccactacacctagctcattttaaaacttttttgtagagatagggtctcaccatgttgcccaggctggtctcaaactcctgggctcaaacgatcctcctaccttggcctctattgtttttatctgatttctatttaatttatttacgttctgatctttatcatatccattcttctgctttctttgagttccatttgctctacttcttcttatttctaaaggtgaacactgaggtcattgatttaagacctttattctggtctatctggacagttaatgctacaaattatcatctaattactgtttagtgacgatacacaaattttgatatgtcatgttttcattttttttttttttcaggttttcctttagcatttttattagacccaaatgaaaacaaaggctaatttagaagccaagcattgattttcccatttgttaatattatgtcttacaatgagttttaacactgaaactcatctaatattaaacagaaacggttgagttacttgttgattttcaatggctgtttttccccctgcattcctccatgcatttatttgtccttgtatcaacaattacttgagctttaccatatgcaaaggggaaggctttacttctctttggaaacatagccttccctgttgcatacagtatttccacaacacacagtcttctgattcggaggaagtgacatgatggtctatatttcaacagttcttttacagtgaactaacaactttatagatgacaccatgacgttaggctttgaaacttatgcgagggtgaggatcaaggaaaacagagatcttttcgagatatttataatactctcaaaggagggaccatttggatatcatattagtttcctgttgctgctgttgtaaaggctgccaataaattaccacaaagttaatagcttacaacaacacaatccattatcttacagttcaggaggccgcagtcccaaatcagttcactgggctaaaatcagggtggaatcagggttggcagaggatgttttcattttaattcggttccaaatactttccaatttaactttggattcctttttaaacttgtggattatttagatgtgttacttattttccaaatatttgcagattttccagagaacattcttttgttgatttttaatttcatttcattgtagtcaaagatcatactttgtatgactttaatccttttaaatatattgagacttgttctagggcctagaatattgtttttcttggtaaatatttcatgtgcacttgagaggaatatacattttgctggtgttgggttgaatgtgttataaatgttagccacatcaagttgatttagtgttaagtgtactgaatccttgctgattttctattctatcagttattgagagaggatattgaaatctttaactataattgtggatttgttcatttcttcttgcagttctaccagcttttgcttcttatattttgaaattttattgggtgcataagcattcagagttatgtcctcatgataaactgattattgtcttgaaataaccttttattgccaataatattctttgctctgaaattcactttatctgatattaatatagccactccagctttcttttgattaccttcactttagtgtatattatcccatcctcttctttcaatcaattttgcttttatatttaaagtgtatttcttgtaggtggcatatatttaaaagatgtgttttgttttgttttcagtcttactatctctgccttttaattggtcatttggtcatttatatttaacatagatattgatacacatagatttaaatttagcatcttattaattatcttctgtttgtcccatttgctctttttccttttttctgctttattttggattaattgaatttttatgattacatttatctccctttttgcttattagtttgaacaaatatttatttgttgcttgaagtctatagtacacatatttaacttgtcatattccacctttaagaatataatggaatataacacacagctactcaattttttattttattctgtattatatttcaaattatggatgtaccaaagtgtgttttgcccattaattatgatggaatttaggctgatttcatattttactctttttttttttttttttctgagacagagtttcgctctgtcacccaggctagagtgcagtggcccgatctcggctcactgcaagctccgcctcccgggttaacgccattctcctgcctcagcctcccgagtagctgggactacagacgcccgcaactgcacctggctaattttttgtatttttagtagagacggggtttcaccgtgttagccaggatggtctcgatctcctgacctcgcgatccaccctcctcggcctcccaaagtgctgggattacaggcgtgagccaccgcgcctggcccatattttactcttataaacaatgctggatgaacatccttatgtgtatttgtttacttttgcaaatatatccgtaagataaattcacagaagtgcatgtgcagttgctcagttgggcatttttctggtgttcaaatcctccttgaaagcttagcaactcacattactttatgaatactaacattttaaaaatgttcttaaaataagttccaaattcattgtggcataattaaccatagatatgtaatttctttgattagagtatatcatttttgaatttttttcttgtttttcagctttgcaggcaataattactttagagaatatattaacagatgaagagtcagaagataatgatctagttgcagagagaggttcacctaccatgcttctaagtttagctgcccagtttgctctagaggtaattcatatgtattcatctactagatttttatcccttttcctttttgaaagacaattaatagaatcattatcagttagacacagaagagacctttactgtttgttttgcctcatattttcatgccaaacttggttgcagaactgctttatttcttctcatttcactataatgcagactaaagtaaatgaaacagtgaggtaacagagttgtgctcaaaacaacataaaaataaacgtagcaaaacattaattttttaaaagaaactccaaattcaaaatgccataccatgtcaataaatagctatctatatagaaacttatctttctcatcaatttgaacaaaatggtttaaatttctggagatcctttgagttcataaccacaaaatagtattagtttagaagtaataaataattgtacccctgtttgttactacagaattctggttttattaatatattgaattaggaaaagcatagtagcatctgtggagctcttagactaggtttgaatactggctctgccatttaatctgtgcttaacttcttcaaatcttaatttcatcctttgcaaaataaagataatgcctacctccaggattgttatgaaaatcgattaagatggctgaaaatgtgctttataaactattaagtttatcttctttttaaaactactttaaataggaaaaccatcttcctgatcagaactacagttccatatttcttccagtagctctctttggctttctacatcaaatgtacatttataaaccttcctttaaaaagataattgcttttgggtttcctctctttcatcttcttccccattctgcacaaatacattccatatctgcatctgccaaatacttttcttccttcaggagttctattacccttctcactaacatcaaaatacatatcattcaaactgtatttagcaactactttgggcaagatattgggctagatgctagaaatatgttccttcaggacctcacaagtcaatttgaacagacaagccatgcattaggaaagtaagtctacagaatatagagttctatgtaagtatatagaataaagaccaaatagctaatatatatgttaaaaattaccaaaattcagagtaggaagagagcactgagaaccagaatcgatttgggaagtctctacagtggaaggaaaccttaagttgggctttggaaagagtagcatttacataagtaagaatgtttttttaaaggaagagatggtataaacaagacatggagaaaggaatgtgattggcttgagagacacagtgtttggttaaagtgatggagggcttatgtttccaccattccagatgttttgcctgatgtaatagtggctttttttttttttttgacaaagtctcactctgtcacccaggctggagtgcagtggcgtaatctcagctcactgtaacctctgcctctcaggttcaagtgattcttgtgcctcagcctcccatgtagctgggattacaggtgtgcgccagccacacctgactaatttttgtatttttagtagaggcggggtttcaccatgttggccaagctggtctggagctcttggccttaagtgatctgtctacctcagcctcccaaagtgctgggattacaggcatgagccactgcaccagccatgacttttattattatgttgatgctataggggaggagtatgagataaagtagaagaaatagctgtgacaagattatatatacattttattctctaaacaataagaaaatattgatggtaatttatgtaaaagtagtgctttaggaaaataatttgggttgtgcatggggaaatgaatggggagaaattatatgtaggacagaatgggagactgtgataataatccagttttaaaataatgagagtctagacaagggtagtgagagtggggtattaagcaggcaaaacattgctttcttttcttttaaaataagctaccttatctttaaatccctttacaaaattcattcccccacctcccaagagaaaatgtggatattctaggttctgaaaactgaagcagtcaggaagagaacttccacagattcctactacctctactcacacaccaggaatcacaccacatagtctgccttctcaactgccaccatagattagctatcatgttccttcctaaagccagtctctaaacttacacacttgtttctatcacctcttgcctttttctcactcactttgtcaacattttattctcttactggtttattcccatcagcatatgaacatgctcatttatcccatatcaaacaaacaaaaagtaagaaaacctcttgaccttccttctctcaccaactactccccaatttctcttcttccctttgtagttaaactcctctaaagatttgcctatatttactgtctccaattctctcttgagcttactccaatcaggcttttgccccaccactctaacaaaactgcttttgtcaaggtcaccaatgacctctttatcgtaaattgcagtggttaattctcagtcctcattgtatttgacctatcagcaacattcaatgcagttgatcactctttcctccttgaaacacagttggcttccaggacaccacattatccttatttttatcctacctcatgagtcactctttctttctcctttgctagttcctcttttctcttcaaccattctcagtgtcaaattatgagctcaggagaggaggtattagggagttgagaagaagggataaggtattaactattcattcagaaaagtaagaaagtgaatgactacggaagtgcaatatgcttgccagtagcactaaggccatttcatgaagttttaaaataaaacaagtagttgtatgtatttttttctggccacattcagctgatgagtggatgtaagcaccaaaatcagtagaaagttggacttaatcagagttgaggttttgccagatgaatacaataaagcaaaagaagggcaggaaaatcaaggaacaagggagtggttataattagtctccatggaatttaaactgggtatgcggtagaacatcaaggggatgagggacagtgaaaaactggtaacatcagtgggttgggggtcttactgcagttgaaggattgctggagtcagggtaatagaggtatcaagttggaaaggtaagaggcggtagacagaaagtagaatgtgtgaaagtaagagctggggtggagaactagggggagggagggagacacctagggcacaaaacttaaggaggaacttattctctgggtggtacaagtaaaggcttggtacttgtacaacactgagagcctccttaaatttttcaccctaggtgcttcactcacctcacctgtcccaccctactcctagccctgactgagagtgtgaaatgattgcaattgttagtaatgacagagtctagtgaatgactgtgggagtaaatggctaaggtaattgttagagtaaaatttcagaaaccaggaaactagaatattgggaggatcctctacctatatattgaaaatgcggaaaatatgccgcgcgcagtggctcacgcttgtaatcccagcactttgggaggcccaggcgggtggatcacctgaggtcaggagttcgagaccagcctggccaacatggtgaaaccccatctctaaaaaaactacaaaaattagccaggcgtagtggcgggtgcctgtaatcccagctactcaggaggctgaggcaggagaatcgcttgaacccaggaagcagaggttgcttcagcctgggtgacaagagcaagaatccatcttaaaaaaaaaaaaaagaaaaagaaaaagaaaatgccaaaaattaagacaggagcagtttttggaaaatataactgagcaataagtaagtcaccaacaaatgagaagaaatgacctgggagctagtaggccacagcaacaatgaagggtagtgggtgatatagtctggttataggaaattcaaagttgaggattttagggaatagaatgggagaataattttaaaatggcaatgaagagcaagaaagacacctactccatctccaggcctatgggtaagctagtgagagcaaaaacagctaccacttaagagggcttcagtggaagcagcatccttggcagaaacctagatttccattagagcaagaatatggaggaaacttttagggaagaggttgctggtagaggagattttgctgaaagtggactgaatttcagagagcatagtggaagggttggaggagtcggggagagatagaaaaagaggacagaagaggggatatatggagacttttgggaatagagtgctggaaatgagggtgacctgacaatctggggttcttttgtttactgctaataagtgggggataaagagcacaataagattagtcctagtggactaagggtagtattggcaaggctttgagtgtttgtgaatagggaggattcggtttccggggctaatgcaaatgtgttctgtttttgtcagtgagttgcatcttcattctaccatcttgcagtagcgtttttgagaatacaaaatgaacatgtttagatatttgtcttatctttaatgaacaggaatatagataatattttgcagtatcactttgagatgtaatttaacgtattatatttgttctttttagaatggacaacaaattgtggcagaaaaagctttggaatatttagctcaacattcagaagaccaggaacaagttcttacagctgtaaagtaagtaacctacatcctgtggaagagaaagtatttcctctgcttatcttgctcttagtcaataaactgccaaaatagtgctattgagatcaaggaaacttacataaaatagcgaagcagaggagggtgaggttgggacttgataaatacttaatggtatgactgagaaaatgccacagtgagaaataagaaaccagcaggattctagagtggttctcctgttggtcaattacacttgaggccacatttccaaagggaaatggagtcacataaataaaagagtcagaggagtcttgagatacttgcatcccttcagtaaggtaaatatttaaaaatcattcaggagagatagtattttttaaagctttttaggttttaaaactttaccaactaccttattttgtcagtttgtcattatgctgccagatcccttcaaagaatagtgatcccagtttgagacccaaaggccagttctagttcctctacagaaagagaaagataaagactgatttaccatacctgatgttctagcaggtgtttttgagcaatggtataaactgtggaaccatttaagaatttgttataagcaacgcttttgttttaaaactcttttattaaattcctctttcaaaattataaaattggtatgttttcattgcaactgttaaaacaataaaatatatataaattaaataagattaatctcccctttaccctctcttttctcacttctccctcccagagtaatcaaggttagtaacttggtatgtattcattcacacatgtttcttcctaacctaagaatcactttccatattactttgtcatacaggtgtttgcttcgttttcttcttccaaaaattgctgaaatgccggaatctgaagataagtgagttatttcaacaaaaatgatgtattccccattagacaaattatagtaacttacaatataaatcatatattcagagatacttagtgtagtgggtaagatcaatacaggttttggggccagtcttcctgggttcatatcctggctctgctgcttaccagatgtgtaaccttcagcaagtttcttaatgtctctgggcttcagtttccccaactgtaaagtgggaagaataataatacctacaccattgggttgctgtgatgactcaatgagttaaaacatctaaaaggcaaaagacttatgtgatctgcagagaaacgagagtataagttaatacatgtgaaacatttagaagtgtcaggaacttaataagccctcaataatgttatctatgatagaattatgatattgcatctgttccccctttcttaacagatgactcaaatatagacatatctcttactttcccacagaacatataacctggatggcttgttggttatgattctgtatcaggtctgctgagagtattcaaatatatttctgtgcacaatatctttggaataagatattaaaacttaacaattcgttgaagactttggtcaccaatttttcgttcacaaatctcactacctcctgattatttgaaagaaaactctactcggggtgttgattagggataactttcagagaaatatcacccatctctgcattctctgcttagacaagaactctgtaatagttccctctacttcacttttgcagctggaggcaatgtattttttcaaataaattcttttggatatatctttgactgaggtaacataggacagatgacttataactgtcattttcataatgcaaattttacccaattgcatattataagttttgccttttctttataggcttcataaatccattagaagggaattcaaacaaaccaaacaaaagatgaagcaattggaattttgaataatgaccaaatatttgctgatactaagaaattattaacttttagacatgataattgtagtgtggttggttttttaaaagattgcttatctcttacagacacatcttgaaatatgtatggatgaaataatgtgatgtctggaatttgcttcaaaataatatgggagaggaagaagtgggtggaggtatcaaggagataagattgatgatgagttaataattattgaagctgtgtgataggtacatgaggattcattatgcttgtctgttaacatttggacatctttgaagttttcaccaataagaagcttttttaaaaaaggactaaaccatgataactactagattgtaagagtacctttagggctaggactatatttgtatttatctttgtatcactgaaacctagggcagtatctgacacataattgccattcgatttatttaaatgactgaatattagttatttataatatctccagcactggacttaaagatgcttcatatttctcataattgtggcatacagtcaaaccacacacattaaaaccaattgggaaatggggtaagggagggaatcctgtttgaattaatgagaaattacaaacactttttaaaatataccttcattgttttcaagtaaatgcagtgacagagaacatcctctagcaatgttttcaggtagaggttagaacctgatttaacaaatagattagactaacttgtaaaaaatattttaagtgcctaattcaatgagagggctcaagagaattgaattgtaggttcagctatttcaataacttttggtttactgtaggcaatggcaacttctttaacttctctaagctttattttcctcatctgtaaaattttaaaaactggactggataatttttataggccttttctgttccaaaattcctgtggttataaatgagcagtatctacctaagtactaacaactcatatgctaaatcttttaaaagcagtttttctcttaaatagattatacattcctttgcatgtcttcattcttatttgtactgtatatttttattaatggacccttcctagattatttgatatgaagtcaccgaattaagcagtgaagaaatcaactttagcttggctgaaattcaaattaataaatttactgtaagaagttactttatataaaccagacttctaagatttatccctgaaaaatctgctgcttttcctgaccacagtctttatatgttaaacctctactgataaggccagtcttatagtatgttctacccttcttcctgtaaacttccttagttgagtttgccaatactttcgtattcattcctttgtttgctttaagtttttatttcattttattttttaagtttaatattttatttttatttatatatatatatatatatatatatattttttttttttttttttttttttttttttttgagaccgagtttcactctttcgcccaggctggagtgcagtggtgtgatctcggctcactgcaaactccaccttctggtttcaagtgattcttctgcctcagcctcctgagtagctgggactacaggcatccgccaccacacccggctaatttttgtatgtttagtagagacggggtttcactatgttggccaggctagtctcaaactcctgacctcgtgatcctcccacctcagcctcccaaagttctgggattacaggtgtgagccaccgtgcccgaccctaatattttatttttttagttaaattttaggttcacagaaaagctaacaggaaggcacagagattcccatacatcccctctccccaccacatgcatagcctcctccattccccgccagagtgctacagttattacaattgatgaagctaaattgacatatcataatcatttgaagtccataatttatattagggttcactcttgatgttgtacattctatgggtttggacaaaggtataatggcatgtatgtatcattacaatatcatacagagtattttcactgccctaaaaattctctgtgctccacctattcattcctccttcatcaaccccttactgtctccatagttttgtcttttccagaatgtcatacagttggaatcatacaatatgtagccttttcacattcgcttctttcacttagtaatatgcatttaaggttcctccatgtatttttgtgtcttgatagcactgaatgatattgtattgtatgaacgtatcacattttatttatccattcacctactgaagggcatcttgatttcttccaagttttggcaattgtgaataaagtttctgtaaacattcatgtgcaggtaactttttagctcctttggtaaatattaataccgaggagcatgattgctgggtcatatggtaagactatgtatgtttggtttgtgagaaaccggtagactgtcttccaaagtggctgtacccttttgcattccttcctgccagcaatgaataagagtccctgttgctgtgtgccctcaccagcatttggtgttgtcagtgtttgagattttgaccattctgataggtatgcagtggtaactcattgttttattttgtatttttctgatgatgtatgatttggagcgtctttttatgtgtgtatttgtcatcgtatatcttctttggtaaggtttctgctaaggtctttggcccattcttttctcccaaggattttaggacccttgccagcaacctcagaccaaatacacttctaattataccacagtataataccacagtataaagatccctggcgtttgaccacagatcccaaatataacaaaaggatcataacggttaaaagacactggcacatggccgggcattgtggctcacaactgtaatcccagcactttgggaggccgaggcgggcggatcacaaggtcaggagattgagaccatcctggctgacacagtgaaaccccatctctactaaaaatacaaaaaattagctgggcgtggtggcaggtgcccagctactcgggaggctgtagtcccagctactcgggaggctgaggcaggagaatggcatgaacccgggaggcagagcttgcagtgagccgagattgtgccactgcactctgggcaacagagtgagactccgtctcaaaaaaaaaaaaaaagatactggcacattactggagtcccattcagtcattaataatttgtccagtccatcattatatcatgaaattgtctcccaggtcccagggcaaggctactgaggtttccaggcttctgtttggtcagattccaaaagcaggagtggtctccacaatatatggcttcaccttttcaggcatctggtataattgaactaagagacaatatcatcttttgctttgagactcttttgaagtactgatgtaatattggatttcccttactacataactcatttgttcatttcttactctcatctactattcctccttttttctatttataaccaaacttttccacatttgaaagaacattaggtgctggtccagattacaggcaacactactaatctagcaaatgcctccccctcagtccactcccatttatataaggtagggttatatagatacagaactagtggactatcttgaccattaagcaatacaactgcatttactcttaaccccaattttgctagatagggtaaagacacaccctgcccccaagaggcccttaggaattctgacataaagatttaaaaatatagttaggtttcttgcttaggaatctgccctgtttccaacacttgtagttgcagccatggtcttgctcatgtttcatcaggtaggaaacataaagttgaggtgatatgaggaggaaagaaagaaagaaaaaaatattgtcatcatgccagtgtcctacacccttgggaagaattgcagtcatactagcatccttccccaactcctcttcctcagactcagcagaaaaacagaggagtctatctagtggggacacttccttagccccaccccccatattgagtgtgagcttgtgaaggcatgtaagccagtccttcatccctatgtctgcccccattttagacaaccaatgtttcaattgcttgttccggcttccctttctaactattattccaaggaggatatatctctgcccgttgttggacattatgggttgtaaagtgtgtttcttggtctgagaaaatgtgactcagcagcccaaattggtgcagtatattctgttccagttcttttattacactctgagcatttgcatctaccactgcgtaagcaaaggccaatccagagttagtgtctattcctgtcgaaactcataccctggggctatcagcatcagtctgacttgctagctgtgttcaaggccttccccgtgaggaatctgccacatagccatcttaagtctctgtctcttttgttggaaaacagaacagttattggcattttgtgcttcagagggtacaagaggaatatgtccaggttcaacttcagaggttacaagaggaatatgtctaggttcaactcatttctttttgctgagtccccagatgcccactaatttcgtggacccagggggccgcctcaagggagcacacagagatatccacttgttgattctcatcaccttccaaacctggaaggggattcttctgatggatatcaacatgtcctacattaatgcacctctcagatttccatagtgattttccatagagtcatacaccatacaaacatcctgttaatggaccagttttccatttcccttctgtaagactacatggccaggtcattggccactgccaatgagtcagtcaaaacccaaacacaggggcttttaccactgttcaattcttccttcactgctaggaaaacagcatgcagttctgcctgctaagatgatttgtttttaccttctttgatctgatggtagccttccaaacagaatattgtttgttcaccttggaactgccatgcataaattaagcagctctttgtcaatcagttgagaactgtttatagggcactgtcccaatgacaatagaatccagcagctcctcatgcatttccaaagtcagtcctaggggaaatgagactctgctcatgagtacctcctccttgcattcacaggtagcatgatcatgtatgtataaaccacttccattttattatggagtttttctgggcactgccctcccaattagagtgtttttccaatatcacccaaggcttcatcatgggtatttcagctttcaggattattttcctccaccatccttcccatccttccaagtctccaatgtctattttatccctttctgtgtccatgtatacacattatttagctcccacttatacttgagatgtggcatttgactttctgcttctgagttatttcacttaagataatggcctccagttctatccatgcttctgcaaaagacatggtttcattccttttatggctgagtagtatctcattatatatatataatgtatatatatgtattgtatatgtgtatatatgtattatatatgtgtatatacatatatgtgtatatgtattatatataatatataatgatatatatgtatatataatgatatatatatatataaaaccttcacttattcttcttttgatgcttttcctatctttatgtagatctgagtttctgacctatatcattttccttctctctaaataacttcttttaacatttcttacaaggaaatctactggcaacaaattccttcaactttctttgtctgagaggttttctttcttttaatttaattgttaattttttctgggtacatagtagatgtatatatttatgggctacatgtgatattttgatacaagcatacaatgtgtaataatcacttcagggtacatggggtatccatcacctcaaacatttattgattatacacttttagttgtttttaaatgtataattaaattactttttactatagtcacctagttgtgctagaaaatactagctcttatacattcttcctaactatttctttgtacccattaaccatcctcacttccttctaccccccgcaacccttcccagcctctggtaaccatcgttctactctctatctccatgagttaaattgttttaatttttggctcccacaaataagtgagaacatgtgaagtttgtctttctgtgcctggcttatttcatttaacataatgacctccagttccatcccagttgttgaaaatgacaggatctcaattattttctatggccgaatagtcctccattgtgtatatgtaccacatttcctttatccattcatctgttgacggacacttgggttgcttctgaatcttggctattgtgaatagtgctgcaacaaacatgggagtgcacatatctctttgatgtactgactatctcttccttctttccttctgtcctgtcttccttttagtgaaggtgatttttctctggtggtatgatttaacttctttgtttttttgtgtgtgtatctgttttatgttttttatttgaggttatcatgaggcttgcaaataatatcttttaacccattattttaatctgatgacttaacactgcttgcataaacaaattaactactaacaagcaaaagaaaaataatacaaattctacagcttaacttcttcccctcactttttaactttttgttgtttctatttatatcttatactgtctatgtcttgaaaagttgttatatttattatttttggttggttcatcttttacttttagtttttctatttaagggtagtttatacactgtacttacagtgctataatattgtgtttttttctgtgtatttatatattactagtgagttttgtaccttcagatgcttttttcttgctcattaacatcctttcatttctgattaaagtactccctttaacatttcttttaggacaggtctggtgttgacgaaatccctcagcttttgtttgtctgggaaagcctttatttctcctacatgtttaaaggatatttttgccagataatactattctagggtaaaagttttttccttcaacactttgaatacgtcatgccattgtctcccagttgtaaggtttccatggaaaagtttgctgccaagcatattgcaacgccattgtatgttgtttcttttctgttgcttttaggattctttctttatcctgaacctttgagagtttgataattaaatgtcttgaggtagtcttctttgggttaaatctacttggtgttctgtaactttcttgtacttggatattgatatctttctctagatttctctagttttctattattatccctttaagaaactttctacccatgtcactttctctgcctcttcttcaaggccattaactcttacatttgctcttttaaaactgtcttctagatcttgtagctgtgcatcatttttaaattcttttttcttttttcctctcaccgtgtgttttcaaatagtgtgtctttgagctaactagttatttcttctgcctgatcagttctactatttagaaactctgatatattcttcaattgcatttttcaactccagaatttctgcttgattcttaattattttaatttctttgttaaatttatgtgatagagttctgaatttcttctctgttattttgaatttgaatttcctcaaaacagctattttgaattctctttctgaatggtcacatacctctgtttctccagaactggtccctggtgtcttatttagttcatttggtgacatcatgttttcctgggtggtcttgatgcttctgggtgttcatcagtatctgggcactgaataattagtattattgtagtctttgcattctgggcttatttgtacctgtccttcttgggagggctttcgtgatatttaaaagtacttgggtgctgtgatctaagctgtatctgcattaggggacaccacaagcccagtaatgctatagttcttggagactcatagaggtactaccttggtggtcttgaataaggtccggaagaattctctagattaccaagcagaaactcttgttctcttcccttactttcccccaaacaaacggagtctctctctctctctcgctctttctctgtctctctctctcactctctcctgaactgtctggcattgggggtatgttgatacaagcacccctatggccattaccactagaactgcactgggtcagacttgaagccaacacagccctggttctcacccaaggcccactgtaagcactacctgactaccacctgtgttgttggttcaaggccttagggctctgcaatcagcaagtggtgaaaccagctagtcctgtgtcctcttcagggcagcaagttcccccaggccccaggtgagtccagagaagctgtccaggagccagggacggcagtcaaaaaccttagaagtgtagctcagatgttctcttctactgtggctgagctggctgtcaaaccatgagacacagtccttcccactcttccctcccacttccacaggcccatggggagtactgccagcctaccgctgatgttcacttaaagcctgaggacttttcagtcaccttgtggtaaatgctgccaggccttatttcacctttcagggcagtgggctcccctctggcccaaggcaggtccagaaataccactcaagagccaaggcctagaattggggatcctgagatcccgcttgatgctctaccctactgtggctgagctggtacctaaggcataagacaaagtcctctttacttttccctctgcttttctcaagcagaaggagtctctcaccatagctgccatagctgggaatgtggtggatctcacctgaagccagcacatctcagagtttcacccaaggcctacagtgtactacttgggatcactgctgattattcatggcccaagggctcttcagtcaacaggtgatggatccttccgggactgggtccttcccttcaaggcaatgggttctcttctggcccagggtgtgcatcaaaatgtcatccaggagctagagcctggaatgggggtctcatgcctctgcccagtgccctatcctactgtggatgatctgatatccaagatgcaagacaaagtcttccctctcttccctctcttctcttcaagcggaaggaagaggtctcctttggagccacaagctatgctacccagggttggggaggggtggaacaagcacccccttagctaccccagctggtggctcagtaagttgcgtgcccccaagtccattggttctgagcccagctcagcactaagacttgcagtccttgtggcctagactgtctttcaagtttatttagagccccagagcactttagcccatgatgacgaggcttgctggaattcagattccaacgactgggatgggagattccccacttgctacagctggtccaaatgttccctctgttagcgggagttggctgtgtttagcccagttttccttcctgctgtgacagggcagcactgagttcagtgcaaagtctgataatctctgcactctctctctctttctcaagtgcgcagatttctctgcaccaggcagctgctgggggatagggaaggggtggcattggtgattaaagactgtctttcctaccctcttcagttcctctttcaacaatatgaagttggaaccagatactgtgagtgctcacctgatttttggttcttatgagagtcattttttgtatgtagacagtggttaaatttggtgttcctacggtgggggaggatgatgggtgggccttctgttccataatcttgctccacccctgtgtctgagagtctttattttccttcacttttgaagtataatttcacaaggtacaaaattctgggttagtgggattttctctcaacatttaaataatttgcttcagtctcttcttttttgtgtggtttctgagcagaagtagaatgtaattcttatctttgttcctctttaggtaaggtattttttcctcaggctttttttcagaattttgtctgtatattttatttcctgtagtttgaaaataaaatgcctagatgtctttttttgtcatttgtcctgtttgatgttctgagcttcctgaatctgtgatttgatatatatgacattaatttggggaaattctcagtcatattatttgaagtattttttctgttgcattacctattcttctccttctggtattcccattacacatatgttacaccttttgtagttgtctcacagtccttggatattctgttctatttttttcagtctttgttctctttgcttttcagtttgggaggtttctgtttatataccctcaagggcagagatttttttttttcctcagctttgttcaatctactaataagcccatcaaaggttttctcatttctgttacagtgtttttgatcactagcattcctttttggttcttaggatttccatctctctgattactttgctgatctgcccttgcatgctgtccactttatccattagagcccttagaataattatcataatcgtgatcaattatcatagttgtcttaaattcccagtctgataattccaacgttcctgctatgtctagttctagtgcttgctctgtgtcttcaaattgtattttctgccttttagtatgccttctaattttttcttaaaagctgggcatgatgtaccaggtaaaaggaactattagtttcctaataaataggcctttagtaatgtggtggtgaattgtggggagaggggaagcattattattattattattattattgagatggtgtctcgttctgtcacccaggctggaatgcagtggcatgatcatggctcactatagccttgacccccacccaggcccaagtgatcctcacacctcagtctccagagtagctggaactgcaggcatgtgcaaccacagctggctgatttttaaatttctgtagaaatgtggtctcactgtgttgcccagactagtctcaaactcctggattcaagcaatcctcccgccttggcatcaaaaatgctgggattacaggcatgagccactgcacctggctgggaagcattgtttagtcctatgattggtcttttagcaagcctatacctctggactgtgaacttcacaagtgcttctcaggtttttttctcccccattaagtgggacaggatggctagagtggactgaatttgagtatttcccttctccgagatcagttaggctctgatataccccagaaggtcaggctgtggttaagcagtttctcttgagggcaagacttgttaagaacagggtgctctggcatgttttaaagtgttttgtttcctctgccccctgcaagatgcataaagagattttgctccaatattcactgagtagctaaccaagctcctggaggcaaaactcacaaaactgtggaggcctccttatgactgggtcctcctgagtcttttaattcagacttgtccacactgagcctccagtggtttgtcagttacgcttcaggttttcctactccagcattggttcccatggtagtttccacttttgaatctctgctctagtaagctatgactccctatcttcgcccttctctccaatttttgtggcagtggttttccctttttcctctcgtctcttataggtccaagaagagttactaatttttcagtgtgttcagcgttttacttgttaggagaaactggcaacttccaagctccttacatgcataactagaaaccggaagttctcttttaaattttatatgcttaaagaagcttgacagaggggtcaggaaacctgggtctactcttttcttcatctgtaaaatgatgtgtctgtacaagataagttattttttaagctgcattccttagaaccgtggaaattttgtggcactgcatcagggacttccaggaaggtgaaactccaagcctccacccactcctcgttcaaccacagcagctcaacttttatcttttatcttttcttgtatattagacttttatacaactttacttgaaataagggttctagttccccccttcaaaaaagcttataaatcacagagatcaccagctgctctcaagtgttatgaccctacaatataaaaccttgtcattgaaatcctttgctgagagtttatgaagaagtagaagagagaaaaaatatgagggcactgggaatgagtaactgtatcctacagtggggaagaagattgttgaaatggtagattggagtcctgagcaaaaaacttcacaattttgcattttcttagttcaattctcaggcacaaatagtgtccctttttagttatgttttatagtaaagatttggagcagttggaaaatatccttttctttatttttaggaagaaagaaatggatcgacttttgacttgcctgaatagaggtaaatatctccctggttatattcagtccttcatcttgcctctattctctgttgaattctccaagtacactaagcacagcaactttaaccttatgtttgagttaagcttcatgctccttattaatctttgccacaggaatctattttggtttcttcattcacaagcagagaaaagtgtgtcatcattagcattcatctccaaatgtgatttcagttctgttttaattcctatttgttttaaggacatttccttccctccctccctcccgtccctccctccctccctccctctcttccttccttccttccttctttctctccttcccccttccctccctcctttcctttccttctctcccttcctcccttctctccctccctgtccctctacctttcttttctagtagccacttgatcctaacctaagaattgaacaggtgaaaaaagatcaagacaaataaaaatactctgaaccctgctgtttttttcataccctctgaatcaaattcaggttgcatattctcttattttgaagctgtccacccaagtctgtgccatctcccttatctactaataatttttccctgtccactttattcaagctaatctcctagttgtatcacattttttttctaactacatgcttttttacatggcatcccttttaacagatctcccatttttactgtccatgtacctctttccttatgtccaaaacacaccaaaaagttcatatcttagaaattctatcctgctcagtgcagtagttcaattttatacctcaaatacctgtcagcagggtgttaaacatagcaaagtggtttagaaaccagaccacttcttttcaaaagagaaaaactttgctggttggcattcttatttctcagaaagagaatgccttctgatagtgatagcacattctggttctgtcctgagcttgctggctcagtaaatattatgccagcatattgatacccttctaattttcaatctccagttcagtcttttaaacgattgtttctattttttatttcctcacatgtaaatcatatctttctacctcaggtggtgaatgattgcactaattaaaattataaatctctccaaagacatgtttgttccccagagtttgagttaacaacttcttggaacttggtaatgctttctgtcattttaattacttttggtatgcacccctacacacatacacaaaaaagaactttctaaattcaaactcctgtgagactgttcttaaagcaggattaaacaattttgctagagtataaaataagaccatcagtatcaaattttcctgtttgatgcagcctttgtgaaactttctcagccttttggtgaagaagccttaagtttggagtcaagagctaatgaagctcagtggtttcgaaaaacaggtaagaggaaattctgtggctctgggaaacattgtggggtggtggaattagacagatgtgatttcaaattctggatctttcatttgtagctgtgggtacagagataacttgcttaatctgttttattacttataaaatggaaatagttatatatacttcatgcagttattaagggttttaaatgaaacagcatatatacttttttcatagtagatactcaatggacattagttgtgtcccttttctatagaaatgggtctaagatgaaactaatgaactgtaactacaggtcctcaaggttgtgctcctaaacttggtttagaatacttaattttttttttttttttttgagatggagtctcgctctgtcgcccaggctggagtgcagtggcttgatctcagctcactgccagctccgcctcccgggttcacaccattctcctgcctcagcctccctagtagctgggactacaggcacccgccaccacgcccggctaattttttgtatttttagtagagacggggtttcaccgtgttagccaggatggtctcgatctcctgacctcgtgatccacctgcctcggcctcccaaagtgctaggattacaggcgtaagccaccgtgcctggcctagaatacttaatttatttctgagtgtgattgaccaaaaatgaactatatacaacaatatggatgaatctcacaaacataatgttgagcaaaagaagctagatattgaagaatacatattgtgttgttcattttatttataattttttaaatgggcaaaactaatatatggtgttataagtcaggataatggttaccctggaaaaggagttggacttgaaagttgtaggagcttcagggtttctggtaatgttcaagatctttcttaatgtgggtgccagacgcatggatatgtccactttgtgaaaattcatcaagctgtacaattatgagttgtgtaatatactttataatggctctatttcaataaaaatgattttaaaacttgcggaggcagttactacagtgataagtaagcatgagcaattaagcagcagtgccacaaagtggactgattctacatgaacctctccctgtgttatgaggtttaatagggctttaatcctgggagaaagggaatgaatactgcaatctgacttctaagaaactgatgcaaataatgaaaaataacaaacatttaaaatatagacaagtttggtgactttaatcttttgaaggtttgaaaaggaatgtttttactttactgcattttaatttggattttccaaggggaagatgatgctgactgatgcctgatgagggcttctactgctctttggaagatatgaatctctccagtaatttttctcaactcttgattacagtgtaccttgttcttaggtgaattttaacttactttcaccactgcgagttagtgagctctatccatgttgatcttcatttttagatagattagtgtcaattaagaattttttttttttttgagacggagttttgctgccagactggagtgcagtggtggcatcatagctcactgtaacctcaaattcctggtgtcagtcttctgggactatagttgtgtgccaccacacctggctagttttgttttgttttggtttgttttttaatttttttgtatagacggagtctctctctgttgcccaggctggtcctgaactcctggcctctagcaatcctcctgccttggtctcccaaagttctgggattataggaatgagccaccaagcctggcctcagctaagaattcttattgcatgtccccaattttaaaaaattcagcagtacctcccttggtcattggtctagtgttgaagattggaattgacgagggtctctaaatttacctggaaaatttttctttaaaacctaaagttaattgtttaaaccttgagaaaccccttactagtatgttaatatcaaaggtgtaagtatcagaaattgtaatggtacagactaaatggtagattttcataatttcatattattatgttatttcatgttaatttccagcttggaacttggctgtgcaatgtgacaaagatccagtgatgatgagagagttttttatactttcttataaggtaagtttcttttaataagtatctcatgtatggaccacaacaaggctataaccactatggctatagtaaagggctaaatatagactaggattgtctcttgatctaggaacttttaatatatatgtaagcaggaatgacctaagaagaatttgttccttttagggtataacataagaatgtggggcatatctttctataccaaaatatcagaaacattcatcagggagcctaaagttctaccatttaagacttatttctttgcctttgaagggatctcagcctcccaaagtcctatattaaaatgtaaatatctttaggaggggaatactctaagtagttgttaattaccaacacattatgaagagttatgggaataagtctacaagaacatagaataagtatctggggatagcaggggctgaaaaaagagataagaagcttaggcctcctttataactttcctatagcaggtcctgagtgtagcgatttgtgagtttgttatttaattataagcatttttaaatagtcgttggcctccaaggtagaggttaaatgccagaaagaggaccaagtattgacaggaagataaaaggagaaggactaaagaatatccttcatacacattcaggaatacacagtatgatatgttgagatcaattaaatgttaagagttttagagctagaaagaactataaagactatctagcacaactccttcatctcacataagagtaatcagagacctaaagagattggttgtcttaaaatgctattaatttaataacaatgatgattatgatcactgaatgtttggggagattaagaaatagtctttgcaagtttaggcataactgccattttaattaagtgaaataaattggttttagttttggcatttgtgatgggacttgtaggattggcgtgtaagaatccaaatggcctagagttttattgtagtagctgggagtttttcctaaaactatacaatgttaatgatgaggtcatgactaatgcctgtcaagatttgacaatgcctctttcaaccatgacaatatatgaactaattttggctctattcaatacaaaggtggaaatcttatttgccaggggaaaaatcacttacaaattacaacataaaccaagaagtaaatcactagatagaaatacaagggcgaatgatactacttgtcactggaaaagataggaatactgtgaagaaatgaagctttttatctctaggaaggtactaaaaacaatggaaagtaatataaaattaaaagcataaatcagtattatagtttatatcatttctatggtgacatgtgcttttccagctgaattttctcattcaaacaggaagttgctgattttcattctgattgtttgtgttcacctggcagaattctcactattcattgatgttctggttacttcttatcagatgtcccagttttgtccttctgatcaagtaattctgattgcacggaaaacatgtttacttatggcagttgcagttgatctagagcaagggagaaaagcttcaacagcttttgaacaggtaatgtgcaaccttcaaagaaaagacaagagttcagtgtgctatttgatatgtttgccttccctgatgcagttctttttgattctctttagagaatccttttctccactccagcatcgtcttgatttcaaaagtttgtaatggctaattccttcctaagcaaaggttacttttggtgtggcctcttcttttaagaagattagatatctcttcttttaaaattccccttcctatggaccactctttccaaaaatgtttttaaatatcttttatcttcattgtctgcctgtgattatatacgcgtttggactccacttttgtttcttaccacatcttctaaggaagaactcatctgtttccatagctttgatagccatctgaaattattacttatctggtttttcttctctcaattgcatttgctttctttttcccacatccttaaatatctcattaacttaatttctacaagacagaattccttacctttgcctgaattcccctatcagattcttaaatgttaccccttttaggagctatcaatatcaccgtctcccatacaccagattattggtttgcttttagctgtttacctttcttctttcaatctaagaaaattgtctccaaatcagaccaatagcatttttgtatgatttttaagatctagatctctctgcttggtttctcgtacctggacaaagaaaacttcctaatctcccatacttgtcaccttccctcctctccaagtaatataaaccctttgctgtttattctcttcctcctgttaatctcttatttcatattgttctttggatctgaaacaaactctcaccagagctatgccaactatttcgcttcttttcccttccattgttgagttcaactcaaaaaacatttgagcaccagacacttttctaggtactggggatacagagataaagaagccaaagtccttgcctctgaggagtaaagggggccctcttttaagagtctttttattttaaaagaagatgagaaaagactctaccttccccagagcaaaataaacaaacaaaaattctacttaacaggcaaaggtaaatgtaatttaattctcaatagggacttttgctttactaaaaaataataataacatcttatttttatatagtgcttttaaatttctaaaagtttttcctttttggttggtaatcctgagtttgtttaattttttatcttagtgaatagagatcaaattgatgtgggggaaatttcacaaactcttaagtacaatcattattttgtttgtttctaactaccgttcttttttattctgtgttctttctcatgtacacctctgtgttttctcagaactctctaaactagtaacctttctataatcttctttgcttttgaaaggatgtctatatacataattgaagatgcacttctgccttttatcatctaagtgtggtccctatgaatcggacagtggtactctgtctctctaaagaatacttgttgttcatgtccttcgcccactttttgatggggttgtttgtttttttcttgtaaatttgttggagttccttgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccactgcttttggtgttttagacatgaagtccttgcccatgcctatgtcctgaatggtaatgcctaggtttcctttagggtttttatggttttaggtcgaatgtttaagtctttaatccatcttgaattgatttttgtataaggtgtaaggaagggatccagtttcagctttctacatatggctagccagttttcccagcaccgtttattaaatagggaatcctttccccattgcttgtttttctcaggtttgtcaaagatcagagagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcctttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaagttggattcctaggtattttattctctttgaagcaattgtgaatgggagttctctcatgatttggctctctgtttgtctgttattggtgtataagaatgcttctgatttttgtacattgattttgtatcctgagactttgctgaagttgcttatcagcttaaggagattttgggctgagacaatggggttttctagatatacaatcatgtcatctgcaaacagggacaatttgacttcctcttttcctaattggataccctttatttccttctcctgcctaattgccgtggccagaacttccaacactatgttgaataggagtggtgagagagggcatccctgtcttgtgccagttttcaaagggaatgcttccagtgtttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattatattgaggatttttgcatcaatgttcatcaaggatattggtctaaaattctcttttttggttgtgtctctgcccggctttggtatcagaatgatgctggcctccagccgccccatccgggagggaggtgggggggtcagccccccgcccggccagccgccctatccaggaggtgaggggcgcttctgcccggccgcccctactgggaagtgaggagcccctctgcccggccaggaccccatctgggaggtgtgcccagcggctcattggggatgggccatgatgacaatggcggttttgtggaatagaaaggcgggaagggtggggaaaaaattgagaaatcggatggttgccgggtctgtgtggatagaagtggacatgggagacttttcattttgttctgtactaagagaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcagaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaaagaatgatgctggcctcataaaatgagttagggaggattccctctttttctattgattggaatagtttcagaaggtatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacctagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcaaagctgagttcaattcctgggtatccttattgacattctgtctcattgatctgtctaatgttgatggtgggaagttaaagtctcccattattaatgtgtgggagtctaagtctctttgtaggtcactcaggacttgctttatgaatctgggtgctcctgtattgggtgcatatatatccaatacgaagacatttatgcagccaaaaaacacacgaaaaaatgttcatcatcactggccatcagagaaatgcaaatcaaaaccacaatgacataccatctcacaccagttagaatggcaatcgttaaaaagtcaggaaacaacaggtgctggagaggatgtggagaaataggaacacttttacactgttggttggactgtaaactagttcaaccattgtggaagtcagtgtggcaattcctcagggatctagaactagaaataccatttgacccagcaatcccattactgggtatatacccaaaggactataaatcatgctgctataaatacacatgcacacgtatgtttattgaggcattattcacaatagcaaaggctaggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacagaaaaccaaacaccgcatattctcactcataggtgggtattgaacaatgagatcacatggacacaggaaggggaacatcacactctggggactgttgtggggtggggggagggggagggatagcattgagaggtatacctaatgctagatgacgagttagtgggtgcagcgcaccagcatggcacatgtatacatatgtaactaacctgcacaatgtgcacatgtaccctaaaacttaaagtataataataaaaaaaaaagaatacttgttgatttctgttgtatacatctgctccctgttctctaaaccctcataagtgggaatatttccaaataagtagctgatgaaggaatatagatggactgcatagttttatcaacattgcctctacccttctgagtatgagttaggagaaattgagggataggtaaaaaacatattctaattgtaatttgtcaaggaaccacaccttcttcctagagcaggagtgggtaaactactgccagctggccaaatcaggcccctggggggttgtagttgaaaataaagaaaataaagaaaaatatttctttattttatttatttatttctttattttctttatttcttttcttttatttgtatatggctaggaaagcctaaaatatttactgtctggccttttgtacaaaaagtgtcctgatccctatccttgattatattttaacagacttattgaggcataattcacataccttataattcacccacttaggtatacaatttattggtttttagaatattcttagaattgtgcaactgttgatacaatctaattttagaacatttttatcaccctaaaaagaaaccccttacccacttagcaatcacttctcattgcctgccaccagcactaagcaaccatgtactttctgtctatataggcttgcctattccagatatttcgtataaatgtcatcatcatcatattttacacgaaagtcaaatgttttttgatgtgtagtcttttctgactggctccttgtataaatgcctgaataacattttcaaggttctttgtgttgtagcatgtatcagtgtttcatttctttttatggctgaattatattccattgtataaatatatcacatttttaaaatccattcatccattgatggacatttgggttgtttccaattttcagctcttgtgaataatgccgtgatgaacaatttatgtacaaatttttgcatggaaatctgttttcatttctttcaatatgaaatatacctaggattggtattgctgggtcatacagtaactctatgtttcatcatttgaggaatgctggagtttttcaaagcacctgcaccattttacattccaaccaggactgaatgaggattccaatttctccacctccttgccaccacttgttattatatctttttaattatagccgtcctagtgagtataaattgatacctcattgtggttttgatgtgcatttccattatgactaatgatgttgagaatcttttcgtgtgtttattggccatttgtatatcttctttggaaaatatctattgaaatctttttgcatttatctatttatttagagatggagtcttgttctgtcacccaagctggagtgcagtggcacgatctcagctcactgcaatctctgcctcccaggttcaagtgattctcctgcctcagcctcccaagtagctgggactacagccacacaccactgtgcccagctaatttttgtatttttgtagagacagggttttgccatgttggccaggttggtctcaaactccttatctcaactgatccccccacctcggccttccaaagtgcttcatgctcattttaaattagcctatttgtctttttaccactgagttgtaataattctttatatattctttatactatactcttatcaaatacatgatttgcaattattttctcctgttctgtggtttgtcttttccatttcttgctagtgccctttgaaatacatttttaattttgatgatatccattttatttattttgttatcatatctaagaccattttctaatccaaagtcatgaaggtttacctcaatgttttcttgtaaggttttttatattttcagctcttacatgtagatctgtgatccattttgagttaatttttgtgtatggtgtgagataggggtccaactttattgttttgcatttgaatatccatttgtcctagtactatttgttgaagactgttttttccccttgaattatcttcgtgccattgttgaaaatcacttgaccacaaatgagaaggtttattctcaattctattccattgacatctatgtctatcctcagggcaataccacattgccttgataattatagctttatgtagtacattttgaaatagggaggtgttagtcccccctcattgttcttctttttaaagattgttctggctattctaggtccctggaatttccattaggaccaacttgttgatttctgcaaaaaagccagctgtgattttgataggggttgcattgaaactgtaaatcagtttagggagaatattaaagcctctgattcatgaacatggaatatctttccatttatttaggtttttcacttctttcaacaatgttttgtggttttcagattataaatttttcactactttttgtagtctcttcagattttgtatttcctcttgagtcagttttagtagtttatctttctagaaatttatccattacatctaagttatagaatttgttggtttacagttgttcatagtattcccttatagtcctctttatttttgtaaggtcagtagtgatacctcctcttttactcctaattttagttatttgtgtcttctctctttttgttcttggtcagtatagacaaaagtatatcaatttgttgttcttttcgagaacaacttttggtttcattttttctattgcatttctagtctctatttcattaattcccactcaaatcttccttctgcttgcttacagttcaatttgctttgtttttacagcttcttaaggtaaaacttggagttactgatttgagatatttcttttttttaatatcaacttttgcagctataaatttcccttcaagaactgcattaaactgcatcccatacattttggtatgttgtatttttttcattcatctcaaaatattttctaattttaattatgttttcctgtttgacccatttattatttaggaatctgttgtttaattttcacatatttgtgaatttcccaaattgttttctcttgctgattttaaattttattccactgtggtcagagtacatactttgtgacttcaattattttaaatttatttgaagtttgtgttatggcctagcatgtcagctatcctagagaaagtgccatgcatatgtgcttgagaagaatgtacattctacttgggttagtgaaatgttttatggctattaggtctagtaggttgatagtgttgttcaagtgttctatatccttgatggttttctgcctacttattctattcattacttaaagtgggctattgaagtctccaactaataaaagttgaagtatctatttctttcttcaattctacccagttttgctttatatttttggggctctgttgttaggtcatatatgtttataattgctatacatttccaatggattggcccttttaacattataaaattttcctctttgttcctagtaattttttttttgttttagagtctatttttgtcttattttagtagtgtcaccctaacattcttatggtcaatgtttccataacataactttttccatcctttcacaatcaacctatttatttgtctctgaacctaatatgtgtctcttgtagacagaatgtagttgggtcatctttgtttcaatatgataatctttgtcttttattgggttgtttaatgcactcacatttaatgttactatttttatggttgaatttacttatgccactttactttttggtttctatatatctcatgtattttttattcctgattttctcctttactcttttcttttgcattaagtgaatgttttctaatataacatttttgttcttttaatgatttttacacaatatttgagttattttcttagtggtcactctggggcttacaatatagatcttaatttatcagaatctacatcagattataaacccaatttcagtgagatatagaaatgctattcctattagctctgttctctcctctttttttatgctattttgttatacacattacatctatatatgctccaaacacaacaatacatcttatagtatcactttatagaattttaagtattttaaagaaactcagagaagaagccgggtgtggtagctcacacctgtaaacctagcactttgggaggccgaggtgggcagatcacttgaggtcaggagttcaaaatcagcctggccaacatggtgaaaccccatctctactaaaaatacacacaaaattagctgggcatggtggcaggtgcctataatcccagctactcaggaggctaaggcaggagaatcacttgaatccggcaggcagaggttgcagtgagccaagatcgcgccattgcactccagcccgggcaacaagagcgaaactctgtctcaaaaataaagaaacttagagaagaaagtatatattatggtttcttatattaagcatcttacttaccttttatgcttttcctcattttttcctgtagattagagttactatatggtctctggattagtctgttctctcacacactatgaagaaatacctgagactgggtaattcataaaggaaagcggtttaattgactcatagttccacatggatggggaggcctcaggaaacttagaatcatgatggaaggcacctcttcacagggtagcaggaaagagaatgaaagccgagtgaagtgggaagccacttacagaaccatcagatcttgtgagaatttactatcacgagaatagcatgggggaaactgcccccatgattcaattacctcccactgggtccctcgcaccacacatggggattatgggaactacaattcaaggtgagatttgtgtggggacacagccaaaccatatcagtctcattttcttactccaaaacaactttcttcccacctgcctcttgtgctgttattgtcaaatatatttcatttctatatatcagaggcccaacaatacaaatatatattcacatatatgtgtatatatattgtttttttaaaacaagagaagaagaaatatacatttatattaatactatcttttataattatataattaatgctaccagtgctctttgttttttcatctggattcaaattactgcctggcattacttgcttttcagcctgaaagattgtctcttagcaacgaattctctcagctcttatttatccagggacatctttatttcaccttctctgaataatagttttgctaggtattagattattagtagacttttatttttctttgatcactttggatatgttgtcccactgccttctggcctttattgtttttaatgagaaatcagctattaatcttaatcacccgtacatgtggcgagtcatgtttctctttgctagtttcaaatttttctttgtcttttaccattttgtaatgtatcttggttggatatctttgtgtttcttgatcccacctagagttttttgggcttcttgagtgtgtagattattgtttttcatcaaaattagggaattttcagccatttgtttaaaatattttttctctttttcgctccttttcttttggtaatcccattatgggtatattggtgtgcctaatggtgtcccatgttttactgaggcttggtttattttttttctttttcattctgctctcatattttgtaatctctgctaatctatcttcatgtttgctgattgcttcctctgctaagtcaaacctaatgttgataccctctagtgagttttaaaatttcatttattgtagttttcaactccagaatttccatctgatttttataatttttatccttttattgagattcatttttgatgaacatttttatcataccttctttctttaagtgtggtttcatttagtatttgaatatatttaaaatagctgctttgaattctgtgtctattaagtttaacatctgggctttttcaaaatcagttcctgttacctgcttttttcctatgtagaagtcacactttcctgtctctttgcatatcttgtaattttctgttgaaaactggacgttttagataatatgttgtagtatctttgggtactgatctccccatggggtttgtggatgttaatgtttgcttctttatttgtttagtgaattagctatagggaaatagtgaagtctattttccccatggtacatagactctgatgtcactctttggaaggcacagtctttgcctgtgcaaagactgcttatacctccctctggtaaaggatgacagtgattttaggagagttctttattactcttttcctgatctgacctcttaagcttctagatgaccttcttctattggtagcacatccagctgttagtcttgactaattgctaggtgattactgtgtgtgtgcgtgtgcgtgtgtgtgtgtgtgtgtgtgtgtgtgtgtgtgtgtgttaaaatgctcttgtgcataaattgccccacagcctgttccaattaaaagaagacccctttgaaggaatagaaatcttcttagctgtctcttcacatacttctctctataaacttctagttggtctattattttcttcttaatatcattgagctatcaatctcctcttaattgctcactaccaaaatctccatgattttttacagtgtccttagacttgaacttccccacgctctgttccaattaaagtcatttcctttagggagtgctatagatctgcctctcctactgggcagaaactgaaccactgttttggagctaggggcagggacagtggcccacttctgtcagagtgacaatccaattgtatgagtggaagactggacaagagttgtagtccctgatagtcttggcttgctgctcccagcatggacactctatcctataagcagctgagatgagagctgagatgagagagctgagatgagatgagattgagacccaggatcctgagcttgcaatgcctgggatagagcttttgccttacaaatagaggctgggtagagaaagagagttctaggcctctgagctatgcttgtttataatagagcttctacaatagagatctggggggatgagaagtgccagcattctggcccttcagagaatccctagcccagaaactggaggtagagagagtcctatcttcttggccacacccacctaaagtagtgcttacatcacactgagctggcggatggtgagtgaatcatagcttaaatgtcacaggctcttactgttcttactaagacttagtagatttcctggaataaatgtttcttcattttctgtataccctcagggcaatttcctgagcctttacatgattatgttttctaattttcactagttatgatgattgttttgctgaggagaggatccatggagctcctcacacaaccattctagaagtgtttctcttctgttctagattgttaaagaaattgataatgctcaagattttctatttaatcctcatttttctgaaacagtaaggaaatgtgaaaatagaggctaatatttctatataaactccaaaatgttcagtttaaactatcatttttctattaatttatttttacctgtttttaatgaaaatgatatgagattatattaatttgcttaaagttcttttttgttgggactaattaacttgttgcactgttgccaaacagaccatgttcctgagtcgtgcacttgaggagatccagacatgcaatgacatccataatttcctgaaacaaacaggtacagtaggaactggaagtttggtaacacagtttgaaaggagcttagaatcgaataaacaagtcttttgtcaccagaaatttgtgccactgcagtacttgataaccagtcaaatgttttttttttctgttgttttgtttgttttttcgagtcagggtctcactgtgtcacccaggctggagcgtggtgatgtgatcttggctcactgcaacctctgccttctgggttcaagcaattttcccacctcagcctcctgagtagctgggaatacaggcatgcactacaacgcctggctaaacttttctattttttggtagatatagggtttcaccatgttggccaggctggtctcgaactcctgacctcaagtgatttgcccacctcggcctcccaaagtactgggattacaggtgtgagccaccactcccagcccagatgattctttaagagctgattttttccccactctatatcagtattgactctgtaacacactacttagattaagaatattttttactttgctttatatgaaagtatagcattaaatattttattattgtttaacataatattatcaatcttagatcactagatttaatgtctaatttaatcaagctttaactttgactaaatgtaggctagtcttcacaatcaagataacagatactgctaatattttgttataaaattatctaaataggctgcatgcagtggctcacgcctgtaatcccagcactttgggaggccgaggcgggcagatcacctgagattaggagtttgaggccagcctgaccaacacggagaaagcccgtctctaccaaaaatacaaagttagccaggcatggtggcacatgcctgtaatcccagctactcaggaggctgaggcatccttgaatctcttgaacccaggaggcaggggttgcagtgagccaagatcatgccattgcactccagcctgggcaacaagagcgaaactctgtctcaaaataaataaataaatacataaatacacaaataaataaataaataaaataatctaaacagtagtaagcctttggaagttatataatatcttgattctatttcctgattaaatatggtattggcttttaggtttagactgaagtttttacaatgtgtttttctgtccctgtttcagaatttgttaaaatcaatggatattcaattgaattacatgctttttcagactttatggagatagtcatatttttctcttttgaactattaatatattgagttataataatagattttataaaattaagtcatcatttcattcctggaataaaccctatttggtcatagtatgttattattttaatatattgatgaattctgttttccaacatttagaaattattggtctgtcactttgtttttgcttatgtgttatgtctttggcagtttgagtatcaaattataggaattataaggaagaacataaacatatgaaatttaatttacttctcgtagtctatgacagtcacttaaatgaataaaaacaacaaaaagtaaagatagagaaaacccaaataaaatacttattatagaagatttaatgggagtaaaactctgtagcctgaaaatatactgtgtatcctgagaacagaaaacatatcatcttttcgtgtgccttttgaagttttacaaaattgatgtcaaggaagacctgaataaattctaagacatgtaaataaaacagacaacatcgtctgatcacaatgcaaaaactagagattaacattggaatcattcttttgaaataccctaccacctggacattttttaaaaacccaaactacagtatacctaggctctaatggtaatgaaaataactcatagtagaatttaaagtgctaaagcagtgctcagagcaaattcattgcctccgtgacttttctttaagcaagtatgcagtggctcacgcctgtaatcccagtactttgggaggccgaggtgggtggatcacatgaggccaggaattcgagaccaccctgccaacatgacgaaaccccatctctactgaaaatacaaaaaccagccaaatatggtggcatgtgcccgtaatcccagctactcgggagcctgagacacgagaatcgcttgaaccccgcaggcggagtttgcagtaagcctagattgtccactgcactccagcctgggcagcacagcaagacactgtttccaaaaaaataaaaaataaaaaagtatgtcagaatgctaactgtccaccaaaaaaaatgaatttcttcttttttaggaatacaactaggctatagatagagtagatagagagatatagtgagatagagataaatgcctctctatatatacatatatatagtctaagtatatttttatacacacagctagactatatacatatatatatgtatctatatagtttatatatagacttcaggcaatcttcagagttttttttaactgtctatacattatagagatttaatggctgtagttaattaaggtgactaatatcagaatgaaggaaagtaaaattccctattggaaaacagtacattatttcatgaaagttttgtggtaaaatatatataacataaaatatgctattttgaccatttttaagtgtacagttgtacaaccattaccactatctatttttaaattttttcatcatcccaaacagaaactctgtatccattaaagaataatttccccattccccctttctccagcccctggtaacctctcatatgcttactgcctctatgaatttgcctattctagatatttctttctttttttttttttttgagttggggttttggtctgttgcttaggatggagtgcagtggcacaatcatagctcactgcagccttgaaccctgcgctcaagctatcctcccaccttgacctccttaagtgctgtgattacaggtgtgaaccaccatgcccaaccctagatatttcctttaagtgaatcatacaatatttgtctttttgtaactggcttatttcacttagcataatgtattcaagattcgtccatgtcatagcatgtgtcaaaattcccttccattttaaggctgaattctattccatcatatggtgtattagtccattttcatactgctgtaaagaactgcctgagactgggtaatttataaaggaaagaggtttaattgactcacagttcagcatggctggggaggccttaggaaacttagaatcatggcagaaggcgaaggggaagcaaggcaccttcttcacaaggtgatgggaaggagaagtgccgagtgaaggggaagagtcccttataaaaccatcagatctcatgagaactcactatcacgagaagggcaagagggaaattgcccttgtgattcaatcacctccacccaatctctcccttaatacatgggaattatggggattacaattcaagaagagatttgggtggagacacaaagcctaaccatatggttccaccccggaccctcccaaatctcatgtgcctttcacatttcaaaaccaatcatgccttcccaacagtcccccaaagtcttaattcattccagcattaactcataagtccatgttcaaagtctcatctgagacaaggcaagtcccttccacctgtaagcctataacagcaaaaccaagttagttacttcctagataaaatgggggtacagatattgggtaaatacacccattccaaatgggagaaattggccaaaacaaaggggctacaggccccaagcaaatctgaaatccagcagggcatcaaatcttaaagctccaaaatgatctcctttgactccatgtctcacatacaggtcatgctgatgcaagaggtgggttcccatcgtcttgggcagctctgcccctgtggctttgcagggtacagcctccctcttggttgctttcacgggctggcattgagtgtctgtggcttttctgggtgcacagtgcaagctgtcagtggatctaccattctggggtctggaggatggtggccctcttcttacagctccaccaggcagtgccccagtggggactctgtgtgggggctccaaccccacatttcccttcctcactaccctagcagaggttctccatgaggactccacccctgcagcaaacttctccacggacacccatttgtttccatacatcctctgaaatctaggtagaagttcccaaacctcaattcttgacttctgtgcacccacaggcacaacaccacatgaaagccaccaaggcttggggcttgcaccctttgaagcaatggcctgagctgtatgttggccccttttagccatggctaggatgtggctagaagtcacagttccaagagtacacaaagcagagaagccctgggcctggcccaggaaaccatttttccctcctaggcctccagacctgtgatgggaggagctgccttgaaggtctctgacgtgccctggagacattttccctattgtctttgtgattaacattgggctcctcattacttatgcaaatatctgcagccagcttgaatttctccccagaaaatgggtttctctcttcagttgcattgtcaggctgaaaattttccaaacttttatgctctgcttcccttttaaacataagttccaatttcagatcgtctctctcaagttcatagttccagaggtctctagggcagaggcaaaatgccaccagtctctttgctaaagcatagcaagagtgacctttgctccagttcccaagaagttcctcatctccatgtgagattatgtcagcctgggcttcactgttcatatcactataagcattttggccaaaaccattcaacaagtctctaggaagttccaaactttcccagatcttcctgtcttctaaaccctccaaagtgttccaacctcttacctgtcacccagttccaaagtcacttccacatttttgggtctctttatagcagtacctcactctactggcaccaatttactgtattagtccattctcgccattttacattcccaccaggaaatgtatcttaatttctccacctccttgccaacacttgttgttttccattttttattattatagctattctagtaggttaaatagtatctcatggttttgattagtatttctctgatgactaaagatgttgagcatcttttcatgtgcttattggttatttgtatttcatctttgagggagggaaaggacttgtctattcaagttctttgcccatatttaaaattgggttgttttttggtgttgcgttttaggatttctttatatattctgtatattaaacccttatcaggtatatgatttgcaaatattttctcctgcatgttttcttttcactttcttgataatgtcctttgatgtaaaaaagtttttaactttgatgaagtccaatttatctaccttttcttttgttgcttgtgctttcagtgtcatgtcaaagaatccattgccaaatccaaagtcatgaagatttattcctataaattcttctaagagttttatggttttagcttatatgtttgggtaattgatccattttgagttcatttttatattcaatggtgtagtaggcatccaacttcattcttttgcctgtggaaatccagttgccaccatgccatttgttgaagagactattattttttgtttgtttgtttgttttgagacggagttttgcttgttgcccaggctggagtgcaatggcacaaccttggctcactacaacctcctcctccctggttcaagtgattcttctgcctcagcctcccaagtagctgggattacaggcatgcaccaccatgcctggctaattttgtatttttagtagaggtagggtttcaccatgttggtcaggctggtctcgaactcctgacctcaggtgatccacccacctcggcctcccaaagtgctgggattacaggtgtaagccaccacacccggcctgaagagactattctttgtcccatataatggtcttgacacccttgttgaaaatcagtcagccatagatgtatgggtttatttcttaactctcagttctattctattggtctatatgtctatctgtatggtagtaccacactgttttattactgtagctttctaataagctttgaaacagagaagtgttggccctccagctttgttatttttcaagattcattttgaactattggggcaccttacaattccatataaatttgagaattgactttttcatttctgtaaaaagaggctggtggaattttgatagggatcgcttagcgtgatataagttttgaaatgttgacatcttaacaatattaagtcttccaatccataaatgtaggctgtcttttcatttatttaggtcttctttaatgtctttcatcagtgtgttatagtaatcattgtacagatcttccaccttcttggctaaattcattcttttgaatactattgtaaatgaattgttttcttaatttcctctttagattgttcattgctgatgtatagaaacacaattgatctttgcatgttcatcttgtacctgcaactttgccgaatttgtagctttcttgtggtttctttgggattttctatacgtagggtcatgtcatctgtgaacagtgagagttacacttctttctttttactttggatgccttttgtttctctttgttgcctaatttatctggctaaaacttcccgtacaatgttgaatagcaaacttcctgtacaatgttgaatagcggtagtgagagagggcatccttgtcttgttcctgatcttagggctaagcttccacctttgagtataatgttaactgtggaattttttttaatgccctttatcagattgaggctattcccttccattcctagtttatcttgaaaatattttggatttcatcacatgatttttctgcatcaatgaatatgaccttttttccttttttctattgatgtggtatattacattaattgatttacttatgttgaacttgcgttcttgggataaatcacacctaatcagattgtataatcctttaatatgctgtaagatttggtttgctagtattttcatggggtttttttaattgatatccataaagaatattggtttgtaattttcttttcttgtgatgtctacatttggctttagtatcagggtaatgctggcttcatagaagaagttaggaagtattccctcctcttccattatttggaagagtttgagagaactgctgtttattcttctttaaatgtttggaagaattcaccagtgaagccatctggtcctagacttctgtttattgggaggttttaaattacttatttaatctctttacttgttataggtctgttgagattttctatttcttctaaagtcaatttagtaatttgtgtgcttttagtaatttgtcatttttttttttttttttgagacggagtctcgctctgtcgcccaggccagactgcggactgcagtggcgtaatctcggctcactgcaagctccgcttcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaggaatttgtcattttatctaagttatctaattttttgatgtacagtagttcatagtaatctctatttgtgattcaatttttggaaggtaaaatcaagagttgttagaggcaaattgggccttgattaaaataggatctggtagttctgtttttagttctttgagaaatcttcacactgttgtccatggaagctctactgatttacattcccaccagcagtgtaaagcatttccttttctctgcatccttgccaacatcgttattttttgacattttaataatggacatcctgactggtgtaagatgatatgtcattgtggttttaatttgcatttttctgatgacttttcaatccagcaatgccattactaggtatctacccaaaggaaaagaaattatatattaaaaagataccagcacccatatatttattgcagcactattcacagttgcaatgatatggagtcaacctacgtatccatcaatggaagattggacaaagaaaatgtggaatgaagatacacacaattaaatagtactcagccataaaaatagaatgaaatcaggtcatttgcagtaacgtggatgaaactggaggccattatcttaagtgaaacaactcagaaccagaacgtcaaatactgcatgttctcactcataagtgggagctaaataaagtatgcacatggacatagagtgtggaataatggacactggagactaggaagggtgagatggtgggagggggttaaaggatgagaaattacttaataggtacaatgtacattatttgggtgatggttacagtaaatacccagacttcactactacttaatatatccatgtaacaaaactgaacttctgtcctttaaatttatataaattaaaaataaaaataaataaataggatcatgagtgcccaataaacaatacttggttacctatttaaacaaagtgacaatcaaacatttaaaaataaacatagggctttggaaggccgaggtgggtggatcacctgaagtcaggagttcaagaccagcctggccaacatggtgaaaccccgtatctactaaaaatacaaaaattagctcggtgtggtggtgcacgcctgtaatcccagctactcgggaggctgaggtaggagaattgcttgaacctgggaggtggagattgcagtgagccaagattgtgccactgcactccagcctgggagacagagtgagattccatcacaaaaataaataaataaataaataaataaataaataaataaataaatgtacataggaggtaacacaattctaacataggaggtaacacaattctaaagaactttagctctttgacaagtgaggaacctttgttctttgttagtttgccactaaataatcaaaaataaagaaaaagacaacataaagctcagagaattattcttgtaaaacacagagtctgctatctaggcagattacacagaagatgaagaataacttttgcattgtggtgaaggcattaatcaataaactaaggaagcaagcccatcaaaatttagataaggttgctacaattttaacacattgcatagctttatttcagacctaggtttaaaccagggcaaaaaaatttaactttcccagtttgtccttcattatgctctttgatgttctggaacaaactgaccatctttcagagcatctgctaggtcaaaactatttttattataatactaagatgtgtagtttttcaggggcagtatgatgtgtgatattgtaatagattgaatgcagaagcagatagtagagtctaattatttctattaagttgggcattagggaactttgcaaaaatgtgaagcaatcttcttatttttaaaataaaattatttttattaaaattgacatcaacatgcaacagattcatctcaaatcaattcaatcaataaatatatttaattttttctgttttaatttataatatggtaagtattgatagttacaacatacatgcggaaaacctctttggaagtccttagtaatatttcagagtacgaagaggtcctgagaacagaaagtttgagaactactgtcttagaaacaaactacttttccctttaaaacagaagcatatacccatttgtcactattgctcataatataatctcaaccacttgttttaattttaacttttaaccaaaataatatctatttcaaagagaaaatttgaggggtgcaattgagaactatctctcacaaacattatagcagattaacagagctcacgaacacatgtagcactttcaatgtacacacccatcccttttaaagaggaaaatgaacacaaccattaacatgacccaaagatattgcctctttatagcatataaaaataagaagcaacagtatataggaccaggcgcggtggcttatgcctgtaatcccaacactttgggaggccgaggtgggtggatcacgaggtcaggggatcaagactagcctgaccaacatggtgaaaccccatctctactaaaaatacaaaaaattagccgggtgtggtggtacatgcctatagtcccagctacttgggaggctgtgctaggagaattacttgaacccagcaggcggaggttgcagtgagccgagatcacgccactgcactccagcctgggtgacagagcgagactccatcttaaaaaaaaaaaaaaaaaaaaagcaacagtatataaacttaaaactgcttagtgaggccaaggtagggagattgcttgagctcaggagttcaagaccagcctgggcaacataggaagaccctgtctctataaataattttttaaagaattaaccaggaatagtggcacatgcttatactcccagctactcgggaggctgtggcaggaggattgcctgagcctggaaggctgtggctgcagtgagccatgattgtgccaccgcactccagcctgggtgacagagtgagaccctgtctcaaaaaaacaaaacaaaacaaaaacaaaaacaaaaaactgtgcttagtaatcaatatttaagcagtctatattaattaaaatttatgtaggtatccaatgattatccattaatgaactcaatttaatatcaaaccagtgtttaagttaattagattatcttaaatctaacataccacagaatgtaattactgctgaaataaaagtttgtcagaacagggattcaatttcagttgaacacaaatttacatctttcataatcttaaatattacatataagtaacattatcttatttgattagtaaatctgtatacatttaggaaaaacagaccgaagtaaaataaaatgtatgcttgttttatacattacataaataaatcaccaaaaatgacataactcttttaaataaaaattatttttaatgttttatttttaatttttgtaggtacattataagtgtatccatttattgttacatgagatattttgatacaggcatgccatgcgtgataatcacattagggtacatgaagtagccatcacatcaaacatttatcctttgtgttacaaacaatccaattatactcttttagttattttagaatgtacaattaatactgactgtggtcaccctgttaggctagcaaacactaggtctattcattctttctatattttttacccattacccatcctcacattctcccctactatctttcccagcttctggtaaccatcattctactctctatttgcatgagttcagttggcttaatttttagcttccacaaataagtgagaacatgcaaggtttgtctttctatgcctggcttatttcacttaacataatgacctccagtcccattcatattgttgcaaatgactagatctcattctttttaatggctgaatagtgctccattgtgtatatgtaccacattttctctatccattcatctgctgatgggcagttaggttgcttccaaatcttggctattgtgaatagtgctgcaatacatatgggagtgcagatatctcttcaatatgctgatttcctttcttttgagtgtatacctaggagtgggattggtgactcttctccacagtggttgtactaatttatgttcccaccagcagtgtacaagggttcccttttttccacgtcatcgccagcatttgtttttgcctatcttttggatataagccattttaactgggatgagataatatctcactgtagttttggtttgcatttctctgatgatcaatgatgcggagcaacttttcagttgcctgtttgccattcatgtgtcttcttttgagaaatgtctattcagatcctttgctcattttaaaaattagattactagattttttcctatagagttgtttgagctctgtatatatatctgcttattaatctcttgtcagaggggtagtttgcaaatactttttcccattctgtggattgtctcttcagtttcttttttgtttttttttttttttgttttttttgtttttttgtttttgagacggagtcttgctctgtcgcccaggctggagtgcagtggtgcgatctcggcttactgtaagctccgcctcctgggttcacccaccattctcctgcctcagcctcccgagtagctgggactacaggcgcccgccaccacacccagctaatttttttttttttgtatttttagtagagatggggtttcaccgtgttagccaggatggtctcgatctcctgacctcgtgatccacccacctccgcctcccaaagtgctgggattacaggtgtgagccaccgcgcccggcccagtttcttgatttaaacaagaattattaaacaaatctcatttgccaaagatataccttaattctggattctcaaaatgtttgagctagcagaattttttgtgaaaatatttttagtttagcacattttagtattaaaagttcaacttctggctgggcgcagtaaccagcactttgggaggccaaggcgggtggatcacctgaggtcaggagttcgagaccagtctggccaacatggcgaaaccctgtctctactaaaaatacgaaaaattagctgggtgtggtggtgggcgcctgtaatcccagctacttggaaggctgaggcaggagaattgctcgaacccgggaggcagaggttgcagtgagccaagatcgtgcaattgcactccagtctggacaacaagagcaaaactctgtctcaaaaaaaaaaaaaaaaaaaaaaagaagttcaacttctttttttcttggagttaaaaaaatatgtatgtaagttcttatttatgtctataaaccaattagaacagagctcctttaatttaggaaactttatgatataacttattaatactccccagagataggaaaatattttacactcacacaatgtgaggtcaaagcctttttcagttgtagacacatagacatagataaagcgatcttatgaattctgatctacaatttcagctataagttaagagtaaacacagaaatatgccagtccagatattacagtgttcaccttccctgcgggtgtgaaattactgattaatttaagttcaaaatgaacaaatagaacaacaaaaaagacaaattctctgttatttcccacccatcagtgactagataagtgactagataatccgttagtccaattacaaagaccaccaaatggtcaaaccatataatcacattcccagtcattgctgctaccaaggaagaatataacttactgactatacacaaaccagaaactaaaacaaaacataaactcaatagaaaagaaaaaagaaagaagcagagattcaacaaatttctgctgccactttggattcaacctggaagccaagaaaagattaatgtaaacaatctaggagttacatttctccagtaacacaatttacctggccctgtcaagtgtatccattgggcatctcagtcagtacttttaagatataaccttggctgggtgtggtggctcacacctgtaatcccagcactttgggaggccaaggcaggcagatcacctgaggtcaggagttcgagaccagcttggccaacttggtgaaaccccatctctactaaaaatacaaaaattagcttggcgtggtggtgggtacctgtaatcccagctacttggtaggctgaagcaggagaatcacttgaacccaggaggcggaggttgcggtgagcagagatcctgccactgcactccaacctggtgacagagtgagactgtctcaaaaaaaaaaaaagatataatcatgactctcttaggaatattaaatgaacacatcaaggattttatttaattcattaactgatgaggaaaccgagaagatgttacaaccaatttcaatttgcatttcattttggttgcttggtttttcctgttttctgtctcttactgtttattcagcggtatcttttttccctttgctgcttccacttccttttgctgcttccagttttacttttattcctgtggtggctttatttttttaccttctttgtctctgaaatagctcatattccatttccttttgttgtgtaccaactcttccctgagttctagcatttctgttttatattcttgttttatagagatgactacttaattaatattactgaatttatgctgatatgtttagtcacaattttaatctgcatatggcaacatttctctggtaagaattctccatctgccattttttttttctgtttcttccatcccattttcatgtagtatctttgtgtataaactgtgctggagttgtttgttttgttttgctttgcttgataacatctttaattgcaatgaggtctctttagaccttctacttgcagatgatacatgtggagaggagctcaggacctgatcaaggataatagaaatttttacttaagttctaaggttgttgtgtatgtgagttcttgtaggctctacatcttctcagccagtggatataggcagctatgggcttctcataacaaagactctttcctccccactgcttcactgacctgttgctcactctttattctctgcttctcaaaaccaaactaaggccagacgagttccctttaccagcctctaaactcttttcttgttattgtagataaaggatttgcacttcagggtgtgctcctccccttggagtgttgtacttttgctgactttttctgattctatttttatttttaaaacatatgtgtgtatgtgtacacaaataccctagactataagctccacaaggacagatactgtgtctgattttgcttacctttgtattgtgcgcctagcacataataggtcttcagaatatgcacacatatatatattcttataaaatgtgtgtatatgtatatatatttatgaatgcatatttcatctataaagccttggaaggatacacaccaaacttaacacttgatagctcttggaacaagtattagtgtgtttaagggactttcactttttattttgttttttgtttctgcatttgaatttttcaatgaatacatagtactttaataattaaaatgaaagatacatttagaaaaattattctgacttgttaaaggtttgtttcttgagattttgtatttccaatgaactaatgcttaaaataatgagcccagtatgtcagtaatgtaaataaatcattaagctaccaactgcaaatagataaattgagggaaagtacaaagccagtgaatcataaattcttgagggaaaattggaaaacgccatccttttaaaaatctactccaaatcagagttaattaagagctgtataaacagtgattaaaattttagtgctatgggaattggcttttacaaaaggattaaccctgacatgccattatattagtgacctaaggaaagcagctcaccacatttattctgcaaagtatttattaaattcctaaggactactatgtattgtggaaataaggaaatgtattactgtctctgtccctaacaaatttacagcaaagaaaggtcagaaacataatcaattatacatatataaggcaaaatgaaataactatactaatagggatacagaatatatgggaccacagaggaagaaatgatctattccaaaaggtgatatttgaacttactcttcaagaataaatagaattttaatggtaggaatcaagtgaacagaagccaggagtaatacaggagaacattgttagtttggggattatctcttattcaggggttatatagtgggagatgagtccatgtcttagtctgtttctgctgctgtaacaaaacacctcatgcagaccgggtaacttacaaaagagaaaaatttttttttctcacatttctggaggctgggaagtctacggtcaaggatccagaaggttcagttttctggtgagggctgctctctgattgcaagatgataccttgttgctgcatcctccagaggggagaaacactgtgtcttcacagggaggaaagtggaagggcaagaaaagttagtgctgtgtggaagcctcttttttaagggccataagggctatctgtaaccctgttcatgagggaggagccctctgggtctaataagctattaaaggttccacctcttatcctatcacattggccattaagtttcaacatctgaattttggaggggacacattcaaaccacagtaggctgaaagtagtgtgatttgtgatgtgcccattctcaataacaaattaggccactagtatcacctagttccaagctatctcatgtctcacttggaccactgcaatagcttcccaagtgtcctctctgctgcacttcttgccctcctaataaattcaatagccacacagcagccagagtattttaacataagtcagttcatgtcagtctccttgcacttcccatttaaatggatttaaaataaaatcccaagtccttaccataatctacaaggccatagataatccggtccttagataccttcctcgccacctctcctgccactctgcctcatagctccatgtactctagccctactatgtctcgataacaccttgtacttccctgcttctgggcctttgtatttgccctttcctttgcattggacactcttgtcctagatattcatatgccttgctccccaacttgctcaagttttaccccctcagagaccacaccctttcaaaaatagcaactttcaatactatttaaccccttaacctgtgtgttgactacttgacatattctatgttgcttattgtttgtctccctaaatagaatccaagttccatgcaggcagaaaagttgtctgtcttgttcattctttatccatacctcctaaagttttgcctggcatataatagggctcaataaatatttattaaatgaaattctgctataacaccagaaattatatcattagagagtcatttattttagtcttagagtgttttgatcttagagaaccctctgcaaagatccttgggagagctcacaatttagtcattatcagcgtatactctgggagaggaacatttagaaaaaagtacttaatggagattgaacttgggatttagagcagagaagggcaggtttccaggggtgaaaaaggaaatttaaggggaagttgggtttgtaccaaagatgactttgcttatagtgagaagatactcaaacctttcttacttgaggaagctcacagcttctgaatctctctttctggctgtgaaaagaaatttcctcttttgggtctcccttgaagattatcatttttggatgttgctaagagcatccttggagtcagagtctctatatatagcaaatcatcaaatgttagggctagaagtaatcttggtgatttggtttcttaaaactatttattttataacatgagttaaacatttatcacaaaaacaggaagatagagaaaaggctttagtttttgtaggtcattgcaaggaagaatttcgcttatctccagtgctataattttgactttggtataaagtattcatcaagtgtcatcattgaaagtattagtggttatgacaaacaaggcaaacctcctgagaactttagaacaaagcccagcatggatgttctgccagcataaatgcagttcagctggcagggcagaggattatctatgtttttatgtattatatattacatatttatatattagggtctcctcaacccataactggaaaggtcattctaatttatccaaatacagtagataaaagctgccatttaacaaggtgtatgctagaaatagaaatattttttgtcttttccattgtacacaccaaaactaggattgaatgcttattcctttgcaggcagtctttgcttggttccttcattggcttaatacagcaatcagtcatgcattacttttgtctcagagattagttctcatgggtaagaaattctcagagatgaaagttttgagatcagccaaaagaaaaggcaattggagctgatcctcaggcacattaaacagaatggcaaaacttgagtagattttctagtgtacattttgagccagaacttaggccacagaaataggagaacctgagtttaggatttttcctggaaggaaattagacaattagctggagatacccaagtatctctgataaaaatggatcctaaaagtcttcacttttggcagcattccatttaaatcatgcctcatagtcagcataagcttaccctaatgatgcaatccaaagccttaatggcagtgagtagagactttgatacagggctatggagtcactgaagaaatatagtaggggttccaggttgaggagacaggtttgttatggttcccagatacttatggtgatatatactattccttctcccaagtgcctgatctaattaggaatgtcagtccaatctccctgttcccaatatatatcttattatggtttgcttttagaaaggacaaatgtgaatctggaaattttatttatttatttatttattatactttaagttttagggtacagatgcacaacgtgcaggttagttacatatgtatacatgtgccatgttggtgtgctgcacccatcaactcatcatttaacattaggtatatctcctaatgtcatccctcccccctccccccaccccacagcaggccctggtgtgtgatgttccccttcctgtgtccatgtgttctcattgttcaattcccatctatgagtgagaacatgcggtgcttggttttttgtccttgcgatagtttgctgagaatgatggtctccagcttcatccatgtccctacaaaggacatgaactcatcattttttatggctgcatagtattccatggtgtacatgtgccacatttacttaatccagtctatcattgttggacatttggcttggttccaagtctttgctattgtgaatagtgccgcaataaacatacgtgtgcatgtgtctttatagcagcatgatttaaaatcttttgggtatatactcagtaatgggatggctgggtcaaatggtatttctagttctagatccctgaggaatcgccacactgacttccacaatagttgaactagtttacagtcccaccaacagtgtaaaagtgttcctatttctccacgtcctctccagcacctgttgtttcctgacattttaataatcgccattctaactggtgtgagatggtatctcattgtggttttgatttgcatttctctgatggccagtgatggtgagcattttttcatgtgttttttggctgcataaatgtcttcttttgagaagtgtctgttcatatcctttgcccactttttgatggggttgtttttttttttcttgtaaatttgtttgagttctttgtagattctggatattagccctttgtcagatgagtagattgcaaaaattatctcccattctgtaggttgcctgttagatggtagtttcttttgctgtgcagaagatctttagtttaattagatcccatttgtcaattttggcttttgttttcattgcttttgctgttttagacattttcttgtacagttatcttagcacaatgtctcctgatcagaataagttgtgtactatacctcacctacacattcattacttattttcacaagacttcccaagctttaaacttcagtccaccactaactgattatatatatatatcacaatacatattcttttcaagtgtacttgtaacatataccaaaatagatcatatgctgggccaaaaagcaagtctcaacaagtttcaaaggattgaaatcatacaaggtatgttatccaaacaaagtacaattaaatgagaaagcaacaacagaaagatgattaggaaacccccactgttggaaatctaaaagaaacatttctaaataacccatcagtcaaagaaaaaatcaaaatgaaaacgatggaatagattgaacttaacaaaaatgaaatatgacatcaaaacttgttggatacaactaaaataaaggaaaagacatagctttaaatgcatatattagaaaagattaagggttgaaaattgatgatctaagcttccaacttgagtctagggaaagaacagcaaattaaagatagtagaaggaagaatgtaacaaagataagagcagaaaacaaagaaatgaaaaataacatataacacagaaaatcaggctgggcacagtggctcatgcctgtaatcccagcactttgggaggccaaggcgggcagatcacctgaggtcaggagtttgagaccagcctggccaacatggtgaagccccgtctctactaaaaatacaaaaattagccaggcatggtggcacatgcctgtaatcacagctactggggaggctgaggcatgagaatcgcctgagcttggaaggtagaggttgcagtgagccaagatcacgccactacaatccagcctgggcgacagagaaagactctgtctcaaaacaacaacaacaacaacaacaacacagaaaatcaacaaagctataggttgcttgtttggaaagattaatacaattgctaaaagtcttgcaagatggatcaagaaagaacacaaattaccaatatcagtaattcaaaagtgggcatcactacaaatccttcagacattaaaatcacaataaaaaggatattgtgaacaactttatgccaataaatttgacagtttggacaaaatggacaaattccttgaaaagtacagctaccaaaattactttcccgccccccattacttctcagctttttggctaagatcaagtacaaaattgtgcccccaaaaataatctgagtagtcctatttagactattttaaatagtcctaaacctactaaagaaatgcaaccttaaataccttctcacaaaggaaatggctttaccagtacattattccaaatatataagaaagaaataatagattttgggttggagccaagatggccaaataggaacagctctggtctacagctcccagcgtgagcgacgcagaagacgggtgatttctgcatttccatctgaggtaccgggttcatctcattagggagtgccagacagtgggcgcaggacagtgggtgcagcgcaccgtgagtgagctgaagcagggcgaggcattgcgtcacttgggaagtgcaaggtttcagggagttccctttcctagtcaaagaaaggggtgacagacggcacctggaaaatcgggtcactcccaccccaatactgcgcttttctgacgggcttaaaaaatggcgcaccaggagattatatcccgcacctggctcgtagggtcctatgcccacagagtctcactgattgatagcacagcagtctgagatcaaactgcaaggcggcagcgaggccgggggaggggtgcctgccattgcccaggcttgcttaggtaaacaaagcagcctggaagcttgaactgggtggagcccaccacagctcgaggaagcctgcctgcctctgtaggctccacctctgggggcagggcacagacaaacaaagacagcaataacctctgcagacttaaatgtccctgtctgacagctttgaagagagcagtggttctcccagcacacagctggagatctgagaatcagcagactgcctcctcaagtgggtccctgacaccgacccccgagcagcctaactgggaggcaccccccagtaggggcagactgacacctcacacagctgggtactcctctgagacaaaacttccagcggaacgatcagacagcagcatttgcggttcacgaaaatccgctgttctgcagccaccgctgctggtacccaggcaaacagggtctggagtggacctctagcaaactccaacagacctgcagctgagggtcctgtctgttagaaggaaagctaacaaacagaaaggacatccacactaaaaacccatctgtacatcaccatcatcaaagaccaaaagtagataaaaccacaaagatggggaaaaaacagagcagaaaaactggaaactctaaaaatcagagcgtctctcctcctccaaaggaacgcagctccttaccagcaacggaacaaagctggacggagaaggactttgacgaggtgagagaagaaggcttcagacaatcaaactactctgagctacaggaggaaattcaaaccaaaggcaaagaagttgaaaactttgaaaaaaatttagacgaatatataactagaataaccaatacagagaagtgcttaaaggagctgatggagctgaaagccaaggctcaagaactacgtgaagaatgcagaagcctcaggagccgatgcgatcaactggaagaaagggtgtcagtgatggaagatgaaatgaatgaaatgaagcaagaagggaagtttagagaagaaagaataaaaagaaatgaacaaagcctccaagaaatatgggactatgtgaaaagaccaaatctgcatctgattggtgtacctgaaggtgacggggagaatggaaccaagttggaaaacactctgtaggatattatccaggagaacttccccaatctaacaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcggcagaaactctaaaagccagaagagagtgggggccaatattcaacattcttaaagaaaagaattttcaatgcagaatttcatgtccagccaaactaagcttcataagtgaaggagaaataaaatactttacagacaagcaaatgctgagagattttgtcaccaccaggcctgccctaaaagagctcccgaaggaagcactaaacatggaaaggaacaactgggaccagccacggcaaaatcatgccaaaatgtaaagaccatcgagactaggaagaaactgcatcaactaacgagcaaaataaccagctaacatcataatgacaggatcaaattcacacataacaatattaactttaattgtaaatggactaaatgctccaattaaaagacacagactggcaaattggataaagagtcaagacccatcaatgtgctgtattcaggaaacccatctcacatgcagagacacacataggctcaaaataaaaggatggaggaagatctaccaagcaaatggaaaacaaacaaaggcaggggttgcgatcctattctctgatcaaacagactttaaaccaacaaagatcaaaagagacaaagaaggccattacataatggtaaagggatcaattcaacaagaagagctaactatcctaaatatatatgcacccaatacaggagcactctgattcataaagcaactcctgagtgacctacaaagagacttagactcccacacaataataatgggagactttaacacccctctgtaaatattagacagttcaacgagacagaaagttaacaaggatacccaggaattgaactcagctctgcaccaagtggacctaatagacatctacagaactcttcaccccaaatcaacagaatatacatttttttctgcaccacaccacacctattccaaaattgaccacatacttggaagtaaagctctcctcagcaaatgtaaaagaacaaacattataacaaactgtctctcagatcacagtgcaatcaaactagaactcaggattaagaaactcactcaaaactgctcaactacacggaaactgaacaacctgctcctgaatgactactgggtacataacaaaacgaaggcagaaataaagatgttctttgaaaccaacgagaacaaagacacaacataccagaatctctgggatgcattcaaaacagtatgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacgcaaaaaccccttcaaaaaattcatgaatccaggagctggttttctgaaagcatcaacaaaattgatagacctctagcaagactaataaggaagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatcactgaatagaccaataacaggctctgaaattgtggcaataatcaatagcttaccaaccaaaaagagcccaggaccagatggattcacagccgaattctaccagaggtacaaggaggaaccggtaccattccttctgaaactattccaatcagtagaaaaagagggaatcctccctaactcactttatgaggccagcatcattctgataccaaagccgggcagagacacaaccaaaaaagagaattttagaccaatatccttgaagaacattgatgcaaaaatcctcaataaaatactggcaatccgaatccagtagcacatcaaaaagcttatccaccatgatcaagtgggcttcatccctaggatgcaaggctggttcaatatatgcaaatcaataaatgtaatccagcatataaacagaaccaaagacaaaaaccacatgattatctcaatagatgcagaaaaggccattgacaaaattcaacaacccttcatgctaaaaattctcaataaattaggtattgatgggatgtatttcaaaataataagagctatctatgacaaacccacagccaatatcatactgaatgggcaaaaacggaagcattccctttgaaaactggcacaagagagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaagaatccaacttacaagggatgtgaaggacctcttcaaggagaactacaaaccactgctcaaggaaataaaagaggatacaaacaaatggaagaacattccatgctcatgggtaggaggaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatctccaagtcaatcctaagccaaaagaacaaagttggaggcatcaagctacctgacttcaaactatactacaaggctacagtaaccaaaacagcatggtactggtaccaaaacagagatatagatcaatggaacagaacagagccctcagaaataaagccgcatatctacaactatctgatctttgacaaacctgagaaaaacaagcaatggggaaaggattccctatttaataaatggtgctgggaaaactggctagccatatgtagaaagctgaaactggatcccttccttaccccttatacaaaaatcaattcacgatggattaaagacttaaacgttagacctaaaaccgtaaaaactctagaggaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaaaaaaccccatcaaaaagtgggtgaaggacatgaacagacacttctcaaaagaagacatttatgcagccaataaacacattgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagcaatcccattactgggtatatacccaaaggactataaatcatgctgctataaagacacatgcacacgtatgtttattgtggcactattcacaataggaaagacctggaaccaacccaaatgtccaacaatgatagactggattaagaaaatgtggcacatatacaccatggaatactatgccgccataaaaaatgatgagttcatgtcctttgtagggacatggatgaaattggaaatcatcattctcagtaaactattgcaagaacaaaaaaccaaacactgcatgttctccctaataggtgggaattgaacgatgagaatacatggacacaggaaggggaacatcacactctggggactgttgtggggtggggggaggggcgagggatagctttaggagatatacctaatgctaaatgacgagttaatgggtgcagcacaccatcatggcacatgtatacatatgtaactaacctgcacattgtgcacatgtaccctaaaacttaaagtattataataataaaataaaataaaaagaaagaaataatatcaatctcatacaaatatctcttatggaaaatagagaaaaaagtaatacatggattttatgaggccagcatactctgattccaaaaactaaaaagaaaaatacaagtcagtgtcagtgtcttttttgtttgtttgtttttgtttttgtttttttgagatgaagtctcactctgtcgcccaggctggagcgcagtggcacgatctcagcttactgcaatatttgcctcccaggttccagcgattctccagcctcagcctcccaagtagctgggactacaggcatgcaccaccacgcccagctaatttttgtatttttagtagagatggggtttcaccatgttggcaaggctggtcttgaactcctgacctcaggtgatccgcccgcctcggcctcccaaagtgctgggattacaggcgtggaccaccacacccggcatcaggccagtatcttaaatgatagatgcaaagatcctaaatacattttagaaaattgaatccagcaatatataaaaaggatactgcatcatgaccaatattgcttatcccaggaattcaacattcaaaaatgagtgcacattaacaaaataaaagaggaaaatataataatctcaatagatgcagaaaaagcatttgaaaaaaattccatacccattcatgacgagaacactcaacgaactaggaatagaaagtcacttcctcaatctgataaacattacttgaaaacaaactactccttattttgtatttaatggtaaaatatgaacactttctcactgatgtcagggaatgaaacatggatatacactatcaccacttccattcaatattatactggaataattccaggcctcctagtaacccatttcacatcttaggtctaattgatcactctctccatgctgcctcttaaagacaatctgttcttttttaacttcagttgtaaaccctttatatgctttaagacggtttccaaagcatttgttaagctctgtcttcttcagatcaactatttcagaaataggttctattttccaaccttctagtcatagccattcttctcctttacatgttttccagtagtggattgtgaatcagaacatgtgggattagggtcctggctctccattaatttgctgtttctatgggtaggaacagcatttagtttctcagccataatcttctcatctggaaagtggggttaataacccctgccctgtgtatgcattagaagggcatttcgcctatccgaagaactcagaataatggagcaatttctaaaccatgactttgaaaacactgcagagacccagccaatctaccatttccaggagcttacaacataattccaacaacaaatgtaacctgaaatagataaacaaactgtacatctctataatggaatactactcagaagtaaatgaatgttaaatgcatttgccaagtgaaaaaagacagatccaaaaggctatgattccatttatatgatatcctggaaaaggtaaaaccataggaaaagaaaacacatcagtgattgccagaggttggacattggagtaggagttccctataaaggggtaacatgagagaatctttagggtaatgaatgttctataaggagcagtgatagtggacacacaattctatgcatttttcacaaccaatagaactatatgccacaaagagtagattttaccggatacaattttaaaataaatcaatcaggatgtggagggaatcccagatggaattcagactgtgacaaatgaatctgactctattacgaatgaactacatagccacatggaagggggtgaggaagaaagaagccgatttaagtaactttgaaaaactctgttttgattagatgcaaggctaaagacaaaaagaactatgcacaatactgtattctagttggtaacttttttcacgtggatatggattagcaataatgaaaatactttacatatttagtcagttttgctgttacatggcatatgcatgcctaaaaattattacagtatccaaaattgtgtaataaagaccacagggcttacgggaaaaaatggggttggggtataacactaaaaaatttggtctgtgacatattaaaaaaaagataagagcctaataaaatgacagcatggttttatatatgttaaatgactaaaaatacatgaatactacaataaatatggctatttaccttaaaaaagacctggcatttgcttatggaagtgaatatcagaaggactgcagcttgtgagatactgtgaagtggtgggaggaggttgtctgaaatctgatggaaagttgtagcaacagatgtggatgagtgtggcccataacacattcagtgaactgaggtagtggatagaagtttgagttgtgcacatgtgtgtgttatgcatattcctatacagcttggttcagccagatgctgctttctgcattcacttactatttcacatagactaaattgcacataagcaagtacttaatttacataatttacattaattgttacctaatatatcaatcatgttggaacaaattcacattttcaaaacaaacattataacaactgtatgtatgtgtgtgtatatatagtatgtattatgtatatgcaaatagacatgcatataatatggttttctttatctgtgatttggaataaagttttaaaaataagtaaatttgggctgggcacggtggctcacacctgtaatctcagcactttgggaggccaaggcaggtggatcatgaagtcaggagttcgagaccagcctggccaatatggtgaaaccccgtctctactaaaaatacaaaaattagctgggcatggtggcacgtgcctgtagtcccagctactcgggaggctgaggtagaagaattgcttgaacccaggaagtgagggttgcagtgagctgagatcacgccaccacactccagcctgggcgacagaacgagactctgtcaaaaaaaaaaaaaaaaaaagtaaattgatatggttgttggatacaggtttatatataaataattaattatatttctgtatactagcaagaaattattggaaagtgacctttaaaatacaatttttgatagcatcaaaatccatcaaatgcctagtaatctataatgaaagatgtataagacctctgcactgaaagccacaaaaccttgaaacatggctgaaagaaatttttaaaggtctaaataaatgcagatatatgccatgttcatgtgttagaaaactcaatattgttaggatatatcagttttcccaaattgatctatagattcaaagcaatcccaatcaaaatcccagctggggctgtgtgtggtggcttacagtactataatcctagcactttgaaaggccaaggtgggaggattggttgagcccaggagttcaagtatggcctaggcaacatggcgagaccctatgtttaccaaaaaaaaaaaaaaaaaaaaaaaaaaaaaaaaaaaccggtgtggtggcatgcacctgtggtcacagtggtcacagctacttgggaggctgaggcaagaagatcacttgagcccaggaatttgaggttacagtgagctatgattgcaccactacactctagcctgggtgacaaagtgagaccttgtctcaaaagataatgaaataaaataaatgaaaaatcataggagaatatcttcatgactttgtggagacaaaagtttaccaactataaaagaaaatattgataaagtggacttcattacaagtgagaactttggtctgtcaaaagataccgttgagaaaagaaaaagacaagccacagataggaagaagatatgccaatacataagcttgacaacttccagaatatataaagaattcttacaattcaacaagaaaagataaataacccaataaaaaaatggacaaaagaattgaatggctgggcacagtggctcgttcctgtaatcccagcactttgggaggctgaggtgggtggatcacctgaggttgggagttcgagaccagcctgaccaacatggagaaaccccatctctactaaaaatacaaaattaagcgggcgtggtggcacatacctgtaatcccagctactcagtaggctgaggcaggagaatcgcttgaacccgggaagcggaggtcacggtcagctgaaatcacgccattgcactccagcctgggcaacaagagtgaaaatccatctcaaaaaaaaaaaagaattgaatggaaatttcacccaaaaaaaatgtataaatggtcaacaagcaaaggaaaagatgctcagcatcattactcatcaagaaaatgcacattgagaagccgctgcaccctcactgaaatgactaaaaaaaaaatcaagtgttaatgagggtgggaagcaactggagttctggcacacaactagtggaaatgtaattggtacaaccactttggaaaactgtttggcagtatctgctaaaaccaaacatgtttctatcccagcagtgaccgtcaaatctcacttttagatatatactcaggtgaaatgagtacatctcttcaccacagtatgtacaagaatgttcaagacagctctattcatagaactaaaaatttgaaacaacattactgttcatcagcagaatgatagattaaataaattgtggtatgttcatacaatggaatactacaaagcaataaaaagaatgaacgtctgatagcatacaaaaatatttatgaatatgacagacattatgagtaaaagaagttggtcccaaaagaatacacaatataaattcaatttttcaaacaattgtattgagatataactcacatgccatgcagttcacccatcaaagtgtacaattcaatacactttagtatattcacagatatgtgcaaccaccactgacaatcaattttggaacattttattacctcaaaaggaaagcaacgtaccctttagtttcccttgcatttctcccacaagccctgaacaaccactaatctactttctgtttctatagctttgcatattctgaacacttcatttaaataaaattatataatacatggacttttgtgactgccttatttcacttagcatatttttgaagttcattcatgttgtggcatgtcagtacttcattactttttatggtcaaataatattctattgcctgggcataccatgttttattcatccattcatcagttgatggacatttggatcatttctatcttttagctattatgaataatgctgctgtaaactcttgtgcacaagtttttgtgtggacctattttcacttttttgtgtgtgtatacctaggagtggaattgctgggtcatatggtaaccctatgtttaatcatttgaggaactgccagagtgtttttcaaagcagctgcatcattttacatttccaccagcaatgtatgaggcttccagtttctccacctccttctcaacacttgtattacctgccttttttattctagccatcctagtgaatgtatagtgatatcttattatggttttgatttcctgatgactaattttcctgatgaccaatggtgttgagcatcttttcagatggttattggccattgtatatcttctttggagagtatctattcacaccctttcccaatttttcattaggctgccttttattattgaatagcaagagttatttatgtattctagatacatgtctttgatcagatatatgccttgattttgccccactctgtcaattgtcttttctctttcttgatcatgtcctttgaaatacaaaattcgttaactttgaggaggtccagtttatctatttttctttcattgcttatgcttttgatatcatatctaagaatccattgccaaatcaaaagttatgaaggtttacccctctgttttcttccatgagttttatagtttagctcttatctttaaatatttgatctatttcgagttaattcttgtatatgctatgaggtgagggtctaacttcattctttatcatgtggctatccagttgtcccagaactatttgattaaaagactatcctttccctcattggatggtctttgccccttttggaaaatcagttgaccacagacacattgttttatttctgggttgtcaattctgttccatatatatatatatatccttatgtcagtaccatgctgtcttgattaccattgctttctattttctttttcttttcctttcttttttgttgagactgagtcttgctctgttgcccaggctggagtgcaatggtgccatctcggcttactgcaacctctgcctccttggttcaagcaattctcctctcagcctcccaagtagctgggactacaggtggccaccaccacatctggctaatttttgtatttttagtagagacagggtttcaccgagttagccaggctggtctcgaactcctgacctcaagtgatctgcccacctcagcctcccaaagtgctgggactataggcatgagccactgcgcccagcctccattgctttctagtaagctttgaaatcaggaagtgttagtcctacaactttattcttggttttcaagattgttttggttattctgggtcccttgaatttccatacgagtttcaagatcaactgtcagtttctgaaaaaaataactgagctgggatgctgatagggattgtgttgaatctatagataattttggggagtgttatcatcttaatgataaatcatcaaatccatgaacatgggatatgtttccattttgttacatcttgtttatttcaatgatgttttatagtttttgtttataagttacataacaaaatggaaactaagttacataacttatacactaaaaactataaacgtacacactaattctttctttttctttttttttttttgagacagagtctcactctgttactcagactggagtgcagtggtgcgatgtcagctcactacaacctctgcctcccgggttcaagtgattctcatgcctcagcctcctgagtagctggaattacacacatgcgcccccacacccggctaatttttttttttttttatagagatgggattctgccatgttggccagactggtctcaaactcctggcctcaagtgatccacctgccttggcctcccaaagtgctggaattacagttgtgagccactgtgcctggtccttgttctttatttctaagtattttcttctttttgatgctgttataaagggaattgtttcaattttattttcagcttactcattgctgctatataaaaatagaattggccaggtatggtggctcactttgggaggccaagactggagtatcacttgagctcaggagtttgagaccagcctgggcaacatagtgagaccttgtctctaataaataaataaataaatacttgattgttgtatattgatcttgatgaacttgctgattagttataatggcattttactggattccctaggaattttattcacaagattatatcatcttgtgaataagattgatgtttttattccttttgatgctattgtaaatggatttattttgcagagcttcaaaacacttgaagcaaaaactgctagaactaaaatgaggaatagacaaatccataactacttggaaacttgaatattcctttcttagtaatcaatagaataggtcaacaaatactcaataaagatgtagaagacatgagcaacactatcagccaacttgacctaattgacatttagaacactctacccaacaacagcagaatacagttttttcaaattcacaaggaacattcatcattgtaagccatattctgaaccacgaaacaaacttcaaaaaatttaaaagtattgaaatcataaaattattgaaatatccaagtattttctctgaccacaagagaattatatatctataatacaaagttatctgtaaaaccttccaatatttggaaattaaacaacatactttaaaataatccagtaggctaaagaggaagtgacaggggaaattaggaattttttttaattgaatgaagatgaagacacaacatataaaaatgtgtaggctacaactagagcagtatctagacaaaagtgtatagcattaaatgctcctattagaaaaaaaaagaaaggtctcaagtaatctaagtctccaccttaagaaactagaaaaaatgagcaaattaaacccaatcaagcaaaagaaaagtaataaaaataagagcacagatcaataaaatttaagacagaaaacagtagataaagtcaatgaaaccaaaagtttttttttcttttgaaaagaccaatacaaatgataaacctctagccaggcagatcaagcacaaattaacaatatcaggcataaatgtggagacctcactagagatcctacagacattttaaaaggtaataagggaatattatgaacacttttatgtccatgaatttagaattttaggtgaaatgtacaaatttcttgaaagtcacaaactaccaaagctccctcaagaagaaatatatactcctatgcctattaattaaattcatagtttaaaatcttccaacaaagaaaactgcattgaagaattctacctaacatttaaagaagatgtaataccaactctatacaaactcatcctgaaaggagggcccaattcccagttcatcttatgagactattatcctgataccagtagtagacaaagacaatataagaaactgcagaccaagattcctcatgaaaatagatgcaaaacataaacgcagaaaagcaaagatagttgctaccttggttggatggtattgactggaaaggagcacaaaggaaccttctgtattgttggaagtgtttgttatcacaatctaggtagttattacacgggtttaaacacatgtaaaaactcatcaagctgtttaaggttagagcacttctttcagtttgttgtatatatgtcatacctcaaaacatttttcaatgttcaatctaccaagaaggatgaatgaaaagtgtctcacatagtttagtgtatgacacctgacatgaaattctttctatgctgatgcccaagaaattctgtcgactaatgaaacagtttggaaactctcctctattctgcttaaaataaagtcactgttggtttatacagcactgtatcttctggttaactcggccattagagtgagcaccagcccagttgaaagttcacaagaagcaagtaaacactggatttgatttagaatcaataatagcagcagggttttctcaggctgtttagaagcatcgtggcaattgtttgagaaaatataggtagttctagtgaatgcgctacagaatgttggaagtagcggttagcttagagattttaaaatgttagaatcaaataaaaaacaaaaataaaatttagaatctgtctacagcagtgaagatgaccttcaaattgtaagtaaaattaatatttcttagaaggaaaacctctccagttagtgaaattacaaccaaagagaataatataatataatcacaaagaatgttgcatttttgcctctttcttagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaagtaagagctatatttatgcttttgtaaggctggtgcccatttagatcgtatgactttttttcttctctttactcttctttcttacctccaggtaggaaataattttttctcatagcactttgtttctccttctctaatgccattcttagactattttgtattatgatcatttgtgcatttatcttcttcactctatgagattataatctctttagggtcataaacaataattacttaatttgtacttacaaaccctagcgaagttcattgctcctaataggtgctcaaattttttctgtgtggaatttaattatgtaactacacaacagggggagctcaaactttagaaagtttttctgggctagctagaaataactgagtgcttcaacaatcaaaagtgatgcaatcttagctgtttgttgaaatgtacagagaaatactggtaatattttttaacacaattgccactctcaaatttcaggccaaactttacgtgggtttgggggcatagagcctttttgggagtacactgcaggaaacagcctaattatcttccctttttatctctcaccctcttcaggagcatgtgtgtggttaataaaaatattaggtagctccaagtgcacaagagtcacatttgcctttccttggtcttgccaagacagaattcctagagccatggagcagatgatatatactttatggacatgtgacagcaaccactgctccttgtataatggaactccaattctaaaaatctgttaaatgcatctggaagtcttagggttagttacctctgatactcccttgtcaagtgtttcctatttttagtatcagataaaaataggacattttagtacaaacctgtttcaattagtgcccttttactgatctgctttctgtttccttcttagtgtgcccttccttgactgtcattcataagattattgcttcacctgtatgactgtgtgcaaggtcatacaaacagtaggttttctgttgatgtttgctgaaaaaaggatgttacctggtaatcccaccatgctactctgcccagaaagtagaagctatttccaaaagcgactgtagatttatcatttataaaattcattgttgtttatttttgttcatctgtttcagcccagtttcattagagaaagcaagtggtagcctgggatgaaaactgtgatgggtgacattatcatgttcacaacctttttccttttcttactctagtaatagcaatggaaaagcctgcacactatcctttgattgctctcaaggccttgaaaaaggctttattgctctacaaaaaggaagaaccaattgatatatcacaatacaggttagtaaatacaatccagcctttttgctagccaaaagaactatagtcaatgcctcaaaagtaaccaatcgttcttaattgactcaactttaaagatgatatggggatgatctgggggcattcttgtgaacagctccatactgagagttgtattacagaccaataattatttagcaaagtcaaggagcttggttttcccaaaggagaaaaaaaaggggaaaagttgcttctttgtgtgaatctgtgtatataataaaactgctaagtacctttctttctttgtttcatcactaaataatattccaaatgtacagaaaagcacaggggttaatataacaaacaccaacgtatccaccacccagatttatttgttttatttttagagatggggtctcgtgatgttgcccaggctggattcaaactcctgggctcaaatgattctccacctcagcttcatgagtagctgggattacaggcacgcagcacccagatttaacaaatgttaacatcttgctatgtttgcctcattatttttctaagcactttaagcaccgataagtgctgtataaaatattatctattggagacttttttgttttctgtgtccagacatggggaaaaatagatgttgtgtgactttttttgtctggaaaacatcattacagtcttcctgtgttaaggcacgaaagacagttcttgtggaatcattccactttaaaccccagttcccttgcccatttgaggaagtaccgagatgctttaaaatgcctgtaaattgaaccagctcataaaatataatagacagccacaactccttcgtgcaggaaactaaaaaaagaatgaaagacaaccataggcatgaaaaaagaaaggattggtcaacctgttttacagcttcaaaaatctgtcttctgaggttggaggccagataaaaccgagggaagaacagaagtgttttgaagctgttagtctgggatgagatccaggttttacttatcttagccatgaagccaatgatttctttccttatgggatgagttttctctttttgattttcagcaaatgtatgcacaacttggttaacctctcagtgccagatggggcgtcgaatgtagagctctgtcccctggaagaagtttggggctattttgaagatgctctgagccacattagccgcactgtaagtcaaatagtgatattaaactttcagttaattttaaagaactgaactgtcttgtgtactataaattatatacaataatgctttctgatatgagttttaggataaattcatattacaattttgtagttacacactacagaattttcctgggtttctgaaatataaatagttgaaagtagacattttctaacacaagtgtattatggattaggtccaagtagcagtaccaccaggcattttgaattattttatattttcaaatcatggtgggatgattactttctctgtgatgatatgaaccttttgaaaaaagttattgctattcccatcctttctcagaagcatcctttctcagaagagtagaaggaacattgaagacctgtattctagtccctcctctgctgatttctttttcttttctgtgcaggtttattcagttgttttaaaattaggtttcttgaggtataattcacatatcataaaattcacccatggcttgtgcacaattcagtaaatttatagagttgtgcaactatcactacaatccagtgttttttagttttaaaaatgttttatttttaatttttgtgggtacatagcggtgtacatgtacccatacttatggggtacatgagattttttggtacaggcatataatgcataataatcatatcaggataaatggggtatccatcacctcaagcatttatcctttgtgttacaagcaattcaattatacttttagttttttaaaatgtacaattaaattattgttgattataatcaccctgttgtgctattaagtacagatcttattcattctattttttgtacctattaaccatttccacatttcccccacccctcctctggtaaccatcactctactctttctctccccagcagttcaattattttaatttttagctttcacaaataagtgagaacatgtgaagtttgttttttgtgtgtgtgctgggcttatttcactcaacatactgacctccagttccatccatgttgttgcaagtgactggatcttattttttttatggctgaatagtactccattgtgtataggtaccacattttctttatccattcatctgttgatggacacttaggttgcttgcaaatcttagctattgtaaacagtgctgcaacaaacataggagtgcagatacctctttgatatactgatttcctttcttttgggtatatatccagtagtgggattgctggatcatacggtaactcaatttttcgtattttgaggaacctccgaactgttctccatagtggttgtactaatttactttcccaccaacagtgtgcaagggttcccttttctccacatcctcaccagcacttcctattattgcctgtcatttggatataagccattttaactggggtgagatgatatctcactgtagttttgatttgcagttctctgatgatcagtgatagtaagtaccttttcatatgcctgtttgccatttgtttgtcttcttttgagaaatgtctattcagatattttccttattttaaaactcgattattagattttttttcctatagagttgtttgagctctgtatatattctggttattaatcccttatcagaggggtagtatgtaaatattttctctcattctgcaggttgtctcttcactttgttgattgtttcctttgctgtgcagaagctttttagcttgatgtgatcccatttgtccatttttgatttggttgcccatacttgtaggatattgctcaaggaatctttgcctactccaatatcctggagagctttcccaatattttcttgtagtagtttcatagtttgaggtgttcgatttaagtctttaatccattttgatttgatctttgtataaggcaagacatagggatctcaactttcctccttctgcatatggatatccagttttcccagcaccatttattgaagagactcttctttccccaaagtatgttcttggcacctttgtcaaaaatgagttcactgtagatgtatggatttatttctgggtttgctattctgttccactatgttgagctgcctggggctggaggaggggtgatacaagcacccttgtggccactgccactgggactgtgctggtcagacctgaagccagcacagcactgggtctcacccaaggcccactgtaaccactacctggctaccacctatgtttgctcaatgccttagggctctacagtcagcaggtgatgaagccagccaggctgtccttcccttcagggcagcaacttccccctggccccagagatgacatgcaggagccagggcctggagtcagaaaccctagaaatctacctagtgctctattctactgcagcttagctggtatccaaaccacaagacaaagtccttcccactctttcctctttccacacgcagaagagtctctccccgtggccaccaccatcaggtggtgtggggagttctgctgggctactgccagtgttcacttaaggcccaagggctctgcaatcagcttgtggtgaatgctgccaggcctgggactcatacttcagagaagtgggctcctctctggcccaggacaggtacagaaatgccatccaagagccaaggcctggaaccggggaccctaggagcccacttggtgctctaacccactgtggctgagttgatatctaagctgcaatacaaaatcctctttactcttccctctgcttttctcaagcagaaggagtctctcctcatagccaccacagctgggaatgtactgggtcacaactgaagccagcatgtctcagagtctcacctaaggcccacagtatgtactacctggctactgctgctgatcactgagggccaaagtgctatttagtcagcaggtgatgaatcctgccgagactgggtccttcccttcaaggcagtgggtaccttttagcccgaggtgtgtctcaaaatgttatctgggaactaggtcctggaatgggaccttcatgactatgccaagtgccctgtcctactgtggctgagctggtatccaagatgcaagacaaagtcccccttaagcttccctctcctctcctctagtggaaggaaggggtctgttttggagctgcaaactgcactgcctggggttgagggaggggtcgtgcaatcactcccttggctgccctggctggtgtctcactaggtcgcatgtcccccagatgcactggctccaagcccagcacagcacaaagatttgcccaggagttgcagtccttgtggcctagactgcctctcaaatttatttagaaccccagagcactttagctctcagtggcaaggcttgttggaactcaagttccaactactgggatggacaattgctctctagctagggctggtctaaatactccctccatgagcatcagttgagttctgcccagtgttactttctgctgtgacagggcagcactgagttccaagcaagatcccacaatcactgtgctctcccttccacaagcacacagattcgccatgccatgcagccactgttggggcataggagaggggtggcattggcagttcaagattgtccttcctacactcttcagtggctctttcggtgatacgaagttaaaaccaggtgctgtgatcactcacctgattttttattattattttttaaattttattattattatactttaagttttagggtacatgtgcacaatgtgcaggtttgttacatatgtatacatgtgccatgttggtgtgctgcacccattaactcatcatttagcattaggtatatctcctaatgctatccctccccactccccccaccccacaacaggccccggtgtgtgatgttccccttcctatgtccatgtgttctcattgttcaattcccacctatgagtgagaacatgtggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttcggttggttccaagtctctgctattgtgaatagtgccgcaataaccatacatgtgcatgtgtctttatagcagcatgatttacaaccctttgggtatatacccagtaatgggatggctgggtcaaatggtatttctagttctagatccctgaggaattgccacactgacttccacaatggttgaactagtttacagtcccaccaacagtgtaaaagtgttcctgtttctccacatcttctccagcacctgttgtttcctgactttttaatgatcgccattctaactggtgtgagatggtatcttattgtggttttgatttgcatttctctgatggccagtgatgatgagcattttttcatgtgtattttggctgcataaatgtcttcttttgagaagtgtctgttcatatcctttgcccactttttaatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcaggagctctttagtttaattagatcccatttgtctgattttttattcttaatttttgtgtagatagttattaaatttggtgttcctgcagagaggatgattggtggaggcttctaatcagccatcttgctccgtccttcctcccacaatccagttttagaacatttccattaccctagaaattttccccttgcccatttgcagacaattcttgctcccaccttcagctccaggcaaccacagatccgctttctgtctctgtagattttctctttctggacacatcatataaatgaaattatataatacgtggcctcttgtgtctggcttatttcattgagcataacgtttttgaggttcgtccatgttgtagcattatcagtattccattcctttttttttttttttttttttttttgctgaataatattctagggaatggatataacacactttgtttatctgttcatcagttcatagatatttgagttgtttccactttttggctatcatgaataatgctactataaatattcatgtgcaagtgtttttgtgagcatatgtgtttaattctcttgaatatatacctaggaatggaattgttgggtcatcaggtaaatctatgtttaacttttggaggagctgcagtctgtttgccaaagtggccataccattttacattttcactagcggtgtatgaggattccagcttctctacattctcaacacttgctattgttcatcttttcttttttttgttatagccattgtggttttgatttatatttccttgatggctaatggtgatgatcattttttcatgtacttattgactgttcgtgtattgtgtttggataaatgtctattcaattattttcccatttttaaaatggaattttttattgagttataagagttctttatatattctggatacaagtcctttaccagatatgtgatttgtaagtattttctcctagtctctggcttgttttttcattttcttaagggtatcatttgaagagccaaagtttttaattttgatgaagtccaatctatcaattttttcttttgtgggtagtgttttggtcatgctgagaaatctttgcccaacccacgtttacaaagattttttcctacgtgtttctgtagaagttttatacttttatctctgacatgtagctctatgattcattttaaattttgttatagtgtgaggtagggtctaaatgatgttttgtttgtttgctgttgcatattaatatcactcctctgctgtttgacttcagttttcacatttgtaaagtgggaataatacctgatctgactctcccacactggggttgtaaggatcaatgaaaataatgtatgttttgtaaactttaacagcttgtacacatgtaaggcagtattgttattataagagagctataaaacattaagaacactacatgccttgcttaaagttacacagaaagtcattatttgagtccatgttaatatctgaggatcctgactgctcttgactcaactacttcttaatatataaatatagtcatgtgccacataatgacatttcataatatataatggtggtcctgtaagattataatggagctgaaaaattcctgtcacctagtgacatcatagccatcgtaaggcaacacattactcacatgtttgtggtgatgccagtgttaacaaaacttactgaactgccagtcatataaaagtacagcacatacaattagatacagtccataattcttgttaatgatataacaaattactatgttactgtttcatgtatttactatacttttatcattattttaaagtatattccttttatttataaaagaaagttaaaactgtaaggcagcttcaggcaagtccttcaggagatattccagaaaatggcattatcatcctaggaaatgacagctccatgtatgttttgcccaagaagcctttccagcaggacaagatgtggaggtgggagacagtgatattgatgatcctggccctgggtaggcctaggttaaaatatgtgtttgtgtcttagtttttaacaaaaagttttaaaagttttttaaaaaattaaaaataggaaaacacttatacaataaggagataaagaaaatatttttgtacaactgtataatgtgtttgtgttttaagctaaatgttattacaaaagagtcaaaaagttggggttttttgttttgtttttgtttttttgagacagagtcttgctctgtcacccaggctggagtgccatggcgcaatctcggctcactgcaacatctgcctcccgggttcaagcagttttcctgcttcagcctcccaaatagctgagactataggtgcatgccaccacacccggctaatttttgtatttttactggagacgaggtttcaccacattggccaggctggcctcaagctcctgacctcaagtgattgtcccacttcagcctcccaaagtgctgggattacaggagtgagccagcatgactggccaaaaaaaaaattttttttttaattaaaaaggttttttttgggtttttttgtttgtttttttgggtttttttttttttttttttttttgagatggagtctcgctgtcactgacgctggagtgcgaaggcacaatctcggctcactgcaacctctgcctcccaggctcaagtgattctcctgcctcagcctcccaagtagctgggattacaggcgtgtgccaccacatctggctaattttgtatttttaggagagacagggtttcaccatgttggtcaggctggtctcaaactcctgacctcaagtgatccatccgcctcgacctcccgaagtgctgggattacagtttataaaggaaaaaagttgcagtaagacaaggtcaatttatatttatatattttttgagacaaagtctctgtcacccaggctggagtgcagtggcatgatctcagctcactacagctttgacctcccaggtacaatcaatcctcccacctcagcctcctgagtagctgggaccacacgtgcgcaccaccacacccagctaatttgtttgtatttttagtagagacagggtttcaccatgttgcccaggctggtctcaaactcaggttcaagtaatttgctcaagtaatctgcccaccttggtctcccaaagtgctgagaatacaggtgtgagccaccacacctggccaaagttaatttattattaagaaagaaaaataccctttaataaactgagtgcagcttaggtatacagtgtttataaagtctgcagtaatgtacaagaatgtcctacaccttcatgttcactcaccactcactcactgactcacccagagcaacttgtagtcctgcaagctctattcatggttagtgccctatacaggagtaccattttttatctttcataccacatttttcctctaccatttctatgtttagatacacaaatacttacctctgggttacagttgcctacagtagtcagtagagtcacatgctgtatgggtttgtagcctaggagcaatgggctttaccatatcgcctaggtgtgtaggaggctataccatataagtttgtgtaaggacactctatgatattcacacaatgacgaaatcacctaatgatacatttctcagcttgtgtccccattgtgaagtgagacatgactatctgcaaatcacaacagatggtggaacattatagcagggtgacaatctgatacaaactagcattgacttaccaaagcctagaattctcctggagatgtgtaattatggcctgtgtgaatttaagtttaaaaataaaaacttcaacattggacatttggattatttattttactgtcttctcggatgaataggaaattctatttctaagccatgagcctcatctggacctttcaggtgtgtttgccatagtgaccaatacaaactgaaattagattgtactataactccaagttgatcaatttccatagtctctctataaggccaaaatttctctgtgcattttgtttttgccactttcattctgtccaatatattgcagttccaattctctggctcttgggttacctgttagagagcttaatgtttttctacttttctcatgagtttcccatccatttattgctcatcccctgaaacatgactggatagttagctttttaatgcagtgattaatttattttttaattttttaatttttatttatttattttttatttatttatttttttgagacggagtctcgctgtgtcgcccaggctggagtgcagtggcgcgatctcggctcactgcaagctccacctcccaggttcacgccattctcctgcctcagcctcttgagtagctgggactacaggcacccgccaccacacccggctaatttttttgcatttttagtagagacggggtttcaccgtattagccaggatggtcttgatctcctgaccttgtgatccgcccacctcggcctcccaaagtgctgggattacaggcgtgagccaccgcgcccagcctgcagtgattaatttaataaccctcttggctctttatattatatatgttgctttatcctatttgattgaatgtgccgtgcatctcctttgtttcaaatgcttgggacaaaattctgcctttgtttgactgacttttttaatgaccagtcactcattcattattcactgagcagataacctttatcaagtgcctccacacactggcaaaatggctatcatacaaatataaaacctcatgcctcacaatattatgctttagactgagcagagtactcttacgtccactctctcgtacaacctccaacagcaattatagaagtagacaatgctgctattgttatccctaatttatcaatgagggaattttaagattcaaaaagtcaagtaaccaatttacctaaggtcattcatgactaatgagtgagagtcaggactagaatgcaggtcttctgagctcctgtcttagtcaattcgggctgctataacaaaaataccatagagtgggtggatcataaataacagaaatttatttctcacagtttgggaggatagaaagtccaaaatcaagacactggcagattcagtgtccagtgagggtctgcttccccatagacggtcctttctgactgtaagctcacatggcagaaggggtaaaggatctctctagggtctcttttataagggcactaatcctattcatgagagcactcctcttatgaccttatcacctcccaacagccccacctcctaatatcatcaccttggaggttaggattttaacatactaattttgaagggacacaaacattcagtccgttgcacatcaactacagggctgtttccactggaggtgcgtggcttctttaccagtttttgctaggaaattttagtttaaaggagaagctcaagttgatatttagaagctagtggtaatgaaaaagcagggagatgactcccaggcttaagcagacaaacctatcaacctatgtaggttcatattctagataatttttaagaagaagtcgattgttcaagtttttttaaatcaaaattttattttgaaataattgtagatttacacgcatttgtaagaaataacacagagagatctcgtgtactctttttattgtttgtttgtttttgagacagagtctcgctctgtcacccaggctggagtgcagtggcgccatctcggcttactgcaacctccgcctcccaggttcaagcgattctcatgcctcagcctcccaagtagctgggactacaggcaaatgccaccatgcctggctaaatttttttgtattttcggtagagatgggttttcaccatgtaggacaggctggtctcgaacttctggcctcaagtgatctgctcgccttggcctcccaaagtgctcatgtactctttacccagtttcccccaacgataacaaaactatagtacaacatcacaatcaagatgttggcattatcacaatcaagacatagagcattgcatttctgtcaccacaagtattcctcatgtttcctttgtatagccctcacactcttctctcccactctcagctcctccttaaaccctgacaaccgcaaatctattaccaatttctataattttgtcatttcaagcatgtcatataaatgtgatcaaacagtatatagcttttgagatttggaatcatacagtacataactttttgagattggctttttttgagacagggtcttgctctgtcacccaggctagagtgcagtgaagctgatcatagctcagcctcagccccccaggcttaagcgatcctcccacctcaactccccgagtagctgggaccacaggcatgcaccaccaagcccagctaattttttaatttttttgtagagatggtctcaaactcctggactaagcgatcctccctccttggcctcccaaagtgctgggattataggcatgagccaccacacctggccaagattggttcttttcacttagcataattctctagagattcatcaagtcattgtttgttacaaaaggacaaatattgtatccttctatttatatgaagtacccagagtggtcaaattcatagagatggacacctgcaggggaggctccccaggaagagctgactgggtgtttaatggcctcttcttgcaggctcaagattgaccttagcttggagtcactgggcttgagcttctatttcccagtcagggttgttcactcagttttacatgagaaaatactcagtgtttgaagaatccagcaaaattactcaaactcagtgtttatggaagggaataaaatagtaaggcatttacattttatatctccataaacaagcaaaagtgtctatctctttcagacaacaaacatgtcatttaattatctccataataaaaaaaattatttaataaacaattgaaaaaaaaagaaagtaaagtggtagtcaccaaggactggggttattacataatgggtacagatctttagctttgcaagatgaaactggttctggagatggatggtagtgatgatagcacaacaatgtgaatgtacttaacgccactaaactgttcacttaaaatgattaagatggttaaattttgtgctatatgtattttaccccattttttaagtcatagaaaagaatctttgtcaggtatcgtaacatttctgtcatctcagtgttggcatcaattcattgtcttttttcgttatttgagatcttcctgattattggtataatgagtaaatttgttaaacctggacaatttcatattttgttctgagactctggatctcatttaaaccttctgttttaacttggtttctctgacctgctttagcaagggagtgggcccagccttgttacttccaggtagaagtagaaacaagcctaagtttctaacttgacctccatcattgatactcaaggtagaggactcctttttactactggtcccttggctagagacagcagacttttcttggggcttttttctttctttttctttttgggtctatgtctgttggcatctctagcaccaagtttggggtatatgaagcaaaaagaaaacccagagaacttatcactgtgtcaatccttggctccaaggtcttccctttctctacacctttcagaggtttcttatgtttgttttatgtataatgttcaagagttagttttatttagcaggaagaatagggataagtacatttattccatctcatggaagtggaaatttcttggttcatttttaagaatatacaaagacttaaataatggtgggggggaaacctacacttaaagagaagggacaaacctaatcctcacagctgatgtcagagtcacagagtcacaaaggcgttttgtaaccaagaagcccagaagaacacagactctttccttttacaagggaagctaaggtgattcaaactactgagctacattctctaagagtttgcttcccaaagcgtgatcagcatcccctaggagcttgttagaagcatggaatcttaggccccagacctactgaatcagtctgcgttttaactatacttccggccgggcacggtggctcatgcctgtaatcctagcactttgggaggccgaggcggatggattacttgaggtcagagttcaaaaccagcctggccatcatggtgaaaccctgtctctactaaaattacaaaagttagccgggcgtggtggtaggcgcctgtaatcccagctacttgggaggctgaggccgaagaattgcttgaacctaggaggcggagattgcaatgagccaagatcacaccactgcactccagcttgggcaacagagtgagactccatcttaaaaaaaaaaaaaatatatatatatatatatatttccaagtgtcttgtatgcacattaaagtttgagaaggtcatttatcagtatcttttgtctcttgtttggccttctacttgttcaatttcatctcagttcctacttctgccaatcttatataagttcatagattaggcaattgggatctaaaggaaatataaggtaaagcttcattcaatgactgagaaaatttagaactggaaactaatgatctttgcagttacctaatttaagctcattattttgcaaattgaggcattgaaaggttaaatatctgacacaaggtcataccactatataatggcaaagctaaaaattgcagccgtgttatttcttcataggacaatggtccttgggttttctttcatctattttttaataaaatttttttaattgagaggaggtcttactatgttgcccaggctggtctcaaattcctgggctcaagcaatcctcctgccatgtcctctcaaagtgctgggattacaggtgtgagcccctgcacccagccttctttcatctaaatcttcctccttccaagcctcacgtctccctgagactggaattgaggttcatacaaagccatctttgagtcagactttgatattgtgtctctcctacagctttgtagtttcctaattggtctctggctctttcttctcttctccattttttcctgttcatccctatcaaatatatctccgtaaaacacaacttttgctctatcactccctttccctcaaatcttttaacaactctgtatttcccaaatccttacctagacccttaaggctatctatccataacctcattcaacccccaaaacaagacagagtttttcccaggcaatagtcaatattctctttatcatcaaccttcacctccttctctcccttcttcttagaacaaagcagaatcttccctgaagaaaacgtgtccctcactacgaatttttatggaggtctcatcttttccaactccctttttctcagcagaagggactaaattacctggatctttgctccatggtggcactttgtactatttatataccaccttcctacggcttctcttcacttaaaacctatatctcttcatcaccaatgttgtcatgtcctggacccaccttttccttccttggtaacttcattgttatttattatcctaagtgactttggcatccatgttagcaattcttgtacctcacagtttccgtttttcactttttagccactgtctacctcccatataagccacccactgtggcactgctccatcttcaagattggtaactaacgcaacacttttctattgagtctaatctcccttacttccccatatctattctctgttctcacttgaacttcaaatcactcgtcttttcccactctattatagtccagtctaactaccttttttttctttttctctttcttttcctttctttctttctcttttctttatttctttatttgcttccttccttcttccctcccttctttcctccccttccttctctctttctctcttcttttgattattcctgctgtttcatttttttccaaacctggtaccttgccaccatcagttcttctgctcctgatcttgagcagcagaagcactaaagaaagttacagaaccatctagatctggcccagtacagattcattctgttaagctttcagtgggttctcattgctgctcagaaattcttttattcttgtcaactttttggcaaactcaagtaaagtggctgcttcaaaccttttctaatctcgtaaaaacttagacctacctcattccccattagatgatctcatcatatcatttcagttgagaagatcaagggcatcacatatgagatccctcattggcccatgtctcaaccataacattctaccactgtacctacctactcacctttcctcttttttcaaaagaaattttctcaaccttgcactgtcagttcaatccccttctacttcctgaggcattttactgcctgtccatcatttttactctctgcctacagatggttccattctgctttcaagaatgcataagtctcaaacaaatggaaatatataccatgttcttggacaggaaagccctaacagtataaagtcagtttccctaaattcaatgcaataaattcagtcaaaattaaaatctcaataggatttttaatgaaacttgatgattctaaaattcttccctaaaagaaaatgaaccaaaacattttttgtaaaagaacaaggaaggacttgccttatcaaatacttttaaaactataaaatgatattaattttaaaagtatggcattagtgcaaaaatctacaaagagattaatagaacaggactgagcccagaaggagatccacatatctatgagaattttgtatgcaatggaaaaggtatatcacatcactgagggaacaattggtaaaatggtattgggacaatttaaaaagcaaagttacgtccttatttttaaactgaggggcgttatagcatagtggttaagagaacagactttggagccacataaccagttcaaataaattctggctacaccatttattagctgtatgactttggtcttattaattaattatgtatacctctgtatcctcatctgtaaaataaatataataataatctcagcactttgggaggcaaaggcaggagtatcgcttgaggccagaagttcaagaccagcctggccaacatagcgagatcttgtctctatgaaaaataaataaataaataaaagctaaaaaaagtgcctaccttacagtattattagtattaaataacttaatatatataaagtacttatagcagcacatagtaagtactatataagtgatagtattatttttttgccttataccatgcacaaaaataaagtccaaaaggaagaaataaagaaaatccagatagattaaagagctaaacataaaatcaaagctataaaagcattaggaaaaaacagaggaaagcatttttttaaatcatggaatggagaggacccactcagaagctgtataagaaacaaatagttttggttacatgaattaataaatagcacaagataccacaaaacattttaggcctggtggagtggctcatgcatgtaatcccagcactttgggaggccgaggtgggaggttcacttgaagccagaagtttgggaccagcctgggcaataaagtgacactctgtctctatgaaaaaaaaaaaaacccataagttttgtgggtttttttttgaaatggagtttcactccgtcacccaggctggagtgcaatggcatgatgatggttcactgtagccttgacctcctgggctcaagagatcctcccacctcagcctcccaagtagctgagactacaggcacatgccactacacccagctaattttttgtatgtttggtagagatgcggtttcaccatgtctcctaggctggtctcaaccttctgagctcaagcaactcaccctccttggccttccaaagtgctgggattataggcatgagccaccacacccaggcagatatgtattttatactttgggttataatacaatattactttattttattgttcatattgttctagctttgaaaaagtctggcagcttcccagaaggttaaacatagttaccctgtgacccagaaattccactggtaggtgtatacccaagagaaatgaaaacatgtgtccaaagactcatagcaaatgttcatagcaaagttattcatatagcccaaaatggaaacagcctgaatgtctgttagccaatgaatgggtaaacaaaatgtggtatttccattcaatggaatactatttgtccattgaaaggaatgaagtactaacacgtgctataacatggataaaccttgaaaacatggtaagtgaaagatgtcagtcacaagggcccacatactgcctggccccatttatcttaaatgtccagaaaaggccaatctataagagacagaaatgagagtagtggttgcccagggcttagtggggtaggggggcaggttgagaggaaatggaaggatattggctgggggcagggggaatatggagccaatgggcatgggctttccttttggaggaatgaaaatattccataattgattgtgatgatggtggcagaactctgtgaatactgtgaatatactaaaaaccaccgtattgtacactttagataaactatggtattttatttaattgtatcttaataaagctgatgcacatactatttactttgggaatctatggagagcctaaaaggacaggcatttgtgctccagaatacctacgattcagttagagatctacgtggctgccatatgtattaagatgttgaggacagagaaaactggtttaaaatatgtggccccaaaaaccatcagagcaaacacctcagtttgctgacattgatttgtattacacgtaggcaagtccatgtggctttcaggtcagtagctgtgtggatgcatttctttattgaggattaatgattttcataagcaatgctgggcatgagggcaactaatgcaaattaaaataaaactcgagtgttccctaactcattggatgacaccatcattcttctggttgcccaagccagacatctaggagtcatcctcagcacctccctcactcccacttctaatctatcaccaagtactatcaatcaatttgacctcccaaatatctctcaaattcatctacttcctcctatctttcaccatcagtaacctagttcaagttacacaccttttatcttagctagtttagtgatctcaggaaccttttaactggcctcacatctactcttgctttcttccttcctttctttgcccagcaaccaaggtgatcgtttacttttttttttttttttttttttttttgagatggagtctcgctctgtcaccaggctggagtgcagtggtgcaatctcggctcactgcaacctctgcctcccaggttcaagcgattcccctgcctcagcctccccagtagctgggactacaggcacccgccaccacgcccagctaatttttgtatttttagtagagatgaggtttcaccatgttggccaggatggtctcgatctcttgacctcgtgatccgcccacctcggcctcccaaagtcctgggattacaggtgtgatccaccatgcccagccaatcttttacatttttgagtatgcatgaccttttgaaatcctctttagtagtttcccattgctcttaaaataaagaccaaaatcttgaatgtggtatacaagatcctactaacctatctgtcctcatcttgagccactctttccctcacattctgcactgtcagccacactttacaagaccacaaattaccaccgtctaggcaaatatgatggtctcttttccctggccttcgttattgaccactgcctccttattgaaattctgttttcctttgtcctttattttctcgccactcctctgcgttcttttccctcttaccacccaactatgaacatttccaatattctctactctttgctactctgtattctgtactctgtcctttaagtgaattaatacactttaactattacctgagttccaatccatatctgcaacagcctgcttatctccagagttacctcaagccaacttgtttaaaatagaacttattgttgtctttatcccttatccccagaaacatgtccttcaattttttctttcagtgatgccagcattctttcagccattcaaactacataccttagagccattttcacttgacccgtcattccccatatcaaatcagttaccaaattctattgattcttcctttaaatgattcttacatccgtccatctaaattgtcactattttagttctgaccctcatcacttcattcttagatcacacaactccttttattttattttattttatttttatttatttatttttttgagacagaatctcgccctgtcgcccaggctggagtgcagtggtgcgatcttggctcacttcaagctccgcctcccaggttcacgccattctcctgcctcagccttccgagtagctgggactacaggtgcctgccaccacgcccggctaatgttttgtatttttagtagagacaggatttcaccatgttagccaagatgttcttgatctcctgacctcgtgatctgcctgcctcggcctcccaaagtgctgggattacaggcacaagccaccacgccgggcctttattttattttttgagacggagtttggagtttcactcttgttgcccaggctggagtgcaatggcacaatcttggctcaccacaacctccgcctcctgggttcaagcgattctcctgcctcagcctcccgagtagctgggattacaggcatgtgccatcacacccagctattttgtatttttagtagagacggggtttctccatgttggtcaggctggtctcgaactcccgacctcaggtgatctgcccgccttggcctcccaaagtgctgggattacaggtgtgagccactgcgccaggccataactccctttaaacacgtctccctgtctgtgttttcccacacggaggtctgttctaaacaccactggcatttctatcttattaaaactacactttcatcatatcactctccttctcaaaaagtttcagtgccttcccgttgccagcaggataaatttcaaaatctgaagcctgtaatgcaaaaacccttaacactccagcccacaagatgttagcaaacgttccacataccctggattagacaaagttccatggtttctttactgtaaaacttccctaaactttcagtgaactagtgtgcattataatgctccaaaagggtgatatatagaatgcggcatttccaaaatgtatttgactaaagaactctattttcatagaccatctgttaacatttctcatgacactagtgttctgaggaagaacattgaggaaaggcttaggaagccccatcctacatttccagtcttatttcccgttaactcctctacataaatcgtctgcttaggccaaagaactcttggtcttcctaagacatgcttgttctcaagtacaatccaagtcttcatttattctgttctacccacatggaatgcccttctctttctctgaatatctatatttttctttttaattgagatttagttcatatatcataaaactcacattaaggtatacagttcagtgagttatagtatattcaaaagattgtgcaaccatcaccattatctaattctagaacattttcatcatccccaaaagaaactctatacccattagcagtccttccccatacctcccttccccagcccctggcaaccacaaatctcctttctgtctctatggctttgcctattctgcacatttcatataatctctgtatatgtagatcctactcatctaccctaagatcatgtttgtttgtttgtttaagtcatttttttcattcacaacattaaaatcacaacactcataccctgtatcagacactgtgccaagcaaaggcaaatgtcattttaccttcaaggggctccctgcctagtgggggagacaggcagtacagtgttcaaagtactattatggtgctgtgaacaaagtagcagaggggcaaagaggtttgagcaagaaattgtggagagccagggaaatcctcactgaggaggtggcatctgactggatattgattcatttgttcattcattcattcagcaaacatctgttgtgcctcttatgtgccaggcacagtgctggactctgaagatacaaaaatgcacaggaaaaattccctgtacctcaaggaactcaatagtctggaggagataaatacatagcatttcaaaacaatataacataagttatattagaggaatggaaagctcactgtgggaacagacaactaactgttcttgtgaatttgaagaaaaagtataagtctatgaagtggacaaggatgaggagtagtgtttcaagcagagactagaccgcctctgactggaatatcctagtgctcatttctttaactgaatgagagcacctaatgtttgtgtctcttaatcacataccttgtgaagtcgtctttacatgtggatgccttgtgtccccaaaagcattgcacaacctttaggataaaagttttgtcttttccctcttagtgccctcattatcacagtgttttatgtatagtaatttctttttggatccaaatgaatgaaaggatgacagctgagacagcattcttgacactctcaaaaagctgctgcctaatgtgtctcctatcacatttctcccttctggggctttaacatgaatgctttctttgtgttccatctcctatgcaagaaccaagaaagtagcttcttagactaatacttttcactattgcaaagtattgtgaagaagcaaatataatcttgtgattagtcatgttaaagaccactgataaggctaagggaccatcttagaaatgtgtgctgtgttcatagctaggtagatatcgttaactctgaagatgaatataatttctactccaaatatggactaattctggtgacagaaattaagaaattcaataaaactgcttcttgacaaccttatccgaaaagtagaggtaggtattagggaggtaattgactgaagacagaatcaagggaagccccaaacagtatgcaagtttttctcgtgcctcaggaagattaggaatctttctaattctttccttcagtcagagaggacctcggtttacgtctcttcatgagatcttgctatggaacattctacagctgacaaaccttcaaagtgctctcctcctgcactctccaggagcacagaccttcctaaacatcagcagagctcctattgtttgtttagtaataaagggacatagcatggatacaggtagtgccacaatgaactgtgacagtaataactgcaaaatttctgttcttggattatagaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcaggtaaggagggagagggctagggcagatgacatgacctagggggcaagaggttatggctgggctctccacaaggactcaaccccatcctccttggctaggaaaggatcttgctcattgttcctctcaatggttccacataacttcaagaatcaggagaccataaacagtaattccttagagcaaaaaccaagaaggacagagaacagggggaaatttaaggatagcaaatggaatctaattaagaggaatgccaagagtgagctctggaaagatgcatcactgtcagtgccagtgcatgtgggaaaggactggcctctgctcaaagcaataactgttgaaaaaggcattttctccaggaactattctcagttgcagagttctgggccattggctaaccaggagaggtttggtagagaaaaagccttgttaccaaataagagcaaaggatattttatagttaagtatcttctcccttataataggggattccttttcctcaagagaggactgtattttctccccaaatctgagatgcttcagatctccgaaggtaacggttagactttcatgccatcaccgtgggtctgggaagctttcccacatttctttttcccctcaagaaatctatttgttgttctctttcccagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaatttaccttggtgaccagctcatttctgggggacaaatgaattttccaaagtgctaaggatgatattgaaatagaccatgtgagagcaagatggtttatgccccatctgaacaaaagagaatgttcatcccagttcaacacagattgcattttattcccaaagtgctcaaattcctaatccctgaagatatcaaagaatcccagactcttatttggaaggaccttagtggtcaccagggccagcatttatctgattcatgaaatctctctctaacatccttgagaatctgttgcccagtttctaacagaacttattccaggccaggcgtagtggcttgtgcctgtaatcccagcactttgggaggctgaggtgggcagatcacttgaggccaggagttcaagaccagcctggccaacatggcaaaactccatctctactaaaaatacaaaaaaaaaaaaaatagccaggcatggtggcgcgtgcctgtagtcccagctactcgggaggctgaggcaggagaatcgtttgaacccaggagacagaggttgcagtgagctgagattgagccactgtacgccagcctaggtgacagagcaagactccatctcgaaaaacaaaaaaaggaacttatcccatgacagggaattcctgagatagctgaacccacctattttgctaattggtaaaatgtcctacctcatactaaacagaagtctgtctccctgtaacaaatctgcttcctgtgtcacagatgccccttggagatgcctctgaagacagaagccaggcctatctttgtcctccaggctttttctccttcgaggtaaacatcctcagaccccttagttgttcctcatgtgatctggtcacctcaccttccaaaagccaagccccatgttccagtgaggcctgaccaatacagttgagcagcctctttctgggtagactggcattagtgtaccataagattacactacctttttcctccagttgatttgtattaacatttttaaacttttgattttgacatagtttcagacttaagttgcaaccaagcacaaagaattgacatacaccctttatccagcttctctatttattttttaccacattgccttcctgtcactctctcagtttctttctgaaccagttgagattaatttgcagacatcctgccccatttccccttaatgcttcagtgagtatttcataaaaacagggatactctcttacataaccacagtacaaccatcaaaattaggaaattaacaatgattcaattctaccatctaatccacagaccgcattcaaatttcactgattgattaacttagtaaagtccttcctaagttcaggattataagttgtatttagttgtcatgcttctaccatctcctacaaactgaaatgattcctcaatctttccttatcttttatgaccttgacatttttgaagagtacaggctaattactttgtaccatgcacctcaatttaggtgattctgatgtttcctaatgattagcttcagtttatgcattttgggtaggcataccacaaaaaaatgatgtgttctcagtgcatcataccagcaagcacacaatgtcaatttgccctgttactgaagttaagaagatgtctgccaggtctctccaatgtaaagtcagtagctaaatattttgtacttagtggttaataattaattatgaggtacttggtggaagatagtttgagactaagtaaataccacattcctcattaaactttcaccactagttttagcatccattggtgattcttgcctgaacatttgtactgtgatggttgctaaatgttgatttttctgcttccatcattccttcttcatttattagttggcattggtaaggtagaggtttttcttctcccctatttattcatgtttttaaaatacattttagtacagactaatggattcctgttttattaaatgggttataagccattatcattatttattttgctgc

SEQ ID NO: 14084 - DNA, 4877 bp, Human
gtagctgagcttcagtcaccttgccagcacctgaccaatgaggactagttaagggacaacaatcccctgtctgataagggaaagggtgtgagctaaaggagagtggaagaaggcaaaccagaattgggatcactgcaatgaggagaccccagaggtggccctgaaggttcacatgcacacatgatgaaagagccagactctcaactcctaaccccagggaacatcaatcaccagtctatggacactctgtatgtctcaccttcaaactttcccaaaaagagtatctgggttatttaatcagccactatcacatagaaaacactccagtggagtagagtagtgccaggccatctctcatgcagcaggccagtctatgaggggctgctttggacagaaactcattcctggtcatactattgtggctggaatccagtcatgaggggtgtagtatggtggccacactttcacaacccctcagacagagattgagagcatcacagtccttccaagtttactcagaatggggcagtgtatatagctggcaacatgcttagtgtattcaggacataaattagaggttaatgctattattgcatgtttcacataccaacatttcatatctcatctttctcccttcttatgtctggatacatctcaaccaattcaccttttaataatatatattgttttgtcatctcagttttttatttcctgtttcttgcattttattgagaatgcaaagcagatgctttcttacacttaattctgttttctggtgtaatttttcaagctattgcttacctttgcttcatgagttcagtagtttcttgttttgtgttcaagaattctaagattcatgtttgcttgcttctgtgttgtcttccttgaatgactaaaaagtccatacagactccgagtttatcatacataaggtcaatgactttcactttgtctctgtcaccaactagcaattagaataacctctcatttctgaagccacttattacatatttggtgtctatttggaagagttgtcctgaactgaaggaaaacgtattccttttatagcctgcttgtatagctatgaaatgatgcctgcacatttagaagtaatacgctttactagtggtaagagggtcctctttcaattcttcctgagcaatgggagcagtgacaaaaagaacctagccatgtaagagaaaaaaaaaaacacacagtgatgttaatgggacaagaacaattcctgaaaatatataaggcatatgctcaaagcattggaattggcagaagaacaatagctaagagaggctgtgtgcagtgttttctctgcagtttgatttctctaagtgggggaattcaatgggcagttatgagagtggcctgcattggatggaaatacttgaaggtctggggttcagcaattttgtggaatttcggaggaaagacttttcattatcatttttatttaccctcacactttggttgtagcatccaccactagctgccatgagaactgggaagatagggcttctgaggttcgctttggtactgcactcaacagagcagaaacatcatgcaggacgtgaatgaacagggaaggattcatctttcttgttgctcaaattttaggttaaaagagtgaagatgtcatttaaagaagataaggaaataagctaagtgcacctcagaaaaagaggaaataaacaacatggttatgaaatacatatgcctttttggaataatcaaatcacctcaggagcaggaatccacatttaaacatttccctacattcagatgtgatagcaaaccagcaagcaaagcataaacaaattctatagataggaaaatgacaaaatcaaaaatgagcttgggaaaatttgcttccagagagaggggttttcttgtaccagacagtggtggaatcaggaacccattctctacctggaaattggtacagagattcagagtctttgtccaggaagacactttggagtagaagaatgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcacttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctaggcctagaggttgcctgaggcacaggataaaagactcccgagcaattgatataattaataccagaagagagtattgctcttatcaatcaattcattgtgaatcaccataatgcaaccctcattcccttccatcttcgcagccatgtatttgtaaataatcaaccctttctctatccttttccactggtttcctttccctttcacaatcctcaggttggttccaacttgctcaagactgccccatctctccttagtccttgccaactctggaattgtacacctggtatattctacacaagacagtcaaaatcatggtgtccacacattactttaaccttcccatgactgccagttacttcacacatgaatatgaataccatcccacagaaacatattgcttgtaccctgaatgattcccatactaagccttcaattcacttttttagtcaaggagtctctctctctctctctctccctcactctctctctccccctctccatctctctctctttctctatcccctggctgtttctggacttttatctgatgacacaaatgttcttatttgcttctcttccaaatgccatgtctttatctctttaaaactcaagtcaaaatttaactctttcttcatttccattagccaaaacattatactcttccccagaatagcagacactttacccaatccagattcatccttaataattccccaaatattgacaatttaattgtgtcaactatacaactataaatggtttccattggctcaattcttgcctctctattgtattataacttgtattgtattattaacttgatggaacatctccatgttgagacatagttgttttatttcccatatacaacccagatatcagttaagaaccactcttagctcataacatttgagtggcgttggcttacactttctacacttttttattctgtccaaagccctcccaaaatgaataagaatatagaaatcacacagtaatcagtgaaaaatcacgtataaaacatactcattctttagacgttctttctgcctccctgtctgacacgtttctctcataccttcttcccttgcaggaccccatgcccttatctccaaggcatctcactcctcatttatctcctcttcaccctcaactaccagcagctatgtgtcttggtaatgtccaaccactatgcctttgggtctcagcctctgtccaccccagatacttattaaggtattcttcttaaagccagttgcatctcttacaccattctggtaccaagcgtaaataatgtgatgttttctaccctttgtatatattgggcatgtctggtgaactgatcttctagctctgccgttagaagattgaaacacctcctgaaagcaaatcatcctatggggcaaaggatgcaagtatctcaagcttgactgtgaaagaatggcttagtcctggaaaggaatggaaattctgatctgcttgtgggcttatcactctgatttgtctctgagtcaaattcatatttgaaactgaaggtgtgaaacataagtaaaaactgaaagaccacttttaccaaagactctgtgccatttggcatatctcagcagcattcctactgttgcacacagaggggagtgaagcatgctgtcccactccacagaagcaccctgtcagccttgcatctccctaggtccaatggtttcactgcagtagaaggtgggacaaaacctggtggatgcagtaatgactggggagcagagtcctaaccatgggtctgagaagaaaaaaggaaaaaaaaaaaggtagatattggcattgagttgactcccaggaatgcttaggaggctggaggggaggtgccttatagggtttgggatcctgctggaatagattgaacaagagccagtgaaattaggattctactgctatttgtcatttgcatccacatccagatgaggtcttgcatgttcaaaaacctcagatagctgaaataaatagaaac

SEQ ID NO: 14085 - DNA, 4787 bp, Human
aatcagtccttaaaaacacacagagagcgcctctggcagcagccgcccacgcccccggccctgcgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtctccagaaatgttaaggagggaggtggtcaagacaggctgaagaatctgagttttaatttgggggagggggaggggaggaagagggaagttaataatgcggctgcggtgtacccgtgtggggtgaaacggaaccagatgcggctgctacatctggaaattgggggtgggggagtgctgggggagaaaggcaccgtggtaatgtttttcaaaagggttgatagcttctgggctcagaacaagaaacaggcttcacaccccaccccccccccaccaccaccaaaaaagtgtctggctgcctcatagggggtgtgtgttctatatgaacccccatctacaaggtccataaaattcctccgcaaacatgggtcgtagcctcacttttctcccaaccccaaacataacggtaggggaagcgaggtgcagaggggtctgggccagagaagcatacgcatcgctgccgagtgaaccacaccggacaaaaaccctcatcccttcccccacctctaggaaccagattgggaccgaacggtccttccgcccccatcccacacctcggcttaacgaccgtgggttgtcctcccgttccccaaacttccgaccctttcagagaccgtccaagtcataagatcaccccttctggaaaggggagtcgtttttcgctctcagctcaagcagattcagccatttggtgacgacacctccttaaaacctattccaagagaagctaacctagccctccacgtcctccgcagttcatctcccaccccatccgaccccaacccgcaccccaggctttcccgggggtggaaaaggacttaggaatgccccggatttttagcgttgagcccaaagctacctgctgaattgggggtgaatccccaaaaggggaccaaaaagacatggagtggaatgcaacacacacacataacacacacaacgcatcccacctcgccgcccactcccgccctcctccccagtccaggaaaccgcgggcctcgccgccttcgccccgggcctgtccctcccgggactcactgaggagccgccgccgcctcgccagctcccgagcgcgagttggaggaaaagttgggcggcgggaagagcggcgggacgagcgcagggagggggcgcaggagacgcggacggagggaagggaggggagacccaaggggcgcggatcgcccgggagggagccaggaggtgaaaggggcgggcggcgagcggagggaggcgccggccccggctgggctgcggcgggcaaagcgcgcagccgggaggctccggcgccgggggccgctcgggacgccaagcccgccccagatccgggggcgccgcggctcttacctcgctcggcgtggaggttccgcctcgggagagtccgccgtggcttgtgcgagcgggcgtgtgcccgcgtccccggctccggcccgccgcccccgggctctgttcgggtcctggcggggtcgcaagagctccgcggccggcgctcgactcccggcggcgctcggtgctcggcgcctccagcccgggcgggaacaatggagccggagctggtgccccggaggcggggcggggggagggctcccgtccgccacccggggtctccagaccttgtgcccccctcctccagaacgcagcggcggcgcctcactttccttgcagaccgggctccatcgccctgcggaggccccggcgccgcggcgtgcccgactgcagcacgggtaccgtgcgccctgcggggcgccccgagctcggaccggagaaaagtccttgggttccgcggcttttcaagcagcggcgcgctcgcggccggggaaggcgaggtcgccgcaatgcgctacgaggggtctcggtcccgtccggacgtggccgcccagctcccggcacacccgggttcctccgcgcgctgcggctgcaccggcgtcccggctcccgctagctgccgcccgccgccgaggacgccgcgcctgtggccgcaagagcgctccgagcgctatgcgccggcgaggcgcgagggctcgctctctcactcccacccgcgctggtccctcctccgcctccgccccctgcagctgcctgctgggccttgtagttccccagccgcggccccaaaggacggggagcgggccgagctgtccggcgctctgcccttctcttcctacagcctggtctcctttggcgtttgcgcccctgcatctgagcacgtcccagagggcgccggaatgtcaggccctagacatagcagcggtttgggggctagggggcaggtgaagagacgccgcagccttgaggttgtacctggtagcgtgggctttggagtctgtgcgccttggggaaatgattttcgcgctctaaatctctgttttcccatctgtaaatgggggataatagtgcttttcacatagagttgaggcgtcaacgagggcctagcgcatagttaacacttagtaaatacaagccggttttattataaggtcagcccctcctcaaacccttcccttggatttcagctttccccagccacataatttaggttttgtggtccaccgggaactggaccctgtaaattctacagcgatgctgttggcttccagaagtctccagcctgcagtgaatgtctaggaagcaaagagtaagcagtgggagttgaggggagacgtgtggttggtttggaaattaatcacagcccactcagaacaccctccagtactgtggaacacaggaaagtggctaaaatgcttccccctgagtcttcccgcgaagtggtataatgtagtggttccctaatccagatggacacgggtcctagggaacgtctgaaaaatacaagttcatgggcctgctcagacatgaggaatcacgctgtcccaggaaggagccaagagcctttattttttccaaggctccttggggcgtgtgatgtgagcccaggctgaggccaccattggggtgggaagtaggcagcacttggtctgaaggattcctccattctgtccatcatttatgaagtttgatgtaggacaaatcatgcatctgataaaatcaaaacggggtatctgttgatactccttcacaagatggtcataagaatcaaataaaataatagctctcagtggaccaaaaatattacacaaatggaagtcactatgaaaggtagtggcagggcctgttcccttaccatcacccacctcaaccccgaaacttgtagaagtttgaatactgaatgagatccccccacccaactcctcacccaacccacccacgcctccctggctaatttaagaaaagagttggccgggtgcggtggcttatgcctgtaatcccagcactttgggaggccgaggcgggtggatcacgaggtcaggagatcgagactatccttgccaacaaggtgaaaccccgtctctactaaaatacaaaaaaattagccaggcatggtggcgcttgcctgtaatcccagctactggggaggctgcggcagaggaatcgcttgaacccgggaggcggaggttgcagtgagccgagattgtgccactgcactccagcctggcaacagagcaagactccgtctcaaaaaaaaaaagaaaagaaaagaaaaaatggtcctcgcgctatttttctaatccaccagtaggtgacagactagtggccaacacagtgttattcacatagtagacactcatgaaatcccttgactggccaaagagcaaatattcaataagtatttgttgaacaaatgagtaaataaacaactaaattacagctcacgcctgtaatcccagcactttgggtggccgaagcgggaggatcacttgaagccagaagttcaagaccagcctgggaaacaaagtgagcccttgtctctacaaaatatttttaaaaattagctggaggtggaggctgaagaaggaggatggcttgagcccaggagtttgaggctgcagtgagctatgatccagccactacactccagcctgggcgacagagtaagaccctgtctcaaaacaaaataatacaaaacaaaaaatgagaaacaagaactcatatctttgttgaataaatgaacttcagccactgtttatagggttttcccctaagagccaccatttaacctttcagctcctggtcaagcttggtttatactcctatgtaagctgcccacccattaggcctcctgcattttaattactacacatcacacgcttgtaagaaggccatactcacaccctacccccaagaggccttccctgcccatcccagctttgtcagtccctggaccccctgctcacttgctgactatccactgagttgataccgtgctttgt

SEQ ID NO: 14086 - DNA, 4787 bp, Human; identical to SEQ ID NO: 14085

SEQ ID NO: 14087 - DNA, 63760 bp, Human
gcccagtgaaggaccataaattaccttggtcatctttccgtgtgatgatctccacatccgaaacttctccaaatctgctgaactgattttgtaggtctgcctcagaaatgtcctggctaaggccacccacataaaggcgcttcgtttctctgttcactttcatgaaggctgggcatatacttgggtgtgtttcagtgggaaaagtaattttctgtatacagagaagagttctttcccttagttcttctaaaatctaacaaaacaactacttcctctgaaccttctgtatcaaatccgtctcctggatctgtatttcacttcctattgtattacttccaaattttagtcttcgaggttttgcccaagccctacatccacatctttcatgaatgcactttggaacagcaaccccatacccatatagacacaggtacagacagagtttttttcctccaaatggccataatattacactctatccctcttaattttatgtattcatgtttttagatgtttttccttgactcactcatacattcatttactgtctttaacaaagtctgacagaaacaggatgtaacgcactaaaagataaaaagagctagcctacctcttcctaattgtctccacccccaacctacccaccccagccttcttcctcctagaagacccaaagaagtgaatagagaggctaggagctccttatagtcacaaaagaataaaacaaatggcacaatattatgtcacaataaaagtgctgcaaagtggggttcagacacaaagatcaagggatatagcgaatacagacttgtgtttttgctatgtgcctgcattgtacaaagtagtttgcatgtttcccatttttcaggagagcagaagaggttaagtcacttcctcaatgccataccgaaaattagtgaatccaggattataatgcaggtctaccttcagaacttggaattcttaacactatactatgaaggttgctgtatcacaggggactcaggaaaacttttccagaggtactagggcccatcatagtatctctcatttcgtttagcacccggcaggcgctcagctctcgcccttcccttccccaagagctgacagactctttccagaagagactcccaaccagcgtccaccacatggcgtgtattctgggcagaacttcggcctacctcttcccgatagtctccgcccccagcctacccacggcagccttctttctctgagaagacccaaagaagtgaagagagactaggaaacggccctgtgacttctcatgcccgaaacccactcctcaccacgtcgttcacctaaagccagcgccgctgcagcccctaacttctggtcacgtgtcccaacggagcatcctctcttccttcctactcgatttccaacccagcctcctaaggttccgttaccacaattcagttcccaagagcttttaatttccttttccgtcctcccaccttccctgacgcctccgtcacctccccctcaacgactgcaaaagagcctaaaccaaaatcccctagtttctattgaacactatcgctgtgtgtaccaattcctggactaggtcggcgtaagagaggaagtaggtgaaaaaaataaagaggcgctcccctccacgtgatcccagccctgcctctttagtgaggcacgcggccgggcggctccaaggctgccggctagggtgagcagcggagcgcttgggcttggagtagcaaagaacgcgctctccagagaaagtatagccactgcttagacagccagggaaacgtgtgcggggaagtggaggactcaggctctcgtgcgagagcggagttggacgtgcagggccgctggggtcacgcggagctctcccgcctcccctccgcgtgagctctgggatggtccgcgccgggagcgcgcgcgaggcttgaagcgcgggtgaagcgcgcaggtcggagtgacagctgcgctgccggcccggctgcggtcagcaacgcgccatggacgcagagctggcagaggtgcgcgccttgcaagctgagatcgcggccctgcggcgagcgtgtgaggacccaccggcgccctgggaagagaagtcccgagtccagtacgtgaccaccccaagtcccccagggcccgctggccagggttcccgggccaggcgggtgaatctccacagacatcctcggtctcctactcccagccctagaaagtgggcatgaactggcattgatcctgtcatgacgatggcctagagttgggagcagcgcgtacggcgcccagctgtaaacgcattgcagggtattaactcgtttaatcgcagtcgtctgtgtggatgactgacaaggaggaagtcttgactatatccctagctagataattccgcctccagtatgcagaagtatctctagttgggatttaataactccgtttggtttcatggcatttgttttggtaggtcagctaaccatctcaactgataatgactttgtgtttacgatgacataaaaattcctttgaaaaataacttcggtaaaaaactaagttgataaaagaaaagtagttaatatagactgcaggagaatttgacattcctctgaggtaggtgctactgttagccctgttttatagttgaagaaactgaggctcagagaagttaggtagcttgtccaaggttccagagaaaggaattgtcagagatggattgggacccaaaaattttactccaaagtctgggcacttttggtttattgaaggagagggagagaaaagctctgcaaccgtaattatgtattatcatctcaaacatagaagcctctcgaaaacataaactgtcttcaatttttgagtcaagagtaatttgacataggtgcagaaagaatgggatttttcctgagctaactggagaagaattggtagaaaatgggaaggaggagatctacagaaaatgtctgcgtgcggtcatgaaagtagaggaagctgtgactggttaaagggagaggaaaaaggtgtgctcctccacaaatgagagtaaatgtattaaagacccttgctatttgaggtgtgctccacagatgggacgctttagcattacctggcggtttgttagagcgacatcctgacctactgaatcagaatctgcattttaaaaaaatacactgccctaacagaggatttgtgtgcacacttggaagtttaagaaccagggaaaaatagtttctttactggccacaagatttcattagtccccatagtagtgtcaactgaaaaatcatgagatctgcaaatttagagagactatttcttaaaaagggttacagtctgcaaagtggccatcctgacaggctaggaagcatagtctcaggcaaagcagaaaggcccacactttggaggaggaggggttggggcagggatttatgctgtatgagtgggctaggtatacatattcaacaggttataggaggggctatgaatattcacgaagggagatgtgctcacctgtactgaataaaaatgcatattacatgcactccatattcattttgggaagctgacttaatatttaaatgcattacaattaggccctgtacgtcaaaagttgaaggagggaagcaaaggtacttaagtacacaggccttgtaaacctgttagaacaagtccatggttggtgatcttatcaaaagaaaatttttgaaatcattctcttgtcctatcaaagcctgtggaacaggggaatcagttagcatctggtggtggatgaactgcaattatttcaatattgcttatctggaggccagtgctagtgaaaaaaatattgtggcagttagaacatagttcattcttttaaaggtagggggtatgtgacttaacccttgcctggcatggccttaggtcttgtttataatttggtatcttattgccacagagtccgttctgcaactcttacgatctctattttaacattaatgctggtcagttgttgtgtctacatcccaaataggaaggggtataacgaggtgtgtctgacctcccatcctgtcatggttaagaactgagtttttaaggtttctttggggtccccttgaccaagagggagtcggttcaggtgattgtgggggtggggtaggattttatttttagttcttagtagattatttatataatctgggacttctcagtggttaaattggaaagtcagaagagtccagattgtgggagacattaaatgtcagtccagggtgtttggatttaaccgtgaggtttcttttcactatagtggaggaggaggattggaacctatgtaccaagctatttttttaagtgattataagtggttggatggattggaggtaggaaaattggagctaaattattcagctatatccatatgtccacactgtggagccaaattgcctgctttcaaatcctgtctctgctattggctgagtgatcttggttaagtgagctccccctttctgtgcttcagtttcctccgtggtaaaattatacccaagtttttgggttgctgtgaggactaattgagttaatatatgtagttcatttagaagagtacttgcctcataatagtaactaacactcattagtagaccattgacctttaaactcgtgtacagattgattttaaaggaaaaaaaattcttgcaagctcctaattctgacaaaaaatttttatgttatgaggacaaacttacaaataataaaaccacaaagtgaataaaattcaaacaaatccaaaatagctcaaactaacatcattagttgaaatacacaaatattttgctcaaactaaataactgctatgaataagaatatgcagattttctttttgtggcaaaatatacataagatttactattttaaccatttttgagcgttcagctcaatggcattaaacacatgcacattgttgtacagccatcaccactgtccatcttcagaactttttcatcacccctaaactgaaacaccatacctattaaacacgaactccctactagccactctgacaactgcaggttcttttttgagttctgcatatccagcctttaatgatgacttggttctcttaccactttgctctatcggaaataccttgaaattttccttcatagtttgctgtgacatttggtgttcacttgtcagaagctcatttatatttatggctttttttttttttttttttgagacggagtttcgctcttgtcgcccaggctggagtgtggtggcgcaacctcagctcactgcaacctccgccccctgggttcaagggagtctcctgcctcagcctcccgagtaactgggattacaggcacccgccaccatgcccagctaattttttgtatttttactagagatggggtttcgccatgttgggcagtctggtctcgaactcttgacctcaggtgatctgcccacctcggcatcccaaacttctgggattacgtgagccaccgtgcccggccgcacatcatttatatatgaagattgtctctgttcttttttctttttctttttcttttttgttttgttttttgagagagggtctcactctgttgcccatgctgaagtgcagtggcatgattatgactcactgcaaccttcacccacctcccatgctcaagcaatcgtcctgcctcagcgaccctccaccagccaagtagttgggactgaaggcatggcacctgccactatgcccagataattttgtgtgtgtgtgtgtgtgtgtattttttggtagacatggggttttaccatgttggcccgactggtcttgaactcctgggctgcctcaggattacaggagtgagtcgctgtgcccaatctgttcttttttccttgacttctatatttaatgtaatttgtaggggcatcagtctatgatggcaaatgcaaaagaagctgtggtagtttcatgatacagaatatacttatattaacattttaaattagcattaaaacaaaatttgagacaaattttacagactttattaagtcttggattctcagtgtgaagaatatagagttagattattctgtgtagagatggtataaggtcataagagcattggttaatgtagtagaattagaaatacaaaaggaagaatagttatgtgagggagcagaacggatggcagtaagtccagatgtcaggcaagtgaaggagtcaaggataacttccaaggtatagagcctgacataccaagggaaatattttattattaacaaatgtagggtaatttagaggaaaagcagattccaagagaaacgatttggtgagctatcaagctagatctaccttgcaggaagaagagatacatggttagaggtatattttaagagttactggcatagaggagctaaggctaatcatttagtgttcctgcagaatgaaagaatacatatttaggatagcagaagtaagagtgttagggttttcctctaatgttggagacaagaagctgaccctagatagcaaatgagaattgggataattatgcccaagaatccaaggaagagatgttttaagctggccggaaaagtcaacagtatagaatgtagcagagtgtttaaaggaaataatggatgacaaaaaaaaaataccatctaatacaattattagctaaaatttctttttttaaaaaagtttaagttttttttttcttttctttgtttttttttttttttgttgagacagagtcttactttgttgcccaggctggaatacagtggcgtgatcttggctcactgcaacctctgcctcccatactcaagcaattctcctgcctcagcctcctgggtagccaggattacaggcacccgccaccactcgaggctaattttttgtatttttagtagagaaggggtttcaccatattggccaggctggtctcgaactcctgacctcaagtgatccacctgccttggcctcccaaagtgctgggattgcaggcgtgagccactgcgccaggccaactaaaatttcattctttttctcaaggaaaatatatttatatgttctcaatgaagaatgtctggccatagtgatgtttaaagagatttgctatttctttttccgataaatctctttcttactataaaacgttctgtggtgtttacttttagaaattaaagttagctaattgattttattttttaatttctttctttttttatttttttgagagggagtctcgctctgtcgcccaggttggagtgcagtggcacaatctctgctcactgcaagctccgcctcccaggttcacaccattctcctgcctcagcctcccgagtagctgggactacaggcgcctgccaccacgcctggcaaattttttgtatatttagtagacatggggtttcactgtgttagccaggatggtcttgatctcctgaccgcgtgatccacccgccttggcttcccaaagtgctgggattacaggcgtgagccacggcgcctggcctattttttaatttcaagacatcttttaaaataatttgagagatatatcagacatttaggctggaatttcatgggtcagaacacacattgtaattttgcaaagtagtcctgttataatttatttgaaaggtgtttctaatatgtggaaatttggaagtataatttggttacatatgttttttgttgaaattaaagattgtgggctgggcatggtggatcacgcctgtaatccagcacgctgggagactgaggcgggaggattgcttgaagtcaggagtttaagaccagcctaggtaataaagccagaccttgtctctatgagaaggaaaaaaaaattagctaggcacagtggcatacctgtggtcccagctactcaggaggatcctttgagcctgggagttcaaggctgcagtgcactatgattacaccactgcactccaggctgggtgacagcgtaagaccctcatctcttaaaaaggaagaaagaaaaaaaaagtggtggtgttagtaaccacactggttttgagaaaattctttttaattttttaattttttttattttaatgggggaaggtgacttaattggaagagagtaagagggacaaaatgggaatgctttgaggaaaatggggttattagatgaaacacgtgttagtaattggagtgattatttttgatatttgccttttagaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtaagcattttttttaaatctagacatagtatggaagcttaccttattatgcataagaaattggttgtcataatattgaattaaaattctacaaggtaagtatttgaaagtatggttgtggtaaacttgtttactcacatatcttttgaacatcacggtgttcaaaaagctgcctgggccaggccccgtgatcatgcctataatcccagcttttgggaggccaaggcatgcagatcacctgaggtcaggagtttgagacaagcctggccaacatggtgcaactctgtctctactgaaaatacaaaaattagccggatgtgttggtgggcacctgtaatctaagctacttgggaagctgagccaggagaatcatttgaacccgggaggtggaagttgcagtgagctgagattgtgccattgcactccaccctgggggacagagcaagactccatttaaaacaaaaaaaaaaagggctgcctgagataaatattaaagaacagacacagtttcttttctttctttcttttttttttttaccttctccttcctgatggaaaagaacagacacagtttttatcattaagtaccttaatagtcaagtaaatagtaataagcgaataatgattataagaacaacagcaccattaatttatacatcttaggagttgttcagcactgacatgaaagctgccaagataaatattttagcagctggaccttttgctggaaggaaggtttctggtcccaatgactagattttattgccaaagatctgtgatgcactaagagataaagggaagctactgcagctgtgcaactggatgtcaagaactttggttggtcaagaataacattcccaaaagcagaaatcatttttggtgtgctttctgacttttccactgaaaattaccctcatgacaggggagagggtcttgggcagccactgcagggagactgaattacatgtagaaacagagtgatggaatttggagacttaaattacttgaaaggaagagatggaatgcagagagaatagagaatgaggataggccagttataagacttttactagcttaaaagccgcagcatgaagattaggcgtagagtcttgacaaagctaatgtggtttgaatgggagatttcagacagggacatcacaagagttgaaatgcttttttcctgtgagtaatatgtgctcattttagcaaacttggaaaaatatagaaattatgaagaagaaatatcattttaaagccagaaatctaagtagttataggagtttcttgaaattaattgcaagtaattcagcaagagtaatggtaccggaagagaaatatcttgttttttatttttttgttctttttcctttgttttttgtttgttttattttttcgagatggagttttgcactgtcacccgggctggagtgcagtggcgtaatcaaagagctttttgaagtcattattgttttccatagctattagttgggcagacacagtttctgtggtgtgttaatgaatgtagctgaagctaggtaatcaaatgatcttgatttccttcaaaataatcatgtgaagaatgtagactttattgcagctatgcttttatttctccaaacattttttagaactttcttttggaatttccttcagtgcctatgatgattcttttaaattctccattttgattctgtaagagtcggtttacaaactaagtaatggaatttggagtcgaaaattaagtgttactgcaaagtaatgagagtagggtttttttttttttttttgagacagagtcttcctctgtcgcccaggctggagtgcagtggtacaatctcagcttactgcagcctctgcctcctgggttcaagcaattctcctgcctcagcctcccgcgtagctgggactacaggcacgcagtgccatgcccagctaatttttgtatttttagtagtgacggggtttccctacattggctaggatgatcttgatctcctgacctcgtgatacgcctgcctcggtctcccaaagtgctgggattacaggtgtgagcccctgcgcctggccgagagtagtattttaatttataatttttattcttgtcttttgattagctttaaatgtatgttgttaaaaatatgtagatgggcttgatgtatggatggttttgaaggactaatcctcttctgctgtctgtgaactttgttaaaaatgcacccttactcattatttaaaaataaaaatcaggccaggtgcagtggctcacgcctgtaatgctagcactttgggaggcctatgtgggcaggtcacttgaggtcaggagtttaagaccagcctggctaacatggtaaaaccccatctctactaaaaatacaacaattagctaggcatggtggagtgttcctgtagtcccagctgctcgggaggctgaggcaggagaatggcttgaagctgggaggcggaggttgcagtgagctgagattgcaccactgcgcttcagccttggtgacagtgagaccctgtctcaaaaaaaaccaaaaaaacaaaaaaaaaggccggttgtggtggctcatacctgtagtcccagcactttgggaagccgaggcgggcgaatcacttgaggtcaggagttcgagaccagcctggccaacatggtgaagcctgtctctaccaaaaacacaaaaattagcagggcgtggtggggcatgcctgtagtaccagctgctcgggaggcagaggttgcagtgagtggagatggtgccaccgcactccagcctgggcgacagaacgagactccatctcaaaaataacataaaataaaataaaacaaaataaaaatcagtgtgttcaagttaaaaagtactgaactgaaaatttatcatgctatatatttatatgcaatttatgtatgcatagtgttcatctataaagaaaaaataaagcctggacataaagaaaaaataaagcctagagattggacagattagtaagtctctctctgtctgatttcttatatgcaaaataaagtggttgctgtagattatttccaggattccatctgcattttttctttaccgcatttttggcacatttatttttatggacaaagcccaaggtcatctagattttctcctatattctaggagttttatagttttgtattttatatttagatctgtgataaattttcagttaatttttgtgaaaggtatagtcagtgtctagattcttttttttttttgttttgcatatggatgttcagttgatccagcaccttttgttaaaaagactattctttctccattgaactgcctttgctcctttgtcaaagatcagttgactgtatctgcgtgagtctatttctagactttctcttctgttctattgacctatttgtatactctttcactaataccatactgtcttgattactgtagctttatagtaagtctctaaatcaggtcatttaagttcttaaactttatttttcttgaagtttattctggctctcctgagtttttgcctttgcgtataaacttgataatcattttgttgatatccagaaagtaacttgctggaattttgattggattgcattgaatgtactgatcaaagttgggaagaactgacatcttaaccatagtgagtcttccatagctatttgtttaaacaattccacatctaatccacgattaagcattgcatctatctgttatgtctctttagtctccttaatctggtcattcttctctgtctcttacgacatagacatatttgaagaccacttgtattatagattgttcttcaatctcttttttttctgatagtttcctcttgatgacattcctgtgcaattttggcaggaaaactatgaaagtgatgttttgttcttaccagtacatctaattaggaagcaaattatgtcaatttgtaccattctgtctttttttcctaactacttattgaacaaatctttaaccagtcttcctattttgagccccaggttcacctcccataaaggtacttggtgctgctgactcataatacccgtctcgtattctgctatgtaaatgaacttacttctgggttttcctcatttgctggcttaggtttcagttttcctggctctaccaggtcactttcatttgtccatgtgctatctagtgcatccatctgatttccagcttcccaaatctgattgctcttatcttccctgttccctttatccttgtagaatcttgcccttctaaaagtaacgtcattagcaaaactagatgactacgtaaagtcaggatagtgcttacttacctcttgggggtagggaatagcctgggaaaggatatgagggaaccttataggttctgtaaaattcctgtagtatgatctcagtggtagttacctgaacaaccacatgtataaaagaaatattgagctgtatacttaagaatagggcattttatgcattcaaatgtatgcatgttatatctcaaaaatatcactgacattttagtgaagttttgagagatggcagaggtgaacgcatggattcaatttactgcctttaagtactagatagtgttgaaaaaataaaaagcattgaacagttaacatgactcaaatttgtctagggttatactagtacatttctactacttaccataacttttggtatagttgaaaacttggccgggcgcagtggctcatgccagtaatcccggcactttgggaggccgaggtgggtggatcacctgaggtcaggagtttgagaccagcctgaccagtatggtgaaaccctgtctctactaaaaatacaaaaattagccaggcatggtggtgcacacctgtaatcccagctactcgggaggctgaggcaggagaattgcttgaacccaggaggtagaggttgcagcgagtcgagatcgcaccattgcactccagcttgggcaacaagagcgaaactccttctggaaaaaaaaaaaagaaaactagaaacacaagttatcattaattttattttgcaaagataatcaatttggtttacgttcttccagagtttttcaatgtaattgctaatgcacactttcacacatatacccacatgtattgtagatattcacacaaaattaaataatacacatttgaagaaaatggctatttgcaaacaaaatatttgtttttctgctttacaggtattagaaaagttctacagagacacagattatcaggaaattgccacatggttacatttcaacttgaatttcagattctggaaattcaggtaaattaagaagcatgttgtgataacagagatacttctgctatgagataaacaattcccacaccccagccttcaacagtgatggagctgaagaggagttcatgagccagggcccccccattcatagcacatttgtgcaaagtggtacattttcaaaatttcaggtattaatagcccagcaactgcatatggtagggttgttgtgaaagccaaaggtgctttattgaaggacaggtagcaagatgctcctgggcttccagtgcaattccatgaggttgtgggaatagtcctgggtgtcatcagtagttaggtgatatgccagccatctaatatctattagttatctattgctgcttaaccagtctccataatatttagcatcttaaaacaacccaaaataggccaaacatggtggctcacacctgtagtctcagcattttgcggggccaaggcaggaggattgcttgagcccaggagtttgagaccagcgtgggcaatgtagtgagaccctgtctctacaaaaaaataaaaaattagccaggcgtggtggtgcgcacctgtgctcccagctactccggaggctgaggtagaaggattgcttgagcctaggaggtcaaggctaccgtgagctgtgattgtgccactgtactcgagcctgggtagcagagtgagactctgtcacacacaaaaaaaaaaccaccaaaaatacaattatccctcagtatctgtgagggattggttccaggactccctgtagtaccaaaatccacggatgctcaagtcccttctataaaatcgtgtagtgtttacctataatgtacacacatcctcgtttatactttaaatcatttctagattacttccaatacccaatacaatgtaaacgctatgaaatagttactatagtatattgtttagggaatcattatgagaaaaacaacttgtacgtgttcagtacagatccaaccatctgcatctgtagatttttttttttcaaatatttttggtctgcagttggtcaatctatggatgtggaaccacagatagggagggctgactatatttattaattatctcacctattttgtgtgggtcaggaattttggagccactcagttgggtgtccttgctcagggcctctcatgaggttgtggtcatctgggaccacagccatttgaatgctccttggggctggatgatcttgtacctcgtattgaactgctgagacacaacagagggaggaagacccctttggctaagaccttcacataatatcaggaagcaggaaagcgaaagcagacagaatgataacaagtaaccccactggccagggtgcagcagaacagggctcagccaccttcaaaggctgactccaagaaaagttgaaagccagagaaagcagttgaaagaggagaaagcagtttcaaccagttggttttgccagttgggccaacagggaatgtgtgcaaagaggaggaacagaacagggaagggctgtcaggctgcattggcctcagctcatcagatatctaaagtggtgtagagtagttgttgtaactgagtcctatggacaagctgcctgcttatattcagggtcatgtgccaggattccttatccttttcatcagtgtccttagccacaaaaacagtcccaagtttcccattttgtatgagacaggacttggttatggagtcaggacttttccttattctttgtcagatagccactccctaactagtcccaaggatttggtacagttacctgggtttggaagttttgcttctctttgcaatccaagtctccatttgctattactggctctggcaggctgaggatgggctaggggttgtctagaccccctcatttgatggcaaagctcccagcctgtactcgtcttagagtatcactctcacactgccaaagtgaccaagaaaaggtgtagtatagcattgcctaggccatttgagcaggatacaaaacacatttcagcatgttcaatgtgtcaggggcatgggtggtaagtggctctaggggactgacattgttcccatatgggcagcaggccttggggatgtacaaggtcaccaaggagatatcacatgaccacaaagatcatttgctgaagactcaagcagagaatggacccaaatggattggtatcatttaggctggacaacctgtgccaccaccccaggcttttcctttaggtggctcagggactcctggatgttgtccctttgtaaaaggtttcatagtctgactgactatattttctttctttgtggctgatgtgaacttgacctgagagtggtaatctactgaatgctcttctgtatgctggcatccattaatgggccaggcctgcaacccatggcaggttggtggaatcataatcctatggtccactaccatctccgaaaacatctgcactctagtatatatgtccaggaaactgctcaggggaatcctagcagccttgcggtcttgcaggctttttctactgtaagagttcatctctttcacagttgcctcataggttatgcggagagaagctccgttgtgggcagaattagtcttgtccttgagaggcttgtccacaaatccaagtgaaaagggaaagattatcctctgacattgaggtgaatgagcttcttagtggagttataccttccaggatgggttgtaccctaagattgattggtatgctccttagtggggctatggcctgagacataacataggctataatatccaacatagactacaatatcttcactttatttaagttgcatacttcagtcaccttaaacctctgatggaaagtatcaaatagtaatttgatgccttcctgagtcagataaggatgaggtcaccatgtaaaatgttgcgggaagtcagggaccccaaatggagggactggctgaagccatggcagaagaacatggattgtgaagatttcatggacatttattagttccccaaattaatacttttataatttcttatgcctttctttactgcagtctctaaacataaattgtgaagatttcatggacccttatcacttccccaatcaatacccttgtgatttcctatgcctgtctttactttaatctcttaatcctgtcagctgaggggatgtatatcacctcaggaccctgtaataattgcattaactgcacaaattgtacagcatgtgtgtttgagcaatatgaaatatgggaatcttggaaaaagaacaggataacagcaattgttcagggaataagagagataaccttaaactctgactgctggtgagccgggcggaacagagccatatttctcttctttcaaaagcaaatggcagaaatatggctgaattctttttctcagcatgggacatcctgagaaagagaatacgtgcctggaggtataggattataaacagcccccccaggggcgcctgtctcttatggttgagactgcagagatgaaatatactccagtctcccatagcgctcccaggcttattaggaagaggaaattcccacctaataaattttgttcagaccagttgatctcaaaaccctgtctcctgataagatgttatcaatgacaatggtacctgaaacttcattagcaattttaatttcgccttggtcctgtggtcctgtgatcttgccctgcctccacttgccttgtgatattctattaccctgttaagtacttgatgtctgtcacccacacatattcgcacactccctccccttttgaaactccctaataaaaacttgctggtttttgtggctcgtggggcatcacggatcctaccaacgtgtgatgtctcccctggacgcccagctttaaaatttctctcttttgtactctgtccctttatttctcaagccggccgacgcttaggaaaaatagaaatgaacctatgtgattattggggtaggtcccccgatagtagaagacatttctgataatgtgatatgctcctaaagaatgacagctgcctgaccagagtcattcctagcatgaactaccacatggtttggcctgctgggcctgggcagccgccccagggcagcacagacaggacagaagccagacagtggatgtcctgccacttaggtcctgcaacccctgctgctgtggccacactctgcctcctaacagacagtgttggcactgacccagacctcaacagtattttaagccaatattctcatcctcatgtcatgaaagcatgattgaaaattttgtgaccatttgataatggcctgagattatactgttagctcacatgctgaatgaattagagtcagttgagctgtgccagacagaaaacttaaaaataaaggtactagaagtgtatttctctattacttaagtaaacttgtaagttttcaagggctaatatggtggttttatgataatcaggttctaccatcagccaacatggcttcaagtcatggcacaatgatcacattagcatttcaggtatcaggaagaagttgggcaaagaaagcctcgcctgttcttttaaaggacactttctggaagttgtacattcatcattttcacttatattctattggccaacaagttcatgcaaaggatgctgggaatttagtctttgttatgcttggccatatggccagtgaaaaactggggcaagaaaaaagtataaatagaggggactactagcagtttctgtcctatatgctttagcggatgcagggggaaaaaaatctaaggagaggaactgtagatatcttctttgaaggacatagaacctagtaattgctgagtctctaaagagacatgagttgtcattgtttaagttttaaagtatgtatgtgttttgggactgattggttttactaacaaagtgctacagaaagagtgtgttctccctggctgtgttaagaactctcactttctctctgagccttttagattttatgattcttcttgaagaccaggactggtaaacaaggtgttggaagaaattacagagagctgtggaatcaacagggtttttggaatcagttgtgtgagaggcaccaagagttcttacttggggagggaaaaacaaaggactatctcgtttctctttattgcttacaattctgatataataacttgatgaaaagtttttgaaatgtttattacttaatggtaaattctagcatattctataccaacttgtgtatgtatgcctttagaaacatatctagtagaattgctgggtcaaaggaaacttacaaattctgattgatagtggcaaattgccttctaaaatagttttaccattttacatactgagcacatttttacatttttactgtgaagactgatagaaaaagaaatgacacagcaaccttgtgtgttctaaaacattttttaaaaataaaatttccactagagggagaggtttagctatctgaaaattaaaaagtaatctaaatagtaaaaccctcaatttacagaatattgttgtaataaagttatattaatataatatttgaactaaacatgacctcaaatcatgttaatagaatgttagaacaaagtgatgacttatagtttgtctaggtcaaccctattattttataagtaaatggatccagagagtttgaatgattactcatgttggtgcagctattgttgtccaaggtggttgggacatagagctctgttggccagatttactttctggtgttcttagtactacatttgtgaagagttgtaaggccatcagaattaacgtttatcagccttccataatccaagcaatatagtcaattagattggtaggagtttgtggggaaagtggcaggttaagtatgtttccataacttctgtcccaatgaaatgaacaaaattattcaaaaaataagcaatttttttaaatggaagagaatacaattccattatcacaggctccaaagaaaatctgtttgatattaatgacatttgagtctaaacactgaaatccaatacagggtgcttcatgagagatttgtaagttttacaaagttaagctggccacattggctcacgcctataatctcagcactgagggaagccaaggcaggaggatagcttgagcccaggaattaaaggccagcctgggcaacatagcgagaccctgtctctaaaaaatatatatttttttaaataaaaaagaaattagccaggcttggttacttacatatatagtcctagccacttgggaggctgagacaggaggattgcttgagcccacaaattcaaggtcacaaagaactgtgattgaacgactgcattccagcctgggcaatagagcaaaaccctgtctcaaaaaaaaaaaaaaaaaaaaaaaaggaccaacttaatggcacccttttcctaaagatctctacccataatccttcagttgtagaggagaatgagaactgtgggcttaagtggaccatagtagaaaggaatgtggtactgagacacatgtaggggctttgaggtcagattgtttataaggtctcttcccttatttaccaactggggagaattgacctagttagcagtaccacaagcaggggagagatggaaagatggaaaaacaatattttgaagtcagcttttgagttgttaaacaggattctataacccaacaaaaaatttgtttttgcctatcctaatgggtgaaaagctgaaatctaacatgtatctacacatacttgaccaagagaccagatgtgctcctgagatttttgctttccttttcctttctttgcttttttttctggtaacagttctattgagatataattcacataccatataacttaccagtttaaagtgtacagttcaatactttttttaaagatgtaatttatttggaatccaagctttgtttcacaagtttattatttatttttattattattattgttattctttttgagactgagtctcgctctgttgcgcaggctgtagtgcagtggcacgatcttggctcgctgcaacctctgcctcctgtgctcaagcgattctcctgcctcagcctcccgagtagctgggattacaggcgcctgccacgacgcctagctaattttttgtatttttagtagagacggggtttcaccgtgttggtcaggatggtctccaactcctaacctcaggtgattcacccgcctctgcctcccaaagtgctggattacaggcgtgagccaccgcgcccggccagtctttgctcatcttataggtaaaaatggcatcttatcggccaggcgcggtggctcccgcctgtaatcccagcacttcaggaggcagagacggggggatcaggaggtcaagagattgagaccgcctggcacggtggctcacgcctgtaatcccagcactttgggaggctgaggcaggtggatcacgaggtcaggagatcgagaccattctggctaacacggtgaaaccccgtctctactaaaaaatacaaaaaaattagccaggcatggtggcgggcacctgtagtcccagctactcgggagactgaggcgggagaatggcgtgaacccgggaggcggagtttgcagtgagccgagatcgcgccaccacactccagcctgggcgacagagcgagactgtctcaaaacaaaaacaaaaacaaaacaaacgagattgagaccatcctggccgacatggtgaaaccccatctctactaaaaatacaaaaattagccgggcgtggtggtgggcacctgttgtcccagctccccagctttggggagaatgaggcagaagaatcgcttgaatccaggaggcggaggttgcggtgagccgagatcgcgccactgcactccagcctggtgacagagcaagactccgtctccaaaaaaaaaaaaaaaaggcatcttaccttattgttttaatttacaattattattagtgagattgaactttttttgtttttgttttgtttctgtcatgattactctttccttttatttggtggcatttcattttgcatatttcaaaagtatttttgtctttttgaagtttactgtgctttgatacagaaatttttatctttattttagaataaggagagattatcttctgctgttactgacctcaacataataatggagcccacagaatgctcagaattaagtgaatttgtgtctaggtaagctattttacaaacttacttttttagagaaaaaaagtaaatttacactttacagttttaagtttaccttttcctcttcttagtaagtaaataggtcttctctgaaagtataacaccactgttgtgcttatatttgagcccatattctctatatctatcattctttcatttagtttatatttattgcacattcactatgtgctgggtattaaaattaaaatgtgagcaaaaaaagacacaatcctcagtcctcatggaattgacagtctagtggagaagttagatattgatcaaataatggcagaagtaaatataaaattatggctatgttaaatgctacaaaggagagttacataatgctgttgaagtatatatcaggaatttttgttttttattatttttgtatttttttttaaattagagatggggtctcactatattgcccaggctgttctcaaactcctaggctcaagcagtcctcctgccttagcctcccaaagtgtttatcaggaatttgactagcagagagaacatgaaatcatttgctgaagcttgaactgacatctgaaaaatgagtaggtgtgaactaacaaagagggaataactttgctgagcactgtgccagcagggagcatggtgtctgtgagcaattgacacagggccacagtgacaggtggaggcaagagcctaggagaatggtgtaagatgaggttaggaaattaggtaaggtccatactactgggaattgggtataaagagtgttatcacagtcccaggaccaagtgaaactattgaaaagttttgagcagggcctgaggaaagcaaaagtgtggcatcctagaaagaattattctggatactatggggaaatggaatgaaggggtgcaatcattgatacaagtgagtcaatgactagtcttttaaaacagttcaggcaagagaagtttgtagtttggactgaaatgatgatacttagctagatggatttgggggataattaggaagcaaaaatgagtgggcatgggattgcttgagtaaaagggattagaggtcattcacaggggataactctttgattatggtggtcccgtctgctgttaagggaaggttggaagaggaccattgtcaggtgacattatgactttattttggacatatgggacttgagtgcctttgaaaacactgaaataaaaatgagaaagaggcagcacagtagaggtgggggtgggagatatagaacactggaattatcttctattgggtaggaattaaagccttgagcaggaatgagtttgcctatgaaggaatatagagtagaactagaaaaggccctagaactgagccttgaggaattctaaaatatactggctgaatagaagggaaggatcctgcaaaggaattagaaaaggaactgtttgagaggtagggagaataccaagaatgtgttgtgtcatggcagagatcacatatttccttttgttcagaccatagtttggaagtagcatctgctatttggaaattacaaaaggaagagtagtgagatatctctcttcctgtaataatgagcatattatagttacttaataaatatttaatcccagctttttgggcaattttttagactgggttcccattttgtggagagtgactggtattttagaaagggtgctgaacataggtcagaagacctggattttattccagattcaactacgtgtaagttacctctccttttggagtttctttcttctttatctctgctgttatgcaatttaaatgttatatgcctaattatgaatttatttttagtttttcattatagatctgtagtttttcagacaggattggtatctttaggttttgaaaaatttttagtcattattttattgactcttgcttctaccttgatcttcccttatcacagtctactttcactttaaatagtaagcatttcacatgtactataagaacaacagtatactttccatttattttccctcaaccattgtattattattttcatataattgtcatacacttttacatgttccaaatgtctcagggcattgttactatgtttgccttagactgtcaattattttttaaagcaattaaaaataagacaaaacttgttttgttttgttttgttttgagatggagtcttactcggtcacccaggctagagtggaatggcatgatcttggctcactgcaacctctgcctcccaagttcaggcaattctcctgcctcagcctcctgagtagctgggattgcaggcatccagccaccatgcccagctaattttctttctttctttctttcttttttttttttttttgtgcatttttggtagagacagggttttactacattggccaggctggtcttgaactcccgacctcaaatgatccacccaccacggcctcccaaagtgccaggattacaggcatgagccaccgtgcctggctgacaaaacgtgtttttgtatatttatcttcattttttcatttccaacattcttcatttctttatttcattcttcatttcatttgattcagatttctaactgctatgctccttcttccttaagaacttcctataacttttttttttttttttgagatggaatttcgctctttttgcccaggctggagtgcgatggcacaatctcagctcactgcaacctctgcctcccgggttcaagtaaatttcctgcctcagcctcccaagtagctgggactacaggtgtgtaccaccacacccggctaattttgtatttttagtagagacggggtttcaccatgttggtcaggctggtctcaaactcctgatctcaggtgatccacccgccttggcctcccaaagtgctgggaatacaggcgtgagccaccgcacctgaccctttaacatttcttactgtgcttgtctgttggccgtaatatctatcagcttttgtttctctggaaaggtcttaattttgccttcattttttgaaagatatttttgctggccatagaattctgagtagacaggtttaaagataaaaaacatatatctttaaacatactctttcataatctggattgcataggttgtgacaaaaagactgcgatgattgttatctttatttttctgtattagtgtgtcatgtgtgtgtgcttggggcagccttaaatctttctcttaattttgtgtttctgtagtttgtgctatgtttagggtatatttgtgtgaaaattatcaaccatgtcttttaaagtatttattttgccctgtgtcactctaatgacacatatgttagactatttgacatattgtcccagcatttggatgctctgttctatttctttcatgccttttttcctttgtgtttcagtttggataatttctattaacctatctgcaacttcgcagagtctttcctctgttgcagtactgtctgccagtgggcccatttaaggagttctttatgtcgcttgtaatgctttttatttcttgtgttttcatattcccttgtatgaatgtaccatagtttgtttattcatttacccattgaaggatatctgggttattttcagtttttggtgaatatagcatattatatatacttttttttttatttttttttttttgagacggagtctcgccctgtcaccaggctggagtgctgtagtatgatatcagctcgctgcaacctctgactccctggttcaagtgattctcctgcctcagcctcccgagtagctgggattataggcacgcaccaccacacccagctagtttttgtatttttaggagagatgtggtttcaccatgttggccaggatggtctcgatctcctgacctagtgatccgcccacctcagcctcccaaagtgctgggattacaggcgtgagccaccacgcctggcctatgtatacatttatgtagcatattatagtgtataatatagcatattatctttatatatgtttgtatgtatacacacacatacacatgcattcatgctgctacaaacattcatatgctataaatatgtatattacacacacaaacatacatgtatatgctgctgtgaacattcactagaggtttttgtgtgaatgtaagttttcttttctctagggtacataaccagaagtggaattgctgagtcgtataagagtatgtttaaatttataataaactgccaaaccgttttccagaatgaccatactgttttgtattcccaccagtaatgtgtgagaatgtctgttaatatttttgtgaattaatttctgatggtcacctaattttagatgtaatagtcccaggaatttattgttagaataaaattttggaatctttatcctaaatttctctttgtgttcgctttatacttgagaaggagacatttggagttatttttgtttcctgactactttagctgaaattgaaatgggttactgccaacattttatgaaagaaatccatgacatctgttttacgtttagtgaagtttggactttgcttaggaaaaatagataaattacagtcattcttacagctgtgagagccaacacccacacccacacacaaaatttctttctatatggaaaactcttatgtgctgtagtacagtatcctttatgaagatgcaaatggaagaataaaggaattgtgaattttttaaagttcattgtaaaagaacagtcttttcttctgtgtgtatgtgtttaaacttgagtcatcatagcttttaagattattttcatggcttactccctcatcacatgattaagagtttatttttttgctcacttgtttgatggagaacgaaatatcgtgtcactgtggcctttaagcgtgaatgaactaatttctcctctttgtaggcccatactttttggaaaacaatttttttcagatgtttaaataatttttaaaatagttattagactgacttttaacacataatctccagtgttccctataaactacatgcttatgcagctttgtgttaattcagctattattttatgttctttgttttcagtgaatctacttggtttttttgttcactattgcccaggctggtctcaaactcctaggctcaagcagtcctcttgccttagcctcccaaagtgtttatcaggaattagactagcacagagaacatgaaatcatttcctgaagcttgagctgacatctgaaaaatgagtaggtgtgaactaacacctactaacaccctttcttgccttcttttagattatttaacttgttttcctatttttttactgtggcaaaatacttacaaaatctaccaactcaaccatgttaaagagtacacttcaataatagtaaatacattcattatgttgtacaaccatcaccactatctgtcaacataactctttcctcttttaaaacagaaactttggccaggtgtggtggctcacgcctataatcccagcactttgggaggctgaggcgggtggatcatgaggtcaggagttcaaatccagcatggtgaaaccctgtctctactaaaaatacaaaaactagctgggcatggtggcacgtgactgtagtcccagctacttgggaggctgaggcaggagaatcgcttgaacctgggaggcggaggttgtggtgagccgagagcaccactacactccagcctgggtgacagagtgagactatctcaaaaaaaaaaaaaaaaaaccagaaactttgtacccataaacaataactcccacttcctccctctcctcatccaccattctactttttgtctgtgtgattttgattaatactatctaagtattaatctaagtacctcatataagtagaatcatacagtatttgccttttttctttagatggagtctcgctctgtcgcccaggcaggcgtgcagtggtgtgatctctgctcactgtaacctctacctcaccagggattctcctgcctcagcctcccaagtagctgggattacaggcacccgctaccatgcccagctaatttttatatttttagtagagaaggggttttgccatattggccaggctggtcttgaattcctgacctcaggtgatctagccatctcggcctcccaaagtgctgggattacaggcgtgagccactgtgcctggccagtatttgccttttttgactggtttatttcgctgagtgtaatgttgtcaaggttcatccatgtggcataagtcagaatttctttttctttttcttttccttttttttttttttttttaagcaccacacaagctttatttgcaccatctatataagatagtcctggccatgcacagtggctcatacctgcaatcccagcatgttgggaggccaaggtgggcacatcacctgaggtcaggagttagagacaagcctggcaaacatggagaaaccctgtctatactaaaaatacaaaaattagctgagtgtggtggtgggcgcctgtatccccagccactcgggaggctgaggcacgaaaatcgcttgaaccggggaggcggaggttgcagtgaaccaagattgtgccactgcactcctctgggtgacagagcaagacatcatctgaaaaaacaaaaccaaaaccaaaaaaaactaagatagttctgtgaatctgtcccattgagagaagacagggccttttctctcaagcctgttgcttaaagcctgtgtgtgtgtgtgtgtgtgtgtgtgtgtgtgtgtgtgtatacatatatatatatatatatatatatatataatataacggggagtttattaaatattaactcacatgatcacaaggtcccgtaataggccgtctgcaggctgaggagcaaggagagccagcctgagttccaaaactgaaaaacttggaattcagtgttcaaggacaggaagcatccaccacaggagaaaaatgtaggctgggaggctaggccagtctaaccttttcatgtgtttctgcctgctctatattcactggcagctgattagatagtgcccatccagattaagggtgagtctgccttctccagcccactgtctcaaatgttaatctcctttggcaataccctcacagacgcacccaggattaatactttgtatccttcaatccaatctagttgacacttagtattaaccatgacaagtccaccccttgtcaacttgaacccatacacatctcctaagatcatacataatcttcaaataaagacaataatagtcataattgtgcctaacatacaactatccttcataaaaccagaaactcaccaatccccaacccaaatactattacataaagttgataatacttaaatgctgatatgaagtcaataaatcatatgtcacatgataaaggaaaaaggaaataaaatgaaagtactttcttagtgcaagtgtatacatgcacaaacatatttttaacgaaagaagaaggaagtactcatgacaattacagtccccgtttctgcagctggtcatgtggtcatagctggtactgatgactcccttcttttactacccattatgtattccctttgcgttcagcaagcacctcagggggtcgtgtttttttcctgatggagcgacccaaaccttcattcctgaaggatctgggccatttgtagtcctgtttggattgggctgtcgtagtttcccattaaccttacttacagggcttggtaatactaagagaagccgtaatgaatctctgctattccatgcatattcttccttacctccattgtgaagtagtagaatgatttcatcttgatagtctgggtcagtcatcccagccaacactgtaactcccttcttagcctgttgacttaaatgtaggaggagcccaaagtgtccaggtggcaatcttaacttccagtttaatgagatctttgttgtgtctcctggaggcagcgttcctccctctggaactaagacctctaggccagcagaatgtaatgtcgcaggaacaggaagcaaaaattttgccagtagatcactaggggtgttggtgagtggtgccacttcaacttccaccccttgattcctggacccatgaatcttggctatggaagaaacagtaccatatattggatgctgattcagagcatacatggccttctggagagatttgccccagctttgcaaagtattgtcacctagttagcattgtaattgtgacttcaaaaggccattctactgttctgtcaatccagctgcttcaggatgattgggaacatggtaagaccagtgaattccatgagcatgagcccactgctgcacttctttagccgtaaagtgagtgccttcatcagaggcaatgctgtatggcatactgtgatggtggataaggcattctgtgagtccacgatggtagtcttggcagaagcattgcatgcagtataggcaaacccatatccggagtaagtgtctattccagtgaggacaaacctctgccctttccattatggaataggcccaatataatcaacctgccaccaggtagctagctgatcaccccaagaaatggtgccatatcgggggtcagtgttgatccctgctgctggcaaattggccttgtcagacgtggtgagtggaagtccttgttgctgagccatgcgtaacctccatccctgccaccatggccactttactttgttcatgggcccattgagcaatgataggggtggctggggaaagaggctgagtgatggattatcctatcccttgattatccatcctatccacttaaaaatgctaaaggaaggggtctcactctgttgcccaggctggtcttgaactcctggactcttgctatcctcctgccttgtcctcccaaagttctgggattataggcatgagccaccacacatgtccttgcaatttcattttatgccactttaacttaaaaaaagtttaaaagacctgtgtttctttagagctctgtcccctattgggggaacccacccccaatatttcagcataggttctttctattttccataagtgtcggctggctgagaaataaagagaaagagtaaaaagagaggaattttacagctgggccgctgggggtgacgtcacatatcagtaggaccgtgatgcctgcctgagtctcagaccagcaagtttttattaagggtttcaaaaggggagggggtataagaacagggagtaggtacaaagatcacatgcttccaagggcaaaaagcagaactactaataagggtccaacaaagatcacaaggcaaagggcaaaagcagaactactgataagggtccatgttcagcggtgcacatattgtcttgataaacatcttaaacaacagaaaacagggtttgagagcagagaaccggtctggccacaaatttaccagggcggagtttttccccaccctagtaagcctgtgagggtactgcaggagaccagggcgtatctcagtccttatctcaactgcataagacagacattcccagagtggctgtttatagacctccccccaggaatgcattcctttcccagggtattaacattaatattccttgctaggaaaagaatttagcgatatctctcctacttgcatgtctgtttttttttttcttcaagtaattcagccactactttaataccacactctacataaaacaaacacattaaatgccaagctggcagagcctcccagtatgcactacagctgcaaaaataatgacatggaaggtttctttttgaaggttgaattatttgagagaaaatcaaaccatttcttttagaccaatctagctgaacaaataagacttctgtaaagattaaggagtctatagcacaagaaatgcagcatattcatttgctatagcttctactcttcgaattttacactggagacctaaaaaaagaatagcttaagtctaaaatagcccattatgagacatttcatatgcataaattctcaatatttcataaatactgtaactaccaaaaaatcattcatgccttagatttagcaaatggacccttgtggaacattgcatttctcaacctgagcaaacataagttaaatatttataaaacaaaatatactgaaactatttcaattcttgtaggggtagaatagacactttaaaggaatcagcctgaacttaggagtcttctgtgtattaatagtgaatatgcatatgcaaaaactctacagaaatattaaaattgatagagtttctaaattttcatatcatatcagaatatataaacacaggggttagtcaactattttactaactgattgatattgtcagtcagtattgattagtttggtatttaaaaatatatggaagtaaactaaaaataactactgcttagaaaacctcagctgatatgtggaaggattagataattggaacactacagaaaggagcaaaatgaagagtagaattctctgtcactcaactaaccccatctctttctccaaaggcagccactattcaattttacttctgtttccttctggaaagggtgagaaaaagatttattaatgtagcaacaacttgcacatctgtttataggctctctgcaagaagaaaaatatggctctttttgcccgaccccacaggcagtcagaccttatggttgtcttcccctgttccctgaaaatcgctgctattctgttctttttcaaggtgcactgatttcatattgttcaaacacacatgttttacaatcaattagtacagttaacacagttgtcacagtggtcctgaggtgtcgtacatcctcagcttatgaagataacaggattaagagattgaagtaaagacaggcataagaaattataaaagtattatttgggaactgataaatgtccatatcaaaatgaaatcttcacaatttatgttcagagattaaagacaggtgtaagaaattataaaagtattgtttgggaactgataaatgtccatattaaaatgaaatcttcacaatttatgttcagagattaaagacaggtgtaagaaattataaaagtattatttgggaactgataaatgtccattttaaaatgaaatcttcacaatttatgttcctctgccgcagctccagctggtccctccgttcggggtccctgacttcccacaacagtccccagccttttgaattattgatgttacgaacttgtatatttatatgttgtgcaccccaaaatgtaaactaataattctttaaaatgcattagttttttaaattacatagaaaataatgtggagtcacaaatgaaaattacattaatactagcttttagtctaatttttaaaaaatgtattagtctgtaaaatcatgtaggaaacaaaaagtagagtaacaaactattgttgcaaaaatactagcttttataatttcacatgtatttacctttattgagtctttttttttgtttttttaaactttttacttcttttgcctttttccatatgttctaagagtctatttcttaatatgtcttcaggttactgtctagtgtcctttctttcactctacagaattctcttgaccatttcttacagagaaagtttaatgataaccaactccctcaacttttgtttgcctgagaatgtcttaatttctcctgcactttttttattttttgttttatttttcttttctccagccacatccctttgatcatctccctcattattattattattattattattattattattttgagatggaatttcactcttgttgcccaggctggagttcaatggcgcgatctcagctcaccgcaacctctgcctcccgggttcaggtgattctcctgccacggcctcccaagtagctgggattacaggcatgcgccaccactcctggctcattttttttgtatttttattagagatggtgtttctccatgttggttaggcttatctccgattcccgacctcaggtgatcctgccttggcctctgaaagtagtgggattacaggtgtgagccaccgcacccggccactatctccctcactttttaaggacagttttgcagaatagaaaattcttggttgacagatttttttttttcttttagcactttgaatatatgacctcactgacttctggcctccatactttctgatgaaaaatctgctgatcattttattgaacatcccttgtatgtgaccagtctcttttctcttgctgctttcaagatattctctctttgtctttgtcttttgacagcttgattataatgtttctctatgtggatctcttagttcatcttggagttctttgagtctcttggatgttttatattcatatctttcatcaaatttgggatgttttaacactttattctgtctgcttcttcctctctttttttttttttctgagactcctacagtgcagaagttggtagtttgttctcttgacatgtccccatgtcccacagtttccttacattctttttttttctttttaatggagtttccctctgtcacccaggctagagtacagtggcgcaatctcagctcactgcaacctccacctcataggttcaagcaattctcctgcctcagcctcccgagtagctgggattacaggtgcctgctgccacattcagctaattttttgtatttttagtagagatggggtttcaccatgttggtgtggctggtcttgaactcctgacctcaagtgatccacccaccttggcctcccaaagtgctaggattacaggcatgagccaccacgctcagctagtttccttacattctgttcacttttcctcattcttttttctttttatttctcagacttgacaatttctattgtcctatctccaggtttggtgatttttctttctgcctactcaaatctgcctttgaattcctgtagtgaatttttcattttaattattgtacttttcacttccagaatttcttttggttttcttttaggtttctttctttgtattgatatttctattgtgttcctgtatcattttcttaactttctccagatctttctttagcatttttaagatggtggttgtaaagtctgtatggtagatctaccatcagattttttttcagggatgctgtctattcatttattttttttcatttcacgaggccattcttttgtatctctttttttttctttctttcttttttttttttttgagatggagtttcgctcttgttgcccaggctggagtgtaatggcatgatctgggtgcactgcaacctctgcctcccaggttcaagcgattctcctgcctcagcctcccaagtagctaggattaaaggcatgtgccaccacacccagctaattttgtatttttagtagagagggggttttgccatgttggtcaggctggtcttgaactcccggcctcaggtgatccgcctgccttggcctttcaaagtgttgggattacaggcatgagccaccgtgcccagccttcttttatatttctttgtatcccttgtgttttgttgttattgttgttgaaaagggctcatttgaacctaataatgtggtaacccccaaagtcagattctccctcttccccagggtttacaggcttgttattgttattatttattttatttatttatttattcatatttttgtaggccatctctgtgccagggattaacctgaggtataaacttaaggtcttctcagtttgtttctgggcttgaagctttccatgggtatgtgcaatctcttacagaatctccccttatatgcagttatttgtcaatgtcctagtcttgattgttcggctcttagaaaggggaaatgaagaaaatgaaggtgggaaaaaaggagctctggccttttaagtcccctggaaatcacttcaactggaggaagcagggttttcaaaagtgtggggatgtgtaactacaatggctgcctgactctttgtctacacttctgtgataagaagccgcagtgaacaaaacacagatcctttatggctggaggacagggtcctttttttttttttgcttgctctggcttctataagctgtgtgtaagctgctctggttatactcacatgactgcctgccaggggggtgggggtgaagaaatgggtagctgctgctatactaagagctgaaatttgctaaaattaatcacaatttaccatccaagcccttctccaagcctttgcctggatgttgccagccttcattagactcagagtttccaaatggttatatcaaacagattctgccagtgaaattgttatataagtggagagatggaattctggtacttcctattctgtcatcttctcaaaaccctctcctttaaatatattttaatattctcttttaatttatttcattcacgttttggctatatttgtattattttttattggctgctgtggggattataacatacgtaacctaacttttaacagtctatttagatttgatactttaccactgcagttatagtcttgtggtcctataaccacatggatcacttccccttcctgcttcatgtggtagttttcatgtgaattatattcacatgtatgtgctgaaaaactccattagtccagtctgagcaacaaaggaagaccctatctctacaaaaacaacaacaaaattagcttattgtagtggggtgcactcgtagtcccagctacttggtaggctgaggtaggagaattacttgagcccaggagttcgacagtgcagtgagctgtgattatgctattgcactttagcctgggagactgagaccctgtctcaaaatataataatgataataataaaactccattagataacattataatgttttacttcaactgtcatacatactttaaataacttaagaaaaggctaatagtttgtcatatttctccagatttttattttttatttttatttatttattattattattttttgagatggagtcttgctgtcgcccaggctggagtgcaatggcgtaatctcagctcactgcaagctctgcctcctgggttcacaccattcttctgcctcagcctcccgagtagctgggactacaggcgcccaccaccacacccggctaattatttttgtattttttagtagagacagggtttcactgtgttagccaggatagtctcgatctcctgacctcgtgatccgcccgcctcggcctcccaaagtgctgggattacaggcgtgagcccccgcccccggccatatttatctagatttttaatgtttctgctgctgttcttgatatggagcctttttaggacatgttgcatgtatcatggctcatttcccataaatacttaagtgtgtatttttattattttactttatttatttatttatttatttatttattgagatggagtcacactctgttgcccaggctggagtgcagtggcaagatcttggttcactgcaacctctgcctcccaggctcaagtgattctccagcctcagcctccctagtagctgggactacaggcacatgccaccacatctggctaatttttgtattgttagcagagacggggtttcgccgtattggccaggctggtctcgaacccctgacctcaagtgatccatgcacctcagcctcccaaagtgttgggattacaggcatgagccaccgtacctggccttattttattttattttattttattttattttattttattttattttattttattttgagatggagtcttgctctgtcacccaggctggagtgcagtggcacaatcttggctcactgcaacctccgctccccaggttcaagtgattctcctgcctcagcctcctgagtagctaggattgcaggcatgcaccaccacgcacagctaatttttttgtatttttagtagagatggggtttcaccatgctggccaggctggtctcgaactcctgacctcaagtgatccgcccaccttggtctcccaaagtgctgggattacaggcatgagccactgcacccggctcaaatgtgcagttttaagtttagagatattcccttatataattacagtgcagtgatcaacttcataaattgacattgatatgatacttttatctaatatgctttccatatgccagttttcttagttgatctcataatatcttacattgcattttctttctccttgaacctggggagtggaggttgcagtgagctgacattgtgccactgcactccagcctgggtgacagagcaagactccatcataaaataaaataagataagataagataaaataaattcaagtattgcatttagttgtcatgtctctttagtttcctttaatctggagttattccctagcctttctttgccatgtttcactttgtcatctttttaaaaagctcttcctgcaaccatcctgagcaacagagcaaggctctatctcttcaaaaagttaaaaaaaaaaaattagcctggcatagtggtgcatgcctatagttctagctacctgaggggctgaggcaagagtatcatttgagactgcagtgagctatgatcaagctactgcattccagcctgggccacagggcaagatttgtctctaaaaaaaaagttctttccacttttttgtttgtttctttttctttctacttttttcccccaatagaatgtttcttattttgtctttgatcatctattgtgatcagttgatgctatgccttcttaggcaaattctgcatagatgatattttgtccttctcagcatagctgtccctcataggtgatattaagtttttcactcaatgaaactgttgtatttctccactatatgataactaattttttctcctttggctccaatatgcaatctgtggggacagacttgatgaccacacaattactactctttattaatatttcttcctcaatttagcatctatgattattcctaccttatctactctctactatgatgtttgcaaaatgatgatttttcaactctagcacttcctccacatttctcagtaggcatttggcattatgcttaagaaatagatcaccattctctatgtatgtatatgtatccatatttataatatgtatggattcattcatttcttttttttccaacgatttataatttcttaatcttattttggtgctcaaagtgtcccggatttgatcagagggaatctctttaagccggctcctgaatccatgtgttaattccttattatatttttgagcacttcctcatattctgtcattaaaagattttccaggctcacaatatacctgtcctgccctaggtgtagattcagcaatttatctgaggaaccagagtttctttttgtgggaaatggcattagagactgagatctgacactaggtctgttcattgctattggagtgtctttgcttcttggttctttcaacaaacagtactaggaaatatgtatttatacatatatacacacacacacacacacaaacctgtatgtaagaaatcatgattcatataatattcatgtgcacaaatagtcatgtgccgcataactactttttgatcagtgacagactgcatatacaaaggtagtctcatgattacattactgtattttactgtacctttcctatgtttagatatgttaaatgcacaaatacttaacattgttttacaattgcctacagtatttagtatagtaatgctgtataggtttatagcctaggagcaataggccataccatatagcctcggtttgcagtaggctgtaccatttaggtttaagtacactgtatgatgttcctatagtgaataaatcatctgacaatgcatttatcagaatgtatccctgttgttaagctacacatgactataaatatttacaaaattatgagtgtacaccaaggcctccagttctactctagcttatccccagtttatagtatgtatgtgtttatgtgtctatatacatactatcatttcacatttctatgtcctttcttccatattgagaaacttggctcctagaaatatcaacaaagttattcatttgctcaatcctattgggttttttttttgttttgtttttgttttttttgagatgaggtgtcactctgttgcccaggctggagtgcagtggtgcaaacccggctcactgcaacctccacctctcaggctcaagtggtcctcccacctcagcctcctgaatagctggaaccacaggcatgcaccaccatgcccagctaattttttgtatttttggtagagatgggtttttgccatgttgcccaggctggtcttgaactcctgggttcaggtgatccatccactttggcatcccaaagtgctgggattataggcatgagccactgtactcagccaatcctgttgtttcttgtagtgaaggcctgctttttttttttcaattagaaaaaaaaatttttttagaaatgggggtctcactatgtgacccaggctggtctcacactcctgggctcaagcagtcatcctgccttggcctcccaaagtgctgggattacagatgtgagccactgtgcctggcctaatattctgcttttaatggaatttttagctttttctatgattttggtcttaaaagtctttatttcatttttggttttgaaagatatcattctgggtatagaatccttggttgactgttttggttctttgggttttttctcctgagtactttggaggcatttgtctgttgtcttatggcttaacagtaaatttgctgtgattcttctttatgttcccctgtgtgtatggaactggttgttgtgttggatacacaactctattcatttggccaaaatcataaaattaagaaaaagagtgaattttactgtatgtaaattcttaaataaataaatacatatatgttaaaagcatattatgtactttgcattgtattagtctctaagaatacaatgatgaacaagataattttcagttttatgaagcttacaacctagtgtatgcacaaaaccaatgatacatggtaattgatggtagagtacatgctataggaatataaatgcatacaatgtctactctaggggagagggagggatagtattagccccaggtaacctaggagagtgccttgtacatggttggtgttcaaacagttcttgagtgaattgtctaacaaaccacttgaaaatataagacctgaagttaagcagagattagacagacaagtcgctagtgttccttcatttatccagcagttacgtgttgcctgttctgcagccaagcattgtcgttgtgcttaatatgtagcagtgaacaaaagaaaagcccgtcttcataaactcaagagatttattttctagtaggggaaacaggcaataaacaaaacagatatgtaaaataaataatatattagatatcgataagtggtggggagaaaataaacaaggatgggctgcacaggaggagggaaggtatgcatttttaaatagcttgactggggaaggcctcattgagaatgtgacctaggagtacatggaggaggttgcctggcctaatcatatcagtttgttatcaaccctaggtactctctaaaaatgtatcaatgtatcaaattatgccttgtattataactactctttttttttttttttttttttgagacagagtctcgtgctctcactcacgctggagttcaggggcatgatcttggctcactacaacctccacctcctgggttcaagcgattctcctgcctcagcctcctgagcagctgggattacaggcatccaccaccacgccctgctaatttttgtattcttagtagagatggggtttcaccacgttggccaggttggtctcgaattcatgaccttaggtgatccacccgtctcggcctcacaaagtgctgggattataggcgtgagccactgtgcccagcctataactattcttatcctcatgtaaattataaatttgtgataataaggacaatgtacctttatgtatttcatttctttcttttttttttcttaaactaatgactaacagcattgaattagaaaaggtgtttaatctctgtggagttatctgcaaaatgaaagaactggaaataattatttccagggttcgctgggcatggtggctcacgcctgtaatcccagcactttgggaggccaaggcgggcggatcacgaggtcaggagatcgagaccatcctggctaacatggtgaaaccccgtctctactaaaaattcaaaaaattagccaggcgcggtggcgggcacctgtagtcccagctactcagtaggctgaggcaggagaatggtgtgaacctgggaggcggagctggcagtgagccaagacggcgccactgcactccagcctgggtgacagtaagactccgtctcaaaaaaaaaaaaaaaaaaaaagaattatttccagggttctgtcccattctaaaaacttatatatttatgaattgaagaataaaatatatctgagaaatgatggaatttactggaattggaatgatagagctgtagaagaacatccacaacttagatctcttctttataacatgagatgattaccaatacttggggaatccttctcagtgaaaccagatatacaaaacactgtttctttgggccaccctctagacataaaattacttcattttacagattgtttattgtttggtattacttgtggcacagattcctaaactcctttagtaagtatatgtgcccaccactatttacagatcactcaactgatctagttaaagtcctcagtaatgaattttatgtgccagatgctttcttcagtatttgtggtctttttctttttaaaaaggcattatttttaaaataaaacacagaaaagtataaaaagttatacctggaagggatttgggaagaaattattcctctgattaatcattgtacaggtaagctgaatgattattacacacacatgctcattttttcaaacatctgaggctgttttgaggatattgtttgagaggatcacgattcagttagttcagtactgacttccccaagagctctcatggagttactgcaggttgaacatccataatctgaaatccaaactgctctaaaatctgaaattttttgattgccgacatgattccttaagtggaaaattccacacctgacttgcgtttgcagtcaaaacgcaggtgtacaacacagttcattcaacatcctcaagggaaaaagaccctccctgctcccttcagctgcggtagcagcacacattcataacagaacaagaaatcatatcagattctaaaatcaaagctagattaataagacaaaagttgttgttaatgaggcagataactgtggaggaaacgtttattttatttttatgtattcatttattttttgagacagagtctcactctgtctcccaggctggagtgcagtggcacaatctcggctcactacaacctccacctctcgggttcaagcaattctcctgcctcagcctcccgagtagctggaattacaggggcacgccaccacacccagctaatttttgtatttttagtagagacagggttttgccatgttgggcaggctggtctcgaactcttggtcttaggtgatctgtccacctcagcctcgcagagttctgggattacaggcgtgagccaccatgcctggcctttggaggaaacatttaaaaatggttctacaggagccatccagcagaatgcctccttatccctagagaacccatttcttggtcccacaactgtttcttatgtttcttctcacctaaaaaaataaaatacagtatacagtaacattttattttattttatttattttttgagatggagtttcactcttgttgctcaggctgtagtgcaatggtgcgatctcggctcactgcaacctccgcctcctgggttcaagcgattcttctgcctcagcctccagagtagctgggattacaggtgcccgccatcacgcccagctagtttttgtatttttagtagagatggggtttcaccacattggacagtctgttcaaactcctgacctcaggcgattcacccgccttagccgcccaaagcactgggattgcaggcgtgagacagcgcacctggcctatagtaacattttaatcaaaacacagcatcataggtggagactgaaagcctaccattgttagttgttgctttttttaaaaagctggtaactggtattttggtgatactacactgcatacattattttttcactatttaatggcatgtcatgttttttactgttaagttcttatgtgtgaataagttaagaaaattattgcttattggtatcataaattcagaatcaggaatgatgatgatgctatatagccatagatcatctacatgggtggctgagatagtgacatctttgttttctcatggatcattgtgcacaaactttgtttcacacacaaaattatttaaaatattgtataaaattaccttcaagacctggacactgtccccaagatatctcattatatacatgcaaatattccaaaatctgaaaaaaattcaaaatctgaaacgcttctggtaccaatcatttttggataagggatactcagcctgtattctagcttccaataattttatcaaagttagcttcaaagcagcttcatggggccgtttattcaatgatcaagagctacaccaaattaatcaccttcataaaaatataactatagctgctgtgaagaacaatttcatgaggtctctctgggaagcagtcccaatgagttcatcgtctgttacagaaccttttgagtgaccaaatatggagaaactaaatctcacctctggtatttatatattgtggatagtttttttggctactgacgggaatcagcagcttatatttgacatatatctgtgttcatatgcactgcatgattaatatttaaaagttaagaataaatggctcagatgcagtggttcatgcctgtaatcctaatggtttgggagactgagatgggaggatcgcttgagcccaggagttcatgaccagtgttggcaacatagtgagaccctgtctctacaaaaaaagaaattgaaaaacattttccaggtctgcctgcctgcctgtagttatagctgctcaggagactgacatgggagggtctcttgagctcaggagctccaggttacagtgagttacgatcatgccactgcactccaggctaggtgacagagcaacacactatctctaaaaataaataaatgggagcctattgtaatagcttttattattactaacaactaataatatagtgaggctaacagatgaagagacaattgccattaaaaatgtagttacagttcacaagagggagaggcacaccacaccataggggccacatgaggagcactggggtcagtcaagagacaaataggagaggggaaatctatgggcaagagcttttattgtggtctccgtgggaaggaatggttgaggcagtgtaagccggcttaagcttggcttgtttgaataatttcagtgagctctgggtcagaggacctgtccctagttaactctcttgtatctggccctggggtgattacagcaggtggatagtggagagaactggtaaagagagaacctggtaaaggaggtggttggaggtgtggattctgggttggttgttttgcatttgaaaaactcactcaagggcaaattgttgattatctctagagattggctaggattgcactgaattggtagattgctttagacaatatggtcattttaacagtattaattcttcaaagcaatgagcatgggatgtgcatgagatggcacatttgttattggtgtataaaaacactactgatttttgtacattgattttgtcccgcaacttaactaaattcatttatcaaatctaagagtttcttggtagagtctgggtttttctagatataagatcatttaagcaaaaagatacaatttcaccttgctcttttccaattgggatgccttttatttctttcctttgcctgattgctctggctaggacttctggtcatatgttgaataggagtgatagaagtcttattctagtttctagaggaaaggctttcaactttcccctgttcagtatgatgttaccttgggttttttatatgtagcctgtattattttgaggtatgtgccctccatgcttagtttgttgagtgtttgaatcctgggaggatgttgaattttatcaaatgctttttctgcatcaattgagattatatgtttttttccctatatcttgtagatatgatatattacatttattgatttgtatatgttgaatcatccttgcatccttggtataaattacatctgatcatggtatattatctttctcatgtgcttaaaagggtttggtttgctagttactttgttgaagattttgcatctgtgttcatcaggaatatgggcctctagttttcttatgtatgtgtgtgtccttaacttgttttagtatcagggtaatgctggcctcttgtagtgagttagggagaattccctcctctttgatgatttaggaatagtttcaggaggataaatattagttcttctatgtatgtttgatagaatacggctgttactccttctggtcctggtcttttctatgttagactttttattgtttttttgttgtttttttgagatggagtctcagtctgtctcccaggctggagtgcagtagtggcatgatcttggctcactgcaacctccgctttccgggttcaagcgattctcctgcctcagcctcccaagtagctgggaacacagtggcgcatcaccattcccggctaatttttgtatttttttgtagagatgtgctttcaccatgttggccaagctggtcttgaactcctgtcctcaggtgatccacctgcctcagcctgccaaagtgctgggatcacaggcgtgagccaccacacccaacctagacttcttgttgattcaatctcactactcattatgttcaagttttctatttatttctgattcaatcttggtatgttgtatgtttccatttcctctaggttttacagcttgtccttataagttgttgataatagtctctcatcttttttatttctgtggtctcatttgtattgtctccattttcatttaaattgtttgggtcttctcttttcttggttagtctagctagtggtttgtcaattttgtttatcttttcaaataaccaacgttttgttttgttggtcctttgcattatttatttgcttatttattttttgactatctatttcatttagttctgctttgatcttttgaaattcttttcttctgctaattttctgtttggtttgttgttgctttgttccttgaggtacattgttagatttatagtttataactttttaccttctggatgtcagcatttattgctataaatttccctcctagcaccatttttgctgtatctcactgattttgctatggtgtgtttccatttttacttatttcaaggaatttttttatttctatcttaattgttttgttgacccagtgatcattcaggaacatgttgtttaatttccatgtatgtgtatagcttccagggttccttttggtgttgatttctagttgtattccagtgtgttctgagaagacacatgctatgattttgatttttaaaaatgttgagacttgttttgtgtcctaacatgtggtctgtcctgtagaacgttctacgttctgatgaaaagaatgtacattctgcagttgttggatagcatgttctgtaaatgtctgttaggtccatttggtctaaagtccaatttaaatccaatgttttttgtttgtttattatctgtctaatgctgtgaacggagtgttgatgtcccccattattattgtattgcaatctagttctctctttatatttggtaatatttgctttatgaatctggatgcttctatattgggtgtatatatatatttagaattgttacatgttttttctgaaatgactcctttatcattatataatgacctatttgttgttgtttttttttttttgagacggagtctctctctgttgcccaggctggagtgcagtagctcaatcctggctcactgcaagcttcacctcccggggtcaagtgattctcctgcctcagcttcccgagactcgtgccactgtactccagcctgggcaacagagtgagactccatctaaaaaaaaaaaaaaaaaaagtgctgggattacaggtgtaagccaccatgccagccatcttttttttttttttttttttttttttttttttaactgttcttgacttaaagttcattttagctgatataagtatagccaccacttgcttttggattttgtttgcatgggatatctttttccatccctttaattgcagtctatatttgtctttagtgttaaagtgagtttcttgtaagcagtgtctaggtggataatatgtttgaatccattcaacctttctatatcttttaagaagagaatttaatctgtttatgttccagtttattattgatatatgaggctttgttcctgtcatactgttgttttctgttgttttatatattctttgttcctgtctttttctcttacagtttgtcattgtgatttggtagatttttgtagtggtactgtttgaattattttcttgctttgtatgttttctttaccagtgagttttacactttcatgtgatttcatgatggtaaatgtcatcctttcgcctccaagtttaggacttccttgagcatttcttctagggatggtcttgtggtaatgaattcttttagcatttgtgttgggatgactttatttctctttcatttatgaatgagaatttagttgactacatttggttgccagttattttcttcacacactgaatatatcattccattctcttctggcctgtgagttttctcctgagaaatccactgttagtctgattgaggttttttctttttctttttttttttgataggtgactagactcctttctcttgctgtttataggatttgctctttaaatatgactttagacagtctgattgtaatgtgctgtgaggaagatctttttgcattgcatttgctttgaggtcgttgaacattttgtttctgaatgtctaaatctcttgatagacttgggaagttttcatctgttattttattaaataagtttcctaatcctttctttgtttatttgcccttgagtatactgctaatttgtaaatttggtcacttcatgttgtcccaaatgtcacaaagccttttttgttttttaatttggccatgcacagtagctcatgcctgtaatcctaacactttgggaggctgagatgggaggatggcttgaggctaggagtttgaaaccagcctctttaacatagtgagaccccatgtctttttatttaaaaatatatatatatattaacgactgggctataccaacatacctgttttcaggttttgagattctttcttctgcctgatctggtttattgttgaagctttcaaatgtattttatatttccttcagtgatttcttcagttccagaatttgttttgttcttttaaaaataccaatctctttgataaatttatcattcatatcctgaattattttcctgattgtattgtttttctgaattctcttgtatctcactgagcttctttaaaaattaatgttttgaggccaggcatggtggctcacgcctgtaaccccagcactttgggagcccgaggtgggcggatcatgaggtcaagagatcaagaccatcctggccaacatgatgaaacaccgtctctactaaaaatacaaaatttagctgggcgtggtggtgcgtgcctgtactcccagctactcgggaggctgaggcaagagaatcacttgaacccaggaggcggaggttgcagtgagccgagatcattccactgcactccagcctggtgacagagtaagactccatctcaaaaaagaaaaaaatcaatgttttgaattctttatctgagatttctgaaatttctttttgactgtctattgctaaataattattgggtttctttgtaggtgtcctgttttcttgcttttcatgtacctgttcccttatgttgatatctgcacatacactgtagcaggcacttcttttttggcatttgcttttgtaagggaggacttttttcctgaaaatgtatctatggtgctggcttggtctacccccagttgctggattgctactggcttgctttcctgttccagcagtgaccaaaaaaaaaaaaaaaaaaaaattattctgccaatctctgccatttgatggtgagtttaatccatttacatttaaaccaattcctgataaggaaatatttacttctgctgttttgctgtttgctgtgtgtgtgtgtgtgtgtgtgtgtgtgtgtgtgtgtgtgtatgtgaacccctcctgggttcaagtgattctcctgtctcagcctcccaagcagctgggattacaggcatgtgccaccacacccagctaatttttgtatttctagtagagacggaggtttctccatgttggtcaggctggtctcgaactcccaaactcaggtgatccgcccacctcggcctcccaatctttagttattttcttactggttaccttgagaattacaggtaatatcttaaacttataacaacctaggttaaattaatactaaactagattggcattaataatacctttaataatttgcaaaaactctgcttcttatatctatgtttctcccccttatattgtgattgtcacagattgcatctttctacattgtttggccattaacatagattagtaatttttgttttatgcatttgtctttaaatcatatgggaaaaagagggcttattaataaaaatacagtgatactttcttcattatttacctatgtaaccattgttcattatttctatatatggttttcagttactgtccagtgttttttccttttagcctgaagaattcccatgagcatttttttgtaggtcaagtctacaagtaacagacctcagctttcttgaatcagggaatgtcttaatttctattgcatttgtgagagagagttttgctggatatcagtctcaggattctctctctttggagctcaacagatttactataatgtgtcttgatgtggatctctttgagtttatcctatttgcagtttatgcacttcttggatgtgtatattaactttttcatccagagggatttgactgttatttctcaagatataatttcagctcccttttttttcaactttccttctttgactttcattatgtatatgttagtacttttttgggtgtcccacaagtctcttaggctccgtttatttttcttcattcttttttctttctctttcttagactggataatttcacttgacctatattcatttttactgattcttttttttttggagagggagactcactctattgcccaggctggagcgcagtgccgcaatctcagttcgctgcaacctctgcctcctgggttcaagggattctcctgcctcagcctcctgagtagctgggattacaggcacacaccaccacgcccggctaatttttgtggtttttttttaatagagatggggtttcaccacattagctaggctggtctcaaactcctgaccttgagatccgcccacctcggcctcccaaagtgctgggattacaggcgtgagccaccgcgcccggccatttttactgattcttatgcccactcaaatctgctgttgagcccctttagtgaatttttaatttcatttgttgtacttttcagttctaaaatttctatttcttttaaaaaaatttctctctttattgccatttcctgtttgttgcatactttgttctcttgattttcttgagttctctaaacatatttaagacagttgatttaaaatcatagcctagtaattcccctagtcattcaacaggagaagtttctgttaatttctttttttttttttcctatgactgggccatattttcttgtttctttgcatgcttagttttttgttattgtcattaaatactgtacattttgaatattatgatgggcaaaaaggaaaaaaataagaaaaaaagatatcttctccaggtctgtgcattttggttctgtatggggacactacttcagtgcttagccaggtctttcacaaccctgccttagtcctgtccttagcctagagattagccagaggttgaagttatgctcccctcagatctcttctaagcatgcattctgccctgagcattcaagtggctttctagttccctggtatacttgagcactttttccaagactttattccccaaagattctcattccctaccttttctttccttggctttcagcatatctgttgtttgtctcaactgtgcttttgccctacacagcagcaacttgttaatttgccttttagtatttttgaaaaacatcccctgtgtagctatgtcttcatggtgaagcagcattgttgtctggggtaatacccaaggttcattgtcccacagccacggaaaaccaggacatgaacacaccactgtgaggttaagagtggatatttaataggtgaaagaaggagaggagctgtctgcacagagaggggtcccagagaaaatgggttgccgcttccacagtcaaatgcaggttttacagatgagcttgaggaggcagtgtctgatttacatagggcacaaaaaattggtcagaccaggtgtaccgcttgcataggatgtgaagaagctggccgccccaccctaatcttttattatgcagatgggttctctactgggccagcgccatgttgcctgcttttttactgtacacgtggtgacaaagaaaagggaagatggagaccaggtgcagtggctcacgcctgtaatcccagcactttgggaggccaaggtgggcagatcacctgaggtcaggagttcgagaccagcctggccaatatggtgaaaccctgtctgtactaaaaatacacaaaaaaattagccaggcatcatggcgcacgcctgtaatcccagctgcttgggaggctgaggcgggagaatcacttgaacccaggaagcggaggttttggtgagccgagattgcaccactgcactccagagtgagacttagtctcaaaaaaaaaaaaagaaagaaaagggaagatggagcctccatgtttaacatacttggcttccaggtatcccttttctattgcagagcatttacctgtgcaaacttctagcttgcttatctatgtttgcagctctatttttcaggctgctctttgttagaaaagaaatgatttgggggctgctttttattaaaagggaagcctttctgagggctccttaaccctcactatctacctaaataatttctttctagctcctgtatcaattgcaagaaagttctgacttagctgaaatgcagtcagaccccttgaatcaaaacgattccttgggaatgaggtctcttttacttgggaaccaagtcaagacaaacaattccttgagaataagatccctttgactgttgtcaggattaggttctcaggctagtaaagtagcatgctatctttaagactgctactgtggccaggtagggagtgtggcaagggtatcttacagtactacaaaacgctcttagcctttttcagttgccctttttctgattaagtgttttctcagttgtaagctttttactctcttcccaaattccagtaaaagtgattctgacagctatgcagtagttttcagtgtttctgagacaggatgaccccagcacttcctattttgccaaaatttttttgttcttattgttgaatttctaattcaaaagcacaccctagcccactttagtctgtagttcaatatcctattgtggtctgccctacttatgtactatcctgaggccaatgtgaattctggaaattattctatactataattcagttctcagtattttttttctgtgtagattctggttcgttttatgtaggggttatttaggatttcataaacagatgtaaaagattcttgtctgaaggctcctcttctctgattctcccttatctcttcttgggatgacttaagtgcagggtgtggaaagttaacagagcaacccactgtgtgtgcagctgccatgctggttgagatcagaaatgacatcctttctttgcttatgtttgcttggtgtcagttggggctagctgacaaagcttcctctctcagtctttccaatagcagtacccgattgggaggtgaggactctgctttgcctgcttttcttattgttggcagtgatggttgacaggcttcacacctcagcctctgtggctaaagtgcctgattaggagtgaaaggggcacagctcctttttggcattggggttcccttctgccaggcctgtttcttctcattttgcatgatctccgttggttagagggaatggtctttcctggggccttttgggttattgttgttgttaatgtaccctttggtaattctgggttgcagtttgctcctgtgtacagactgggatatacaggaggcaaaaataaatcctaaggaattcttttccaggtcctcccttgattcctgaagactctacctgtcctgctttcttcattccacatttcagagtttctgatgtttgctttatgtgctgtgttcatggttttaaattatagttaacggaagcattggggtggaatatgcttactctatcattactggtacaggaactcaactcccgcaatcatttatcaaatgagtgattaaatgatacatggttcttgccttcaagttacttgtggtgtatgtggcttacattattaacatagatgtactattaagagaattaagactcattcctgtgagagttctcctaggcaaaggagtgagattatttctagctgttagggaataggatacgtggtgtggtggtgtggtaattgttctgacaatggttctctgtcaccaactggatgtcctgcagctcagttcagttctcacactaacagaccccacaagttataggcagaggtctccaccaggagtgcctccacttcacactccagctgcaagtatcaaggtccacctgcagttaggaccaactggccataaattctggagttcccacatatctctcaggtttaataatttgctagaaccgctcacagaacgtactgaaaacactatacttacaattagcattttattatgaaggatacaacccagacacagccaaatggaagtaatgcatagacgaaggtctgggggttggggagacagagattccttgtggaatccagacacattatcctcccagtacatcagtgtattcatcaaccaggaagttctgctgtgctcctggttagccctcaaatgatgtgtttggtgatgtgtttgatgtgttttcctggtgaacagcctccagtctgcaatacgtagaagccactatgagacaactcattagcataacaaagacacatctatcactcaggaagttccaagggttttaaagcgctgtgccagaaactggcacttacatactgtctgttcttcattattctttattatactacagtcatcaaataaaatttcagggaatgtggcatttgagtgatttaaataatacgtagacttaaacgtttgaaaatggggaaaggggtattctaggctgagaaagtagcattagcagtcataccagaggaacacacacacacaagtgcaagaattgatatgtagaactacttcaagtttttggttttagtgtaggatacatgaaaaggaaaagaaataaagctagattgggtctatcatttaatgatatttattaatcagagaatcatttattcctacagagcagaagagagaaaagatctgttcatgtttttccgaagcctgcatttttttgtggagtggtttgaatatcgtaagcgcacgtttaaacatctcaaggtaaagtctgaagtctttgaatttaaacatatatggaaaacaaagctgatattaattgagaattcatccctaacatccttttcttaaaagctttcaaacagtagaaaatattctcattgacttttggaatttgcaattatttggaataactggaggaggattacttctgtacaaatcagtgaacaatttatgttgtggaatgtcttgaaagaagtgtggttatattcaaatttatttaaaatccgcattttggaaaaacattctttcaagagtatttgaagtaaaacaacaaatgttaataaagaatatcatcacagcaggcttatcatgtagtggtatactgctaacttcctgagccagactctgtgttttcagcttctcaattgtgcatttcgagtttaaataccaaagcctgattcttgcgaagtaatgcttcctaaagcctgatatgggtactttaaagtacttccttttattccctttctttgttttcgggcataactgaaattaagtttggttgcatcgtaatacctcaggttctactcatttggatagcatcaaattattgacagcattaatccacacagcaaccagttctgaaagtcaacttaaataatatttcagggttcagattctctcaaaagcctaaccagatcatgaatattgtttttaggacttgtactaactctcctttatttggggttctattgtttcttattattatttattctatttggttgagctaataaaatctgtcaggcctaggatttttttccacaaagaaacatgggcagttctgtactatagtaccttgaggtgttctcatgattttgttatattcgatcataggtagtcttaaaatgccagaaaaattaaatatttctgcttcacaagtgttataatacagtaatgaccagggagtgtgctggcagttatggtaatagatgaatcacctaatgttgctgtttccttatgcatttgaatgggtgatggaaaatgggagcactagtctccatttccaaagctgatttgactctacgtgctttccagtcaggtatgaagtataattggtgtatttttcttatggagggtaaagagcttctaggagctggtctttgctagttataaaattactagggtggaaaaaacctatcacattgtcctgtaaccgtcaccaatatccacattgttttgtaaccatcaccactgtccttctccagaagtttttcatcatcccaaactgaaacatacccattaaacattaactcctcattcctgccttctcttagcacttgctaccactgttgtgttttctgtttctatgaatttgactattctaggtacctcatatatgtggagtgtcttttcacttagcataatgtcctcaaagtttctccatgtcatagcatgtgtcagatttcttttcttttttttttttttttgagacagggtctcactctgtcacccaggctggagtccagtggtgcagtcacggctcatggcagctttgactgtccctggctcaggtgatcctcccacctcagcctcccaagtagctgggactacaggcgcacgccaccatgtcagctaatttatgtatttttcgtagagatgcagtttcgccgtgttgcccatgctggtcttgaactactgggctcaagcaattgacctatcttggcctcccaagcccagtgccctccccctgcctttttattaaggctggatcatattccattaaatgtatgtacattttgcttatccattcatttgctgatggtcactggttgtttttacttttgggctattgtgaataatcctgctgtgaacattagtgtactgatatctgtttgcacctctttcaattcttttaagtgtaatgatatacctggaaatataattgctggatcatatggtaattctatgtttaattatttgaagaaccgcatactcttttccacagtgcttgtaccattttacaccagcaaagcacgagtacttcaatttctctacaactactttaatacttgttattttctgcttttttttttttttttggctatagccaacctaatgggtaggaagtgatatctcactgtggttttgatttacatcctcctaatggttagtgatgttaaatgtatttttatatgctggttggccatttgtatatctttgaggaaatgtctgtgcaagtccttagcccatttttgaattgggttgttttttgttgttgaattgtagagttctttatatattctagatattaatttcctcttaaatatatgatttcaaaatactttctctgggttgtcttttgactcttgatagtgtcctttgatgagcagaaatttttaatttttaaaatttatttttatttaatttttaatcgactaatagtaattttacatattcatggggtacatagtggtgtttcaatacatataatgtatagtgatcagatcagggtaattagcatttccatcagcttaaacatttatcatttctttgtgttgggaaccgtcagtatcttctagctatttgaaactatatattatcgttaattatagtcatcttacaatggtatagaacttattcctcctatctagctgtaattttgtatcctttaacaaatctctcccaaaagttttaaattttgatggagaccagtttatctattttttcttttttacctgtgtttttggtgacaaatccaagtaattccgtgccaaattcaatgtcataaaggttttcctctatattttctctaagaattttataatttaacccttaagtttaggtcttttagtttgtttttaaatattacataaggtaggtgtccaacttcattcttttgtatatggatatccagttttcccagcaccattgttgaagagactggcgttctccactgaatggtctttgtacttttgttgaaaagtatctgaccctatttggaagggtttatttctgggctgtttaatttattctgttggtctatatgtctgtacttacgctagtaccacactgttttcctttttttttttttttttttttttttagacagagtcttgctctgtcgcctaggctagagtgcagtgatgcgatcttggctcactgcaacctccgcctcctggtcaagcgattctcctgcctcagcctcccagtagctgggattacaggcacccgccaccacacccggctaattttttggaatttttaatagagacagagtttaaccatgttggccaggctggtctcgaactcctgacctcaagtaatccacccgcctcagcctcacaaagtgctgggattacaggtgtgagccattgcgcccagccacacactgttttcattactgtatctttgttgtaaatgttgaagttaggaaatgtgagtcttctatctttattcttattttcaagattcttctctttatttgggggtctcttgaagttccattttatttgtgtgaaagcatcattgagattttgatggcaactgtgttcagtctgcatatcatattggatagtattgttgtcttaacaacattaaatcttaccatccataaacacaagacatctttccatttatgtatgtctttagtttttttcagcaatgttagtaaaaagtaaatcatttaaaaatttaaagcctctaattattagtgtcaagaatgaaacattatgaatataatggagacagcatatttttactttctctaattatttcgtctgatatcttctgaatcttggtggtataatttgtattgtttattttgttttatttgtgatttaaggttgtgtatatgaaggtgtaaggtatgcatgttcatatatatcctcttatctagaaatccccaaattatttctttaattctggaattcataccttttaccaatgttctttctcccttatcattatcttatctaaaactactgacttttgaattttttcttaatttgagagttatttgatggtgttttgctccataagttttatcataaaaataatataggaatacattatttttctgaaaactagaaagatgacagtcattcaagattatgatagtttaaagattcaatttttccaaataaaacagaacccttctatttagatggattttattttgcaatatttattatatattcaattcaaatgtactcactattgtgctaggcaattgaaagtaaaaagtataaagctgcattttgcgctctcagtgaggtttaagtcagggaaatgaggcatgcacacaaaataacgagaaagtagtataatagctgtgatcattagttatcaaaataagtgaatgagctaataatcattgttagaataataattgtgttcttagatctcagatgctttaatgaaaaatgttatcttgaggtcaactttgacaaatggggagataactgaaaaacatctgacattctaggtagggaaaacagaagcaaatgcttaaaaatgggaataagtatgtattctgtacacagagacaacttgatttcaatacatactttatggtggaaataatgtttgtacttttacttacacagtccggactcatgtttctaaaacactgataattttgtgtttaacttcaatgtaatgtgtagtctaatacttttagtggggtacaagtgagaggaatgttattttagaaactttactctggcaccactgagtcatcataaattattactctcagatagaagatttaattcttgcagttagccatgtcagtttatcatgagtaatcagaaagtgttactcagaagctttattgtgaatattcagtttgttacagtgaacatggatgtgtatgggtgggaaggtagtgtgcactggcaccacagaatattctgttttcatcttatgcttgaactaatttattgatgagattctcatttctgtagtataaaaggaaaatattttgcagttatctcgtatttgaaagactttgccatagagaactttatcagaaatggatgaacttttcattatttcttataagcatattggttttggcctgcttgagtttaaaactttttttggtagacttagaatgttaatatttagataaagaaaatattttactgaagacattaccagaaagtaaaataacttgaacatttctgtattagctctttatcagagaataacatttattttatttggaaagttttcctaaatatgagactatctgctatttctcagactaagtgaaaaatttaataaaatagctgccttgataggaggaaaacaaagttcttactttataaggaataacgtatgaatcataaaagaagaatgagcgatcatgggaaacatttagcttttcaaagtttttggaacatgtaccttaaatgcttttgggatccagtaaaggccaggaaaggcaaagagttgaaagtttcttggatttatcctcgtacttacatcattagtaataggaataatgcatctcaaatttgggcatttatataaaaacatgatttttaaatggtagtctagtataaactaggattttgtaatgctgtttaaatattttcatattactttgtttcgaacgtagacattcagtcttactttttacttattatatgtaagattttgaacatccttgcttaaaatattaaattccttcaaaatgagatacaaggttaatattaaaccaatacttaagttcctttactcattgttgagacagactattagtgtaggtgtactttcatttatatgttgtaccaatagaggttaaaagtatgaccctatcggtaatctttttaagcaaataaaactgtttggatgctttcccaggacgattggattgccctccaggcgtatctcttcaatgcggtcccggatgtaactggtgtcattagccttgcagaatgtgtcatctgtaattgaagctatgttgttgaactgaaaaaaaacgaggaaaacattgttcagaaatctgaaatcaacctttcatatgctatataatgggtaaaggaaacctaagtcagaggtctgagtgccccctcacttcaaatccttgtgtcaaattaattaggaaatactcaaatgtacacctggagacaaatacaatcaagagcagacttcacacgtactgtgctggtctacttgttatgctctggatggaatctggacttctgggaagaaagttcatgagcctagtattaatctttttgataggcagacatttagctatcacgctactacagtgatctaaccaaaatttgtatgtgaataagtgaggttcccaatgagtcacaagattttgactcataggtaattagagtcagatattgtgaaaggaactatcatacctgaagatgaattacacgtagactttctggtaaattaagaggcacggattccagggcattatggtccaagtagaggaaggtgaggttattcagtttctgtaaggaaaatttcatgtgagtgttattgaggttctgtacattctttcacaggattcaagcaatatatatgtgcatatgagtatatgtctatatatacagacttgcatattgatatgaatacatcaattatatcaattgttcgtatggtagtttcttgtttgggttttttttctgacttcacgtgtagtgtattttgatcctttatgatggccagtggagctctgccgcataccccacacttctgtccattcatctgatctctgaatatccggctctaatgccaacttctggtactctttgtgtttgtcttgataggaactaatgaggtgagtccctatgtgggattgaattttgaccctggtgctgccataacctctcctgtacctctggagtttcccatctcagttccaccaatttctagctaagtggttacttcttagaaatgtgtgtgcttgtatgtttttagtagagacgaggtttcaccatgttggctggtatggtatcgatttcctgacctcgtgatctgcccgcctcagcctcccaaagtgctgggattacaggtgtgagccaccatgcccggcctaaaaaaatacaaaaaattagacaggcgtggtggtgggcgcctgtagtcccagctactcgggaggctgaggcaggagaatgctgtgaacccaggaggcagagcttgcagtgagctgagatcgcaccactgtactacagcctgggcaacagagcgagactctgtctcaaaaagaaaaaaaaaaaaaaaaaaaaaagaaatgtgtgtgcttagccgggcatggtggctcacgcctgtaatcccagtactttgagaggtcaatgtgggtggatcacttgaggtcaggagttcgagaccagcctggccaacatggtgaaaccccatttctactaaaaatacaaaaattaactggtgtggtagcacatgcctgtaatcccagctactagggagcctgagtgaggcaggagaattgcttgaacccagggggtggaggttgcagtgagccgagattgtgccactgcactccagcctgggccacagaacgagactccatctcaagaaaaaaaaaaaaaaatgtgttcttagcaagatgtttcccaaagcagtttagcaaacagttagcttgatgcaggttttttccctaagggcttaatgttggattattcttcatgatcagtaacccattattgtgtataattgtaatttcccctgacattactcttttaccttatcttcaatatgtatcctgtggtagattttgctaattcttttctgtgttgctattttaatactttcttaagcaccctacccttccaccatgtgggcatcaagctcttgtcttcccagtgagtctcatttacatgaggtagaataacctaattctactagtgactgtagcagcttaggacattaaacaaaactatagggcagctgaatttattattttcttttcttttt

SEQ ID NO: 14088 - DNA, 63760 bp, Human; identical to SEQ ID NO: 14087

SEQ ID NO: 14089 - DNA, 103377 bp, Human
  misc_feature (1)...(103377): n = A,T,C or G
aaggaaactgggagggagaattctacagactccaggtgggaaatactgtcatacttactgtaggtaccacagctatgtgtgtgcaatgcatctattatggaattgtgttcccaaaaatatatgttggagtcctcatccccgctacctcagaatgtgaccttatttggaaacaggattttgtcagaggtaatcaaattaaaatgtagttattagggtggtccttagtccaataagaatggtgttcttataaaaggagaaaatttggacacagagacacacacagagggaagacgataggacaagatacagggaaaggaaagcaggttcaagctgaggagaaagacctggaataggtcctttcctcacagccctcagaaggaattaagactgctgacatcttgatctaggacttctggcctccagatctgtgacacaatacacatctgctgtttaggttacttagtctgtggtatattactatggcagctgtagtaaactaatacagaaaccacgaacgactgtatttgaggcgcaagtccctacctaatttgctcataaattgccttctctgaaatcccgtgtcctcaaagggaaatcacgattgcattaaatgggggaagctctcttatagtaccacctctaagaacacataattttattgactatatattatgcactggtactaagggcttggcctgcctcacctcctttatcacctccattttacccaggaggaaacagacacaggtgcactttgtctatcatagataataattcttgctgaatccaggcatgcccctgtccactatgtctgcactaaactagaaatacactctcatgtttacacctttttttttttgtctttttccccttttgtggagaacagggtctcgctatattgcccaggcagttcttaaacttctgggctcaaactattcccccaactcccacttctgcctccctaagtactgggattacaggtgtgggccactgcgcccagcacaccctcacgtttttaaagtcttgaaattctcctatttccgcttctcaaaaggtccaatccttttccttaaacgtgaatataccacataaacgaacacgaaatagaaacagggacaaaaaagtatttttttgacgatggcaaacgggaaaaaaaaaaagaaagctgtttaggtggcatttgaaaagttaaaaaagaaagaaaactcagagcagcccaaaagacagatgatacctaagaaggcacaaccagcaagacatgttgactgttagtattatttcagcatcctccttgagcagcttggctttgctctgggacaatgcaccagcctgggatgctcagagatgcaggcacggaggttgtgcagcctctccgcacactgcgcatgcgcggctgccggttcaagtcgcggtccaggaccgcagggaggcgggcaagcgaaactgagaaaaacccacccacggtccagggactgggggctcgggcgaacccacccagggacctcctgaccaaggccatttgtctgcaacctgatggctagaagtgataccaccctgagcatcttcaatcccctttccccactctacagccccttgtactgtccctccttcctcattcacacccctgatccaaactcaagcactgaatttgtccccagacgagggcctcggctctgcgcggccgctggctgagtagcttggcccgattccgggtgtgaagtgaggaggaattgatgcgggtaaacatacagcgccggcccgcgccgcatcccgggtctgcagctacagctgcggcgaaagcccaaggtgcgcgtgcgcggagcgccactaggcagcccaggacgcgcgggctcggagccgggcgaggggccgcggaaggcgcgtgcgcagagcgaccccgggcgcgcgagaaggtcctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctgggtgggtagtgtgcagccgccgcctccagtaagggcggtcttgtgtgggcgtggggacggtcggcgcggggtacgtcacggcctgggggccgcggcggggcggtgttcatgcagggacgctcgggctcccgcgcgctctgcccccggctggccccgaagtcgggcggcggccaggagcgcccgcgggcccatgtccgggctggcgggcgcgcgtggccgcggcgtctacgcggccccagcacccgcttccggtcggcggcccgcgcgtggggccggagcacgtgggagcagtccctggggtccaccgggcgggcgcgcggctccgcgtcctctcctcagagcgaggcgcggcgggacctccgcgctctcttttcggttacgcatgcgtgcgaccttgagcggtgcccagcctcagcttccccgtctgcaaagtagcctggaggatacttgcctgcctgctccaaggttgctgctgtgggcgcactttgatggtagcatcctgcatggtagcggttctctacctggcggttttgcagccctgagggcatctggcaatggcgatgtcaggagacattttggctgtcacagctggcgaggagtgatggggtcactggcatctagtggagtccagaccagtgatactgttaaacttcccgcagtgcacaggagtgccctatgcaaccataaggaattatcccgcgccgtcaacagtgtagaggcacagaaggtccgtcaagtggcctggctgcctagggtgaccagcaccggggacatcacctgtgggctacttgtaaatgtagaagctggggccccaccctacccctgcccaatcagaatctgcattttaagcgcgtgaacgtttgagaacagctgctctatcaatccgaggcattaagaaacccttggcagtgtactaaggtagtcagtcttagcacatgtgaacttcaccagccaagaggaattcaagtagaattcaaagaataaaaccctgtttttaactcaagacagaactatgctgagctctaccgaaagccttgacacagttaacactatgacacataatcaccaggaggcttcatatatctataaacatgtctgcatactctttgtagacagctgacctgcttggttacgtatatcattccttcatttcaaaaccctgcaagttaggaggaagtatttgcatgtcactaattaaaaaaaaaaaaaaaaaaaaaccctgcagctcagagaggtaaagctacttgcccaaggtcacacagctaataagccaagctgagaaacgattctggattgatccagttctaaatataaatgatgttgagctcatcttaaattgtgaatgtgaccttgtttctgctcatcatattgctgggtaattccctagcagtgtttccttttaaaaaggcatgcagaaaccattctcttcattttatgaacacagaggtgtaaactgatgaattccaaaggaaaaaaaaaatccccgtagaggtcactaattggagccaacggtgtatgcagctactaaatttgaaatgactcaatttcagaaagcttgtgggatacataggtatagtttgtagacatgaattttcctactccggtggtcaaaaagttaaattgtcaaataaatttcttatcctctaataaaggtccagagaacctgttctgggagtctcatgaattttaataccaaacaagatgtctcattaaaattaaatttattaaacttctaaatgagcttggtgcctaattctgattctagattcacacatagccatgccctgaagtgatgaatgtgacttaaatggcattacaagcattgacctcacattgttacccaatcctctgatctagtcagataaccaagaattagtgctatttggaaaaataagccctgcttctttttattccctcccctcattttctgcccatttcctcctttcctgccctacctcttctttgaggtggtaaggccttgcaaaactttcttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgcttttgacatgcacgatgctgttagttgtcctttaaaaaaaaaaaaaatacacttcggtttctgtttctcatgaccaaggtaagagtcagttatgatttaggtaatattaataattttggctctcaaatgccattcagagaaagagagtaggggagtgggattagttaaaaactgggatgattttgaaataagaagatgacaattattaaacagtatctcagcagctggacagggaagattattctgtttgtaaataactgaaattaggaacacaaaagatggtcccaatttctttaaaagagaagacagtttgttgtccagagcagttctgtctcatagaattgagccaggtaaaaattttggggagcaatttttaataagtaaaaagatacagatgacattgatttggatgatgtatgttatgtaacctaatgtatcaaaaatattatttaatacaaagtcagtataagaaaatctttgaagtgtttgacattaattttgatactaggtcctcaaaatctgtgtgtgttttatacatacaacacatcttagtttgaactagcctcatttcaggcactctgtagcctcatttggtgggtggctactggcttggacagcatgggtctaggtctttgtggagcaacccaagatgtctgttgataatggctatgctgggagggtcaggcagagggtgggtgttaagaatattcagaattaggagttttggtgtatgtaaaatgtggtatgtgtaaaatgtgttttcttggagtctaatacagaattatttaaaatccttttaaaatcaaaggaaaataagcttatttccagtttcttaaatatcgtaaaataataaggtagatctgcgaagggtaataagaacatttgcagtgttgaccataatataccatatctttataaatccagattgcaggattttaatgagtgacttctacttcacctttagtaaaatgaagacctcttctgtgcctttttgcactcccgtagcttcctccttgccaaataatagcacttgagactataagtgcctgcctcactgtctggggcccaggagaccctaaaaggtcatggaggtagggtctctgtggggattaccaagcccagtactgatgggattgtgggctgcctgagacagttgacagtcatgtccactgtgtggccaaaattccacagacatagcgtgagtgtgttttgcgctgtcattctttgttaacttcatgtaggctgtttctttagacaccagaacatctatatagctgatgacaaaaatagatttttcttacgtaatattagcgcatgccctaggtggattgtcagaagaatctatgtatgttgtcatttgaccccatgaaatacgtctgaggtttaaaagtgcagctgacaagcttttcagcctcagtcggttcttactacttgatgttatcaagtcattcattccaagtgggatttctaagagttttggcacatttctgaggaaggtggagcaaagtgaaggatcattctgcatgcttccataggtggttattgtttaaccccagaacgtgcagtgatcctagttggaatgagatcgtaatcacaatctcccctccttccatcatttgtaatgggtcttgctctggatgtcaaagcaactctggtggtaggttcacattctttctttgccctgtcttccctgggggctgacagtgtacccttgggttttacccttgctaggtgaaatgtaggttctcttccacgtttgcaaaggagatggctgagggtggaggccagtgtgagggcttgggacagagatgaacccttatctcaggggccatgattggcctttcactacagggtgatcaatgagtaatctgttgtttctggaaactgaaaaggcttctggaatatagaaagcacaagacacgtgtgttcctattaagggtccgaagagatttagagtaagatgctatattgtatgttggagaaacagcatcagattatagatttagctccgtttggttctgttttctaattgacctgaaccatgccaaccttaagttcttgtagtaagtggttggttgtccactgcagctgtttctgtttctagaataattgagaagggggtaaaacttaaattgcaaaattctgcagataaataataagagttttgtccagctggcaacacaaatattcagcagattctaggcatgcaggtgtaaaatatccttttcttttttctagctctctctttcaaataaaagcaatatggttttatttagaatctttaagtaaactggatacaggcatgtgtgagaactattgtgggttcagttccagaccatcacagtaaagcaaacatcgcaataaaattagtcacatgaagtttttggtttcccagtacacataaggttaggtttatactatactgtattctattaggtgtacaatagcattatgtctaaaaaatgtacataaccttaaatacattttattgctttaaaaaaaaaaagtgctagggatcatgtcatccttcagtgagttgtaattcttttgctggtggaaggtgttgtcttgatattgactgttgaccagagtagtggttgctgaaggttggggtggctgtggcaattttaaaaaataaaacagcaatgaagtttgccacatcacttgattctttcttttacaaaaaaattctcttttggcgaggcatggtggctcatgcctataatcccagcactttgggaggcagaggcaggcagatcacttgaggtcaggagttcaagaccagtctggccaacatggcaaaaccccatctctaccaaaaatacacacacaaaaattagccaggcatgatggtgcacacatgtagtcccagctactcaggaggctgaggcccgagaatcacttgaacccgggaggctgaggttgcagtgagccgagatcccaccactgcactccagcctggacgacagagtaagactctgtctcaaaaaaaaaaaaaaaaaaaaaattggagtcctctcaaactctgctgctgctgctttaccaactaagtttatgttaatatagtgaatcctttgttgtcacttcaacaatgttcaacaacatcttcaccagaaatagatttttatctccagaaaccactttcttttcgcgtccctaagaagcagtgtctattcagttcaggtttcatcctgagattgcagcaactcagtcaaatcttcaggcttcacttctaattctagttctcttggtatttccatcacattctgcagttacttcctctgctgaagtcttgaacccctcaaagtcatccatgaggattggaatcaactccttacaaactcctgttaacattgatattttcatcttttcccatggatcatgaatgttgtgaatggcatctggaatgctaaatcctttcctgaaggttttccatttactttgcctagatgcatcagaggaatcactatctatggcatctataaccttaggaaatgcatatcctaagtaataagacttgaaagttgaagttactcctcaatccatgggctgcagagtagatgtcgtgttagcaggcctgaaaataacacgaatctccttgtacatctccatcagagctcttgggtgaccaggtacgttgtcagtgggcagaaatattttgaaagaaatatttgtttttgagcagtaattcttaatagtgggcttaaaatattcggtaaaccatgctgtaaacagatgtgctgtcatccaagctttgctgttccatttacaaagcccaggaagagaagattcagcatcatttttaagagcactaggattttcagaattgtaaatgagcactggcttcaagttaaagtcaccatctgcattagccactaacacaaaagtccgcctgtcctttaaagctttcaagccagacactgacttctcctctctagctatgaacgtcatgggtggcattttcttccaatagaaggctgttttgtctacattgaaaatctgtttagtgtagccactttcatcggtgatcttagctagctctcctggataacttgctgcggcctctccatcagcacttgctgcttcaaggagctgttcaaggacagagcaaggagcaattctttccttaaacctcatgaacttctgctagattcagacttttcttctgcagctttctcacatgcctcagtccccatagaagtgaagagagttagagccttgctctaggttaggctttggcttaagggaatgttgtgctggtttggtcttctacccagatcattaaaacttcctctatgtcagcaataaggctgtttcactctcatcattcacgtgttcactggggtagcacgtttaatttccttcaagaacttttcctttgcattcacaacttggctaattgggtgcaagagacctagctttcagcctatcagcttctgacatgtgttcctcactaagcttaaccatttctagcttttaatttaaagtgagagatgtgtgactcttcttttctcttgaactcttagaggccattgtagggttattaattagcctgatttcaatattagtgtgattcagggactagggaggcctggaggagaggaagagagatgggggtctatggagcaatcagaacacacacaacatttatccattaagttctctgacttatatgggtgcggttcatggtgccctaaaacaatgacaatggtaacatcaaagatcactcatcacagattgacgtaacagatgtaataatgaaacgatttgacatattgcaagaattaccaaaacgtgacacagacacgtcacgtgagacatgctgttaggaaaatggtgttgatagactttctcgacgcagggttgccaaaaaccttgaatttgtaaaaactacaatctatgaagcacaataaaataagatatgcctgtataatatgggacagcagtgcatcgttttgttttgttttgttttttgagccagaatctatttttctccttgaaaagctatatattagagattatttggtcctttttatctttgcgattattcactccttactctgattctatttctttttttttaaactgctataatttatatactattttctgtcatttttcaggagtagatggagacttaaagcaatgtaaaggagcaaggtaaatgatatctcctaagaaatgtcccctgaaagcactccttatatagatgctcaggcgactggtcagaccttctgatgagatgtttgaaaagtgattgataggcagtctgtaggtagaaagcacaatagtgttattctggaatacattacgcttgaaaataatgctcctaccatcggctataagggaatttcagtgattaataaatgcagcatttaatatattaagagcttccttcaatagtgttaaaatggtggaagggggcaaccttgattttgtgttgcagatatttgcagtttaaaattgccttgttggtgcttaaagagcatttttttgaagacatagtaatcctaacacatgcatttctactgtgtaagagcacaaaaaggaagacttttccccatggcttttcatagctgggccatccatgtggcttctcttcacatcccttttcagcaatgtctggcagatagatcaccacctttcctgatcctcctttatcctctgtctcccttgtgtcctttgctgtgatgccaacagtgagtagcagctaaggaccctggtgcagctggccacgtggcaaggtgcctgcgtatgagaggaggatggtcacctcttcacagccatgcctggcaggcagtttcatggcattgcttgtggcgcttggtggggcccttgactcttctctctctgagctctgggagctgggccgaatgatgtgcccttttgtgattgatggtgccttatttaaaaaacactgcagatgacatagctgttcaaggacagagcaaggagcaaaccaaagtttgctctttgactcccaatagactgttccatgtgtctatgaagtaaaagcaaatggtcatagttggcacatcgaagcttatctgagccttcagacaaaagccaaaataagcaccaaccctctctcccacttgtgtcagctgccatgcacatggaagagaagcacatggtccttgagcactgtgcgcctgtctgctctctagcccagcactgtgtatccagcaaatcttcctgccaggatggaaatgttctgtaactatactgcatccgatgggagccacagctggaaactgggttcatgagatgtgactcatgcaactgaggacctgaatttctcgtgttatttaaatagcccccaatgactaattgccaaaacgtaacatagagacacaaaatatagagtggacagcacaactctagaggaatgcattcactcatccttaatctatttagaaaatactctgctgggtgttacaaaggcttcaaaattagtctcttcctttaaggatcttagagtcctgctggaatctaaaacatgattggtaaaatctgtgaataattgctaatgatatacacaataagaatgtgttagcaacagtgcaggattttgaactgaaatcacatttggggtagcatactgtcaaggatagataggagccaagaagaaaaatggatattccagaccaggagaaatggccaagccataggcatctttactaaagcatagaagagagtcgttttttgttgttgttgtttttatcaagcaaagactgtattaaaaaaggaaaaagatcttgctaatgattacattgaagtgtggaggtgagaagagatttgaaaacataataatcctaacacatgcatttctcctgtgtaagaacacaagaaggaagactttgttttccccttgggtttgcatagctggagcacctgtgtagctcctcttcacatctcttttgagcaatgtctggcaggtagagattagaaatctctaatgtttcattgagaaatacgagactggggctggggacagtggttcacgcctatcatcccagcactttgggaggccgaggcaagtcgatcgcttgaggccaagagttcgagaccaccccggccaacatggcgaaaccccatctctactaaaaatacaaaaattagtctggcatggtgatgcgtgcctgtaatcccagctacttgggaggctgagacacgagaatcacttgagactgggaggcggaggttgtagtgagctgagatcacgccactgcactccagcctgggcagtagagctagattctgtctcaaaaaaaaaaaaaaatactagattaatctctgtcaggctaagattagtatttcttaaactgggtgcccattggtaatatccctttagcctattttaaagtgaaaatctcaccccatcctgcaagcacacatcctgggttttccccctatgactttcagaagagtctaggatggttatcgagacaccagcctacattctggatttgtctgattgtttccacatgataccaccttacttgttcctctgtcccctgtatttcctctaatctagaaattatgcctagtgcttcagttggacacaggtcagctgcctctggcaagaataatgctgtgccccttcgtcacctttttggggagatgtttgtattcagtctatatagggtcagtaccttcatgctagccccagccctgcagagtagagttgtcctcaggaaagctggtgaactgactcctctcccatagtggtacatggaactttttagtgagaagttcagagcctgagatacaagttagaagtactggctataatgcctgtgtgtgtggacagccggaacccttaggcaggaagaggaggctgccggggacagaggtgtgccatgctgtgcacccttcgaagagaaggtactcacaggaacctaaataggtttcacgtgtatgggttcctctgttccatgcagtgggatacaggaaagaaagagcagccatgcagctgttttctcactgtgtcggagcacacaccacagtctctttgatgtttgctcatgagattgaaggacactcatggctttgtcacaagatgcctgagaaagcacagaggttttttgtttgtttgtgtgtttgtttttgagacagaatctcgcactgtcgcccaggctggagtgcagtggtgcgatctcggctcactgcaagctccgcctcccaggttcacgcctttctcctgcctcagcctcccgagaagctgggactgcaggtgcccgccaccacacccagctaattttttgtattttttttttagtagagacagggtttcaccatgttagccaggatggtctcgatctcctgacctcatgatccatctgcctcggcctcccaaagtgctgggattacaggtgaaccaccacacccggccttagttttattttttttttttgagatggagtctcgctcttgtcacccaggctggagtgcaatggcgcgatcttggctcactgcaatctccacctcccgggttcaagcaattctcctgccctagcctccctagtagctgggattacaggtgcctgccaccacacccagctaattttttgtatttttagtagagatggggtttcaccatgttggtcaggcaggtctcgaactcctgacctcagcacagagttattaaaatcaaatgcagttgcctacgctttgtctgcttttgaaaagtaaacttaatgtttcagactgaggtgtatttgtcattggggtcctatgttctgcacagtttgtaaatctacttcacccaaagtgatacagtgatactcaggagggcttaaaaaagattaaatccttcatttggaaacatcatgcccagtgaaaggaacacaggccctaaggagatgtggctgattctagggaccgggaccagtaaaatacaacatgagcacagagcactttctcatgccaggatgcagtgggcggggttgggggggggggtcccactggcacaatatgaaccatttgtaatcaaaagaataatgaccagaagagagtataatactctgtctatatattttttaagtctctgtgttatgattctcaaaagagtaaaagggtggctgggggtgagctcttttacagaagaatgccagttaataaatatggacagaatgggagaattagccaggtcaccattttgggatcccgactgtaagtggttcccacaagcattgtcagtggaagccaaaatcatagagtaatcatgcaggagacgaaggtgcccgcagtgccatgtcagaagtcactgactgataacagaggcaaacgggccttcagagcaggcagctctgggggccacaattgaccctgtggcccaactgatgtagctttgccatccagaaagcagcatgtcacgtcacgtgtgctttctgaagtgacctcagaaatggttaacctgaatccatctggacctctagcagtttcagaggggtagaggaacacgggagggggtgtcatgtggaaacagcaagacaaatcctgaatgtaggatgttccaccaggtacctggactgggtccttgaaaatgttgactatcatggggaaaaaataggggctggcttttccacttttaaagaggctaaagggacatagtcaaattcagtggaccttagattggggaaaaaaatctataaaagacatttttgtgacaattggagaggtgtgatgtgtgctatttagggggtactatgaaatattgctgatttgcctgggtttggcagtggtattatggctgtgtaggagagtgttattctgaggagaaacgtgcagagagctagaggaatgaagagttagggcatctgcatgttttcaggtgtgttgcgtgcaggtatagggtatgtagatgtttcctatcctactattgactcttctgtatacttgaaaagttaaaataggaaagggaagattaagtcttaagcatgaaccactaaaaacaaccccaaaagcagtattaagtagtagtcagttaattctgtttaagagacaagaatgtaaagcatgcatctttagaaaattgatgttggagatatggaagaaatagtttcagaaccttcagctctctcgaacattacagtggcaatgcattcattgcaatgtgtattatagcagaaaacattctgaaggaagagtcccatttcctagtgctcatttttcagttcctcgtctctctcatagtgcaggagatttgtagacaaatgtctacaggatttagacagatgtcaggaaaattgtcttttgttgatgtcttaattggaatccgatagtttgtcagggcatgatgcttataaaaggaataaaagctttctaaaattcttcaaagagtagccactggtacctgtgtgtcacatcatatgctgatgagacatgacagaaaatgctcctaagtagccttatagctgatcctgaggagctactgtgactgggctctcactgcacctctcagctgacttctgcctactgggtctgtgtcatccctttttactctgaggctaccaaggtcttaggaaactggaggttggagcttgaactgagtgatgggaggaaaagacttcctgaagtgctgcccacatctcatgtatgttctcttggacccagttgtatccctgccattccctggaggttacctgttcatacgcagacttctctttcccttatttacctcaattgcagtagcttggcaaccttttaactcttgctttttaaaaggaaaattatttggttatcgtagaaacattttgtgcagcaaagtgttacacatatttctgttctggccttaaataatcatggatttcattaaatactaaacattttgctgattttaatacagtgctttagtgtattcttattttctttttgcatctcttatttgcctcgtttatcttaacataaagcatttcctttggttaagtagatccttatatctgctttttctttttgtatgactcctatttaggttggtgctaaagtaatgacggtttttgccattacaatacctgtagacataaaggtctagcttactttttgccatttgctaccctgtgtttagtactggcattttgctgactgctcatcagcttttgatacggtgtgcttacgtgacaagctctttaaagtgaaatcataatcagatttgagatttagaattgaggcgacttgtcctgtctacagtgaaactgaggcaggacaacctggggagctatgaatagtaggaaaatcccagtgaaaatccagcacttctaacttctactcctgggcgcttcatcacttagagttaccagcagtcttggtaccatttgttcatagttttgccagccctcacaggtacaggtacaattgtagatactgaaactctcaccagctgacatctaatttaccagctgatttaattttatctcattgatgattgagaggctctactgatagcccaaaaccactttagcttaggtgaaacatgagctgcgttggtaactgaagcctggcccatctcattgacaacttacttactgtactgatttagtaaaattacccatcctctgtgtccccgagtatggtttgcagcatatcacaggcaatgtgtgacatcttccaggatattgcatgcctaccaaaatataatcagattaaagaacatgttcagttcatatctgacctacggccccattgcactgtttaacatgattttgcaacagagatgtaaccatctgcacatgttatgcatccccttataccattagggtttatgctgagatcaagtaaaatcatatcctctcatagggaggggacgggacttctgtgaagtagcctgaagaaattaacatctttatatgatcacatctataatacagaataataaatgccatgtacctgttgctgtgtttattgcttctgctggctgggactagtgagtgtcccgattttaaggacgtgttttgaaactggcttgtctgtctttctgcctctcttctcagccaagtgtcttgctaaagtgggctgtgtttgccgaactcactcccccattttccttccctcgctatgagctggctttttggccctaccactcacagaaattgttctgacagaggtagcagtgatgtccgtgctgctaggtgcagagggcacccttttcttaaattgccagaacttccggcttcctttgccgcttctgcaccctccttggaaatctttctctttggcttcacggatagttcctcttctggcttccccatagctttcttttcctcctggtgcctgtttggcgtccctatggctttgttatgggccctgtcctcttgtggaaacctcttctgagctcatggcttcggcacatgcttctgctctgatgaccccttgacctccctggctgggcctcacctcttttgagttcctgtctacgtttcccagtgaccacaggctcttcctacccgcgtggccaagaggcagctctgaagcattgtattttaaacggggcctctagttctctgccagatctgctcttttcctgcattccacaccaggcagcaaaccccgaaagccccacagcagatggctgggagttatcttccagtcttcaattccttgccatccccacccacaccttccaggcacctcctgatttataaatatttcaaagccacttctgtgtcattccagctgccatttcctgcttcaggctttcaggcttttttctgatctaatagcaatatttactgagaacctttaccacatgcagttctgttggttacctgcagtgagatcagtggtggctgtggggttttgatgctcatgagggtgaaatcgcagagttctggggcccaggtgtatttgcatgaggtggctttggtgagagcatagccttcaccaggatgtttttggaggtttttctcctagtgtattttcctagattcctttgtcaaaggaatttggtcataaactggcccttaagtactttctaagagaagccttgttcatgtggatcacaatgaccttagactttgtgtgcgttgtcagtgctgccctctcctgggcattgcttctgcattcttaatgcaaatatgtgagttattcctgggtgtggctccatgacttgttcctttctggaagctctagccttatctcagccctcatcttgttaaaccagttgtgctgaccttgcttctctgacagcaacctgataaaagcctgtaaagttgcccacttcaagtcattgagcaatacaggtagccaagcagtagaggtggttacaataaatggcttaacattcccagcatttaggtggctccattcagatggcggaaggcaggtggcactttctgttgtggagaatttgaggagagagctttaagttcaaaaggaatttaagaaaagcctaagttggatctatgagggctctagaggagagattgagatgttcagggtgttccttcgattcatgaacccgactgacttttcacagcaggaccaccagttgccagatactgagacaactgagtcaaatgaatacaacagcatccctgttcttcaggggactgcaggcaggggtgctgtaatttgtacgggggcgggggtggacatgatctgttcttctatattatcatcattcatctgctagagacaactcgattttcttgggagccaggaaaaggaagttggccagtcggatgtgcctcacagcagagcaaacgcatcccaaatgagccaccggaagggttggggagtcactgaggtggaggaggaagggctgagggtatttcaggccaagaggactcggtgagaggcggagcacaggtaaaaaggcctgccaagggcagatggcggcgagccctgtgccaggctaaggaattcacattttatctcgtagccatcatacagcctggcgagcacacgatgtctagaagggtggtgcttctgatgatgtggactgttggcgcttagacactggagactggtagaaggctgttgccattgtccagatgaacgatagaaggactgcatgagttttccacaaactggggggcctaaaacaacaggagattactttatctcagctctggagacaagaagttggaagtcaggatatcagcagggctgcgtttttccttggcttgtagctgcatcgctccggtctcagcttctctccacgtggccttctcttctctccttttgtctcttataaataaggacccctgccattggatgtagggcccaccgggataatacagagtgccacatctccagatccttcacttaatcacatctgcaaaggtcttttttccaaataaggtccgattctcgggccctagggattaggacgtggacatatatttttgggagccacccttcaactgactacaaggacccacagggttggaatgaaaggaagaaaagtggctgattcagaggccgttcagctgacagctgggcatagagggatgggagggagaaggcaggtgaatagcagtgacttgtcctgaagtcgaaattagaggaagctgtgaggcctgaaaatagggatgagttccattttaggcatttggacatgttgagtttcaggaaactgaaagactgggcacctcttaggttgacagcattgatggaaacaaccatgatttcccatttaagacaaacaaaactcttggtgccgttaacccatgaagaaaactgacataggtggccatcgacctacactcgtctttgaacagctacagtacctagaagccattttagtttttacttttattattattattttttgagacagagtctcgttctgttgtccaggctagaatgcaatggcacaatctcagctcattgcaacctctgcctcccaggctcaagtgatcctcctgcctcagcctcccaagtagctgggactactggtgtgcaccactgcacccggctaattgctgtatttttagtagagacggggttttgccatgttgcccaggctggtctcgagccgtgcacccggctaatttttgtatttttagtagagatggggttttgccatgttgcccaagctggtctcaaactcctgaactcaagtgatccacctgcctcggcctcctaaagtgctgggattacaggtatgagccactgtgcctggcccctggaagccattttaaacttatttctaagtccccttcctcagagagaatacatgcacacacacagttggataattagcctaggaagggtctggaaatttagccatatgcccaccatgttttgtcctcctcctccttttgtgtgtgtgtgtgtgtgtgtgtagtatgtgcatctctgatacaaagggagcagctctggatccctagtcattctccaatcagcctccgaattccccctaaccctgcatcaaaacctgaatccccccaaccctgtgtgaaagcctgccacttcaggcttaatctttgttgacacgtaagggtgccgaactcacaactttgaagtccttttattctactcccttctccttttctcatcccagctgggttgtaaatgtcagggagaagtagagggcccagtcctccttcctggggtagggagattatttaaccatgggatgcaccatgatttccaaacacagttgattttccagagaagggagtgaaaagaaaagtgctttggaataacctttggactccacgcaccatgccggggataaacatggaaaataaccatttgttgggcggtgctccgtgtcacatattctagtatgtagttttatacccagccattccccttaccctttcgatttttgttagagcgggacggtgccctgcatgctgtgtgctgtctgagtatgacatttctagtagtaaggaaggttaggatggctctttcctttgccttcattaaagttctcttgcccagatgtgagatctttaaaaggtcagtgtttttgaataaggaatgaaatcatattctaagataaaagttcagagagttatacaataaaataataaattagtaaatggcacttccctgagaggcgatggtcactggtcactgttgttgcatcccattcctcttgccttcagggaatatcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggtacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagcttacacacacaggcatggtgtactgtgggtgcttagtattgctgtaggacttcttgtgtcctgagttcaccactaccctttaattctaaacatttataaactattgaagttagattcaaaactttcttttccctaagcttttactttctgcttattctgcttataaattagtaaatgttggccgggcgtggtggcacacatctgtaatcccagcactttgggaggccgaggcatgtggatcacttgagcccaggagttcaagactagcctgggcaacatggcgaaaccctgtctctacaaaaaatacaaaaatcagctgggtgtggtggtgcacgcctataatcccagctactcgggaggctgaggcatgagaatcgcttgaacctggaaggcagaggttgcagtgagccaagatcataccactgcactccagcctgggcaacagagtgagactctgttaccaaaaacaaaaaatctagtaaatgttaacagtcactgttcagaggccataacagtgtttgagtctcaacctttacaattttttcataaacttcacctttatactgttaactcacacttacaaaactctaatatattttatttctttgttgagtacttcagttgtctgaattaaagaatgaaactcttttagtcaataatcatcttaaacataataagtttataaaaatgatgaacctaaaattcttaatatttcaacatcattctgatcatgccttaaattgcaaatgtaaataattcaggtatgcatttaaatggttatttattagcattattgttctcataggccaaattcaattaaaaagtacaagtaataaaataataagtaacatggaaaatgtattcagtggtcttgctgcttttaagcatccctctaaatgatttgggagttgagagatgtctgttcattaaggaaaacagttccctcccaggtactttacattcccatgcaggtgattagagttttcatttcttaaaataagtaaatatctttccacctaactccagtaatctttgaacttgggaggaattctccattcttttatgcttctcaggtcagtacaagtcgtaggtacagctattaaaaggatatctgattgaattctggatatctttcatgtagtttgactgacagtaacacctcatagggccacattactgacatagttagaacattgtgctagccttagttatgtgtctgccaagcccctagctgttcaaagaaaaggcggtctcttaccagctgtccttccctggtaattggagctgtggaataaaggtcagttgctctttgagaatgtgagtgagcatttctgactcctcatccttcagtgcccccatgtgtggaaggcttggtaaattgagctgtgcctgcagttaccaagctatgcctccttttgtcaatataattcccactttgctactttgggtaccagaggtacactctgcatagcaggaaccataccctatgctttttggttcttttgagaaatcctaggtagaattagatacataaaatctgagatactcgaaccaatttatacatatgcaaatatgtattctttaaaaaaggatcttgatccttatttcttagtgatcttcttcatcccttccccatgttaagatagcaccttccattaacaaactgctcttgccttttatataaaaaaataaaaattaaaaaaaccaagtagatgaagatgaataacccagtgttacgggctgagtcatgtccccctcaaacttacgtggtggaggcctaaccccaggacctcagaatgtgactatatttggagataggtctttaaagggctaaacaatgtcctaatccaatgggactggtgtccttataagaggcgattaggacacagacacactacggacaaccacgtgaggacacagggagaggacagcatctactaaccaaggagagaggtctcagaagagaccaaccctgctgactgactctgatcttagacttccagcctccagaattgcaagaaaattaatttctatgtaagccacccattttgtgttattttgtgatggcggccctagcaaacttacagtcccaagaatctaagatttttgattgtgtgaaggatcaagccatctggaccaatgttttcctgaatttctgggcagacctttccaggaaggtgggcagcaaatggcccaggtctgttcagttagaggatcaccagagaagtttctccattctcagctcctatcatctttttacagctgaattttctgacattcctccacccccaccagcacacaaaaataagtgaaccaaaagcataacagctaaagaaatattcctgtgacatggtcactcatgtgtctttaggagagaagcactttgtactgtgtattgctgtttatattcttaatgtttttcttacatttcatgatgatttacattgccctaaattttttaaaaatgtaattttggcattgtcttcatatatatgcatatatccctggtggtaattcctaacaggccattgatagggaatgctaagagtaaggatagtgatatggtttggctgtgtccccacccaaatctcatcttgaattgtagctcccacaattcctgtgtattgtgggagggacctggtgggaggtaattgaatcatgggggcaggtctttcccgtgctgttctcgtgatagtgaataagtctcatgagatctggtggttttatgaaaaggagttttcctgcacaagctcgctgtcacgtctgccgccaagtgagatgtgcctttcatcttctgccatgattgtgaggcctccccagccacgtggaactgtgagtccattaagcctctttttctttataaattacccattctcaggtatgtctttatcagcagcctgaaaatgactgatacagatagaaatggaagggtagcggagggcctgtcaccttcactgaaaaagaatagaagtgattgagttttggtaggaaagatgatctttaaataaagcctttgtgcatgttgtggaggacagttgctggttttcattaattcaaaaggcctagggatatgtgggtttggcattaatctataatgcctcagacactggaaaactagctctgagaagggtttaggcaaagtgacatccatctagagctctatgtttgtatatttagctcttaaaattcaaaaagaatttagattattgccattagctaaatggaagcatcatggtgcatcaataggaaatgggaaaaaaaatgattaatagtatttatacatatgtgttattctgtagcaataacgaaggcctagcatgctggggtttgttttcattttgtgaggactatactgtgctgttttttagtaaactggtgaactgcctcagataaattgtcacacatagttctgtaaactctgcctgtagctttcattgactttaggttgtgaatgaaacgtttaaaagtttatttttatgttttttttatgtttttttttttaatatgtttgaaagtcattgtacagtagcccgatgagggaaaaacaaaaagatagccaaagttacttttttttgagacannnnnnnnnnnnnnnnnnnnctgtcgcccaggctggagtgcagtggcgccatctccgctcactgcaagctccgcctcctgggttcacgccattctcctgcctcagcctcccaagtagctgggactacagggtgcccgccaccacgcctggctaatttttttgtattttttagtagagacagggtttccaccgtgttagccaggatggtctcgatctcctgacctcgtgatccacccgcctcggcctcccaaagtgctgggattacaggcgtgagccaccgcacttggcaacaagatagccaaagtttcttaaatgccttctatttctattgctgctgtaacaaattaccacaaactgaggcctgattttaccaatctcttggtaaaatcgggtgttggcaaggctctgtttgtttctggaggctctaatggggaatgttttcttgccttttccagctattagaggccacccacacgtcttgactcatcttcaaagctagcactgtttcacctctttgaacatacttttttagtgcagacgtttgtagccataatttccctccacgcagtgcttttgctgcatcccataagttttggtatgttgtgtttccatttttattcttctcaaagtatcttttaatttctctcataatttcatctttgacccacaaatttttaggagtatgttgtttaatttccacattatttgtgaatttcccaagttttcttcagttactgatttctaatttcattgttgattgggaaaatatatgatttcacttctttgtaaacttattgagacttatgacccagcatatggcctattctggataattttccatgtgcacttaagaataatgtatattctgttattattgggtcagttttgtatagatgtctgtcaagttttaatggtttacagtgtgtaagtggattaaatcaagtcttgtatttgtcttccgtctagttgttctgtccattgtcaagtgtggcattgaaatctccagctactattattggaatcagctatatcccctttcagttttgacagtttttgctgcttgtattttggggctctgtggttaggttcatatatgtttataattgttgcatcttcttgatggggtgacctttatcactataaaatgtttccattaaaattgtttggttttttttagtgaaatggtttgtcctaagtctactttgtctgatattactatagctacttcagctctctttgggctgttgtttgcaaggaatctcatttccatcattttactttcaatgcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacatgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagatcaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgtttgccctggaaaaaagcttgactcttgctggtggagcccagattcaaaacgggggcagggggtggttacaaagcatatcaatctgttatttcatcacatacctgctgccttcttaaaggaaacaggaaagcattctttgatcagcatctacagggtctgagattctgctttgaaaaaatccatgtaggaaaagcgagaaggaaaggaagtacacaggaagggagagccaattcatctctgtgaccagaaaaattaaaagttctttttgcactggtcatctactgccaaatatgtgcttttaaatgggagagagaacaatatgcatgtacatagcagtattattcagtatcctgggctttttcctcttcattatggttatcagatttgtgtgcaaatgaatgtaaacacacacacacacacacacacacatatatgggtttttttttttgagacagggtcttactctgttgcacaggctagatagagtgcagtgcagtggtgcaaccatagctgactgtagcctcgaactcctgggctcaaccgattctcttacctcagctccccgagtagctgggaccagaggcacatgctaccacacccagctaatttttaaatgttttttgtagagacagggtctcgctgtattgtccaggctggtctcgaactcttggtctcaagcaatcctccttgccacagcttcccaggtgcctgggattacaggcatgagccacagcccccagctaacatattctttaaccccaatatctacaggatttaagactctctctgttggatagctcaacttaaagatatggtagagctctcctgaatttataaatccaaatcaacagttatttattctcccaagctagggacccaccctccttatggtcgcagggggttccctggcacactgcatgctagttagaaagccctcacactgaccccaggctcctccctatatgcctgtaccctttggccacctacctgtggatcttttctctctgggagcctccttgttctctgtgtttgggacaggctgtcaccttctgtcaactagggtaccttgctcttaaattatcccttcaatcccacctccaccataattaaagttaaaacagtagtgggacctgcttttagcctgcagtgtgtgggcgtggagggaaggcaccctgaagctccagggaaggaatggcgccatactttgtgcgctcaccagtgccccagaaaggatggcactggggacaagagccccaaaacatgggcatcccctcctccctaagaaggctcaacagagggtccccttcagggattccatcaataaagaaagcacattttatgaaggggagttgagaagtcccaggaagatttcctcacattggattccaggggtcatttatgagtgttgtgatggtcggtgggtattttttgtcattcagggctacttctattaacattgtaactgttcattttttcccaacctaataagtttttctttttaaaacaactttatggaggtttaattggagtacaataaactgcacataaagtatactgtgtgaccagttttggcatgcagttaccgtgacacagttcccacacccagatgacaaatcttcccacaactcccagaagtttcacgtgcccactgcaacccctgcctctctctgaccccatgccaaaggaaccactggtctgcttctgaaattaaagatttcctagaattgtatatagaaccacacagtatatgttctttttttaatctggcttctctcattgagcataattttgggaactcatgtcattgtgtgtaccagtagtttttatgccttttattcagttgtgtggctgcaccacaggctgaatatccattgacctattgacagtcttggcttctttccagtttttagctgttacaaatgaaactgccataaatatctgtgcctaagtctttgtgtaaacataggcttttctttcttgagtaaacatgtaggactggactgattccttcctgaggattgtatggtaaatttatagttaacttttaaagaaactgcccaaagagttgctatgttagccttttattactgctgtaaccagttgtcacaaacagtggcttaaaacaacacaaatgtattgtcttacagttctggacaccagaattggtctcagttggtaaaatcaaggtattggcagggctgcgttcctttctggaggctgtggggtattggctgtttccttgcctctccagctcctagagtggccgccattcctgggctctgactaccgctcctcttcataccttctctctctccctcctggccgcctcttataaggaccttgtgattatattgagtccacctggataatccagggtcacctccccacctcaagattcttaattacttttgcaaattccctgttgccatggaatttaacattcacaggttctgggaattaggacttggacatctttgggggacaattattctctctactgcagattgcgtcatcactgagttgtaaagttcagttccttacgtattctggatacgagtcctttgggtgtctgtgtgtgcatgtgtgtatgtatgtattgtaaatattttccctcagtctgtagcttgccttttgctttcttatgtgtatgtgccttttaattttgaagaaagcccctttatccatatgttctcgtacgacccttgctctttgcgttctatgtataaaaccttcacataatccaagcctccaagaatttttctcctgttttctttacagaggtttatgatcctagggatcaatatttttccccaatacagatatgttttcatacagataggtatggtctagcaacaccttttgaaccagttcattttttaagtgattttttaaatttaaatatggatgagaaaaaaattcttagaccaattcccatacctattaaatagaattgctaatgcctgtgaattatgccacatgctaatcaagagttttactttgcagatgatcactcaattatctttacagatctctattttaagcaatcatatttattattttttctctacagttcaaaaatgatagcttacagctacaggaagcgatatatcaaatacttaaatacttttttctaagcccactagagcaagcttctcatttgaggcaatattactgagactcttaattttatgcttaattattcatttcagtcctttaaattcctaaacacgagaaagcactagcatttacatgcaggctcatttgtaaaggtgaaacagtgacagcacggtgctgtggaagtttctatcctgtatatataaagcacaaaatacgttagtggttgtagggaaaagcgcggtagtgctcacagcgtgttaacaacttgcaacatttgttgaagaacagatgattgcacttctcatcatttgatgttctcatcaccgtgtcttctcccttctcatactgctaggaatttgtgcttggcttgtaacattgcttctgcctgacttctgttttcgggtctgagaggacatttcttagataataggtcattgaaattagttagctgaaggtgacatatggataggtcttcaggtgagaaaaacattctgatttacatagtgatgtattcttaatcactgtttttgcaaggtttctctttgtcagtatttgtttcaaaatatattaatgaacttatcatttctgattactgatttatttaaccttgtaaggactgtctccatgtcagttgtcacatttttcttggtgcctagcacaaagtaggtacccagtcaacatttgtttaattaaactgattgtattctgagcatgtgccatttctgcatacccgggatatctggcttctcgagatttttcatctatgatttgaatcaatattacatgttatgtttacttgtgtgacacaggatggtcccaacttagaaatatttgtctcagaaggggctctgtgctcagtcactggaaacctggactgaattttaatttaaggggaaagtcaattttaggttcgtttggattctagttcatagcattacagttttgttcttcagtttccacagtgtaaatgaaataacacatatagcagcaaggagcagtgagccagtcatacgggtgcagtacagtacttaaccaaaacaagcaaaccataccgttaaattttgaaccaggtaggtttgggttttctcctagtttatagacaggtatttattcatggaaggcaagttggatggagattgcagaaaacctaaaagagaggaatatattttgtgtttttggactttaacagcactaactttgatttccttttcctgtgacatacttacctctgatttttgctcacactcagcctcactgttctatagttttggagtgtttcctgcaaatcacagtgtctttctgctatacattgggataagaaaatatatacatgaattagatctggtaatggcaggccttgagaatagagcaaagggtaaaacccaaatatgtcagcatccaagcccacataagtgtgacagttctccagactgtgttaaagtttcctgattgtattaggacatattgtattgctataaagaaatgcctgagtccacgtaatttgtaagaaaatgggtttaaatggctcacaattctgtaggctatacagaaagcaagccactaaggcgtgtggcttgtgtgcctacagagcaccaggatgagctccctttgagccctggctgaagcaggagcagtggggatgaggggagcagtgtcctgaggcagctgggccctgggcgtggctcaggaaaccacccttctcttctaggcccctgggcctgtgatgagagaggctgccttggagacttctgaaatacctgtgagacctttcccccactgttttggtgtcagcacttccctcctttttagatatgcaaatttctctggcaagtggttgctccacagcctgcttgaattcctctcctgaaaaagctttttcgttctctgccacatggccaggcagcatatttcctaaacttttttgctctaccttccctttaaatataacttccaactttgtcatttctttgcttctgcatctgagcgtagtctgttagaagaagccaggttacacatagcatgctttgctgcttagaaatttgttctgctagataacctaaaggattaccctgaagttctaacttccacagaaccctagggcatgaacagaatgcagccaagttctttgctaagaaataacatgtgtgacctttcctccagttctcagtttctcatttccatgtgagaccttgttggcctggacttcaccatccatatcactatcagcattttgatcacaaccatttaactgttctctaggaagctgcaacttttctctcatcttcctgtgttcttctgagccctccaaactcttccaacctctgcctgttacccaattccaaagtcacttccatattttcaggtatccttgtagcaacacgccacttctggtaccaattttctgtattaggccgtgcttgcattgccttaaagaaatggctgagtctagataatttagaagaacaacggtttaattggctcacatttctgcaggttatacaggaagcatagtggcagctgcttcgggggagtcctcaagaggcttacaatcacggtggacgggtaagcaggagcaggcatgtaacatggcaaaagcatgagccagagagagagttggggggaggtaccatgcacttttaaaccaccagctctcatgtgaactcagagcaagagctcactgatcaccaagtggaggatggcccaagcgaaggatctgcccccatgatcagtatacctcccaccaagccctgcctccaacattgagggctacaattcagcatgagatttgggagggaataaatatataaactctattactgaccaatgcagtttctcctcataaacactgacctgatgcagggtctttttggcgtagagggggcatggagattagttcattctgattggtcattaccaaaggctgggcaagggcatgtggtaagggatgcaggagtgcctgtggaatatggaatggtgaatgaggctgagcagggcaggggtcccagggcccagagagaagtgcctggcccaccatccacctgggaacatgctaggggtttgctaacggatggccaaggtggctgggaagaaaccaggaggcaggccagggtaggagggcagccacactcatcccatgagtctagtcggcagcccagggtccttggccagctcaatgacttatctcctttaagggacttgattgtctcaggcatgcctacagagtttccaccgccagccagagagccaaaatgtttcccaagccaatcccatgagatgcctcacttctagtgagccacccccagcccccacaacagcctccagtcagggcccacctgaagcctcccttttccaactgtaaagctttcccagctccccaacctgcatttgagcttctgccaaaggcaagtgctggtgtccaactttcttgctatgcaatctctgaatgaatagcctctgctcgttctcatttgaagagattttcatttaccttcacacatggacagttatctttataacttaactcagtgcctcctcatttaccagaatctggtcttttcgtgggcttctcttgtcttcccgcaaatgtaataatgccttcctatgacactaggatgctttgagcagatagactcttccagtccatgcaaagaggtggtgtggtttggcctcactcctcactgcaggcttaggccagctcccccttgcagccacgtgcgtggacgtgactctgggagtgaagtgaaatagcgctgccgacaggatctgggctctgtgctgtgtgccaggagcatagagagcaatgtgaaacagctgttgcccacagtgacctttcagaacagtttttgctgttagggttctagggattactaagtaagcttggctggttaagaaggtcaaaaaaagcccaaggcaaccccagctgtctgaactagccatttcagaaggctgaaacctttctgctgtgaagggctggatttcctagcttatgtagttcaaagctcagtttttaggattgctgtgctacttactgaccgaaagttggtttttggaaattgacccttattttccaatatctttcataaagctggaaatgctttcactagaagaaaaggaggatcttatgttagaacatatatatatagcgatgtaaaagtttcagtagttactctcaaaagaaggtcaccaaggacaactgtgatttcatatgtaatgattccagcctagaaaatgtttttttcttgatttccatttaagagagttgagccaattaactaatccttgcatatggtatgttccattaagttgtcagtgtttttattccaagatgcatgtttctttaaaagagctagcttattagggcatgtcttcataagcactttaccctggccatgtccgtgagaatgctgtgcataactttcattgaattctacatctcatttgatgcaggcctaattaactattattaactgagaaccccaatttattggaatcatttgctgcagttaacttgagaaagaatggggcatgtttaagggtccttatttttaaatctctctttcattacaaacacattaacataagtctgatttgggggtgacagaaggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacccgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttcatacattaccacgttttaggcattctgttaataagcagcagaaaatggaataagacagagtccaagaatatgtagttggacagcatctcacttcatactgatgctgctggtccggggacctcatttcgagaatcaaggtgtttaggaaacaagcagtagaatatcttagatgaacaatactagtggtgtacattttaaataaattgaacaattactgattagctactatgtactgtcaaaatggttcagaaaaatgacaccaccacttctatcaaaatgtactggatgttgggttttttaattaaagcaacttcactttaaaatgtggttttacacacattcaaaacactgctgaccctctttcctcagctgccattaaggtgcttagcccttccgaggaagctaaggccttgtgaagctgtcactcattgggtgactagcaccctgcccggtggcaccagccccgcactcgcccacaccatggcctccatctttgtttgagctcacttgcatctactcggccctcattctacagtgcagtgtggtgaccatcacataagaccgtcgccctcatcaaagcagctagtgtaaatggtgaaacttttgggcctgacctgtttgcaagggcctggccagtgtcaacatcgggagcctttttggtagcatgggggctggtggacctgtacctacaggcagttctgcccctgtaccatttccccagccagagtcaacattgggaacctcctctgcagcagcatgggggctgctggacctgtacctgtaggcagtcctgcccctccactgctgccccagctgagcagaaggaagtgcaagcaaggaaagaagcatctgagggatctacttaggacatgggctttaatctttttgaagaaacctcttttgtaacatgatcagtgaaaagctgaactcttggctgggcaccgtggctcacacctgtaatcccagcactttgggagtccatagtgggaggatcactccaggccaggagttcaagactagcctgggcaacatagggagaccgtgtctctacaaaaaaaattaaaaatcagcctggtgtggtggcgcacacctgtagccccagctacttgggaggctgaggcgggaggatcacttgagcccggggggtcagggctgcagtgggatgtgatcaccctactatactcaggtgagaccttgtctcaaaaagaaaagctgaactcttaaaacgtgcacacacacagtcagctaacatctttataactgtcagattgtgacaatttgattctaactcaagatcagcctttcttgtagtttattttgtgtctttaaggaactagcctatctaacacaaaacactggctttaagttttttctcttttttgtaattgggaataaaaattatgttcaagatacatcaagattagttttggagaaaaaaagcattaagtagattcagttgtgcaagatgcacaaagtgtaacttcataagtaagcggtcacaaactcgggttcataatccgttacccaaaatctatggagccagatgtatttaaatataggttatttttaaaaggtattagaattcatatgttccatgacacagaacgttctcaggcagcacccgtaatcaaatccattagtatttctatagggaagtgcttgaagagtcgcactaagtatgataaatgtggaccattaaaaccacctcatgctagcccagtacagattttgcagtgttttcagaagcttttgggttatggaattgggaacagaggctgtgtttgttcctctgcagccccggcaattaagaagtgtttgtgaagctggtttaatgtgcctagcaggtgtgatgtattggtgaattccaaataattgatagttttgtttgcttttttttttttttaagcaaaatatttggtaggaggcactttagtttctcaagttcaatagctgtttgctcttactggagcgttgctgttaagggagacagcagatcttgtcaattccctataactcacggttaacaaaagcattccctaatgattccatatgttgatgctcagaggtaattctgggccaagcgctcagagcacaacacagattatttcactccatggacgcaaccgcctagaaggtgtgtggcatgactacatcattaggatcccattttagaggtgtgcaagccaaggtccagcaggcttataagacctgcagtatgaataggatcctcattttataggtgctttacccaaggctgctagcttccagagtttccggctagaaagctgcagagttggggtttcccgaaagaccaccaggctttagaggacctggcttcactgcctgggctgcctgccacctcccacacctaaagcatctccccccgccccaccccacccccagctttaaggccacccccgctctgcaggtcagcggctattaaatacatttctccaataaacatcgtatgttagacaggctaagaaacttgtcccagggcgtgcagctgagctgggagttttctgcaggtctcttgggtccccaaagccctaggtcttgtatgaacatgaggataggagcaaaatcaggccttcccatgtgtattaatgttactctgttctcacactgctataaagaacttccctgagactgggtattctgtagaggaaagaggtttaattgacccacagttccacatggctggggaggcctcgggaaacttacagtcatggcagaaggggatggcaaggcagcaggagaaaggggcaaaggaggcacttgcaaacacttataaaaccttcagatctcactatcacgagaacagcatgggggaaaccaccccaacgatccaatcacctccctccctccacacttggggattacagttcgagattgtcaggcctctgagcccaagctaagccatcatatcccctgtgacctgcacgtatacatccagatggcctgaagcaactgaaaaaccacaaagtgaaaatagccacttcctgccttaatggatgacactccaccattgtgatttgttcctgccccaccctaactgattgaccttgtgacattccttctcctggacaatgagtctnnnnnnnnnnnnnnnnnnnnnnnnnnnnnnccccctttaactgtaattttccactacctacccaaatcctataaaactgccgcacccctatctccctttgctgactcctttttcggactcagtctgcctgtacccaggtgattaaaaagctttattgctcacacaaagcctgtttggtggtctcttcacagggctgcatgtaacagatgagatttaggtggggacacagccaaaccgtatcaccatatatgcttcttaatgacagttggctcaaggtgttttccccgtaaataacgcaactcacagttataaaattgaagataggtccccatttgcatggtaagcaggtacagctccctgagagagcagttggggagaaaccctcgctttttatatctttgttgggtaaaacatcaaccactgtgcctcaggggcggacttagtgagcatttaagatacattttcagttataaaatgttacttgatttgcagcaattacccagtctccaccttagacagaaacttagaggccatcggcctagacttcctccaggcacagggcttccataacagttgaattaatttaagccttaatgcctcccataagcccccgggaactcaggctgcctctgaggatgaaaacacccgccagtctttgggccccagcctggggcaccctgtagcttcttcagagcttccacctccctgccaggctctccccctccccatgctgcccttgcagctactacagaagctgctctcaacatgccacacagattccagctgaggggaggggagtggtcacagtcacaagggatattttctaattctcctaaggagggtagtagtgtatgtggccctagcatgttaaaaacaatatgacctttcctggtaaaaaggaccctgaagcaatgttaaagctgcaagcttgttagtaagcagggaagaatatccatctgatggccctagtgcaagtgttttatgctcctttattttatttcagcatttttcctttcacaacgctgtccctttaagtgtgccatcatcaacagctgtagttatcatttgatctgagtagtttaattacttgtttagatcctttcttattccacggatttaggattattttatctaaatggtgaggaaaagtgtctgtctgcacagtcccctacagatttataatcccacagttctgtgtcttttaaattaaaagctccatgacattttaagctttaaataaacactgttggaagcatttttagaggatacagctgttttcctgcctttgtccacactcctttcttcctgttcgcacactcgccttagtcagagttccacggagcacctccatcgtcctgcctgccctctgttctgttccttcactcggcttttcaaacccgacagtggtgtctcacttgttcgatgcctgcagtttccttttgtcaatcttcctctctcaactactagaacaaacactcaaggaagtaaaatgtgccgcctcactgccaatccgtccatctccttgccctgagagccttggctctttctccccctcacatgagaagaagaaaataaaaggagcgctcatgcctgggtaaccctcccttagaggaggcttttcaccactcagctgttgaggaggagggtgggccagcccttccttctgttctgcagcttctgtagggagaccgagtgcaggatggaatccaggaagccttgagttactcaggttgttacttgaacttcgacttctacaaaccagcccagacttttctaagagtcctgtcttttgtactctcctaaagggctttgagccctccattcagggattgggccttcacagtctgcagtatccagaacggtggaggttctgaggtttgtttggtgtgttttacagcaaacttaataaaatacagcttgtggtcaggcgcagaggctcatgccttaatcccaacactgggagaccgaggctggagaatcacttgaggccaccagtttgagaccagcctgtgccacagggcaaggcatcccatgtctacaaacaaataaataaatgaaaaaaatacagcttgtggtagaaaagcaaggagaaaaatattatagtgctgaaaatgaaatggcacctgcagatgcagctgtgggtggatttgccaagaaaagcagagaaagaacagaggagggctcttcttgttgctgttagcagtcaaaaccagagtatccatcaggaggtggagaagccaggggtcttctgcagggaagagggccacagagggggtcagtgcacagggggaggaaggaagatggggagtgcagggcaggggccacccaaaagcccaaggaagagcccagtccacaataaccagcctctcctggtctccagtgtccacagggtggactgggcccagcctcagccccatcccaggaggaagagccagagagttccccaggcaagtgcagtgagccctgggaccaggagagaagcgtgcacagaggcaaagtccacaccgtggcagccaaagcagtcagtgagcccagtcctctgagtataaggcggcaagagccctagccgatgctgcaggtgcagtcaagagatgcagtttggatgctgctgaaggaacatgatacagggccacacggaaaactttttctcaagacagcagcactctgcccttggttcattcaggaattttgcatataggtggtggatatgattgactgcccaggccttgtgtctacacagatgaccattcaccttctgtgagaaagatgcaggagacaaagcacaggtggccctaccattgcagcggctcacaagagaccttcccggcctcctccatgtgtgacacagcgaatcctgccgtgtggtgcaggcagctctctgcatgcctatctgggaggagcagatattttggagttaaaacctgccctaactctcttttttttgaagacataatttcgctcttgttgcccaggctggagtgcagtggcacgatcttggctcactgcaacctccgcctcttgggttcaagtgattctcctgccccagcctcctgagtagctgggattacagtcacatgccaccatgcccagctagttttttgtatttttaatacagacggggttttgccatgttgcccaggctggtcttgaactactgagctcgggcagtcctcctgccttgacctcccaaagtgctgggattataggcgtgagccaccgcgcccgccccataactctcctttagtcgcagttcataccttgccaactttcaaaacacatcgaggcaattacagacaagcatgcatacctatgtgcatgtaagcatgtgaacatacataggagtatgaagacttacatgcctcttggatacacatagccttctctgtgcgtacacgttacttccctcagtgtgtcctgggtctcccagatactatcttacagggaaaaaaactagtatttagggatgattattgtatttgtttatgtcattgtgggacagttaaaggccattgagatcgcctgctcttttcaggacttcttgttgggtccagctgtacagattcaaggtagactacgtcctgctaatgctctccacaccctgtgggaagggttcagtgctaaatctagaacaggtggtcagtctcataactgaatttgaatccagatttttgtcagatgcatccgtgtgtcttcttcttaaatcagttgtgaacagggctatttccagcctctcgggttcagggactgcctctgtgccaccgcagactggaagacaaggactctgcccaggccttgggatagccttctgccttcactggggccttggggggattgtcatcaggcaacactcagctccatggagcttacctgggtttgaaattccacttggtagacattcctctgtgttgaagtatttctttttttttggcataatgcctcctagcaggtcagttagttggttcttcagtaaagtaatctttctaggcccacactggagacagagtggggaagacagctagtgtgtaacaagcatgctctaggaggctggcactagaatgttacttatgtgccctgaaatattcattctgtaaagtaggattatttcactgtagtagcatcctcagtagtattcttattggtaatatgagtgcaattgatactatgtatatattaaatatacatacagaaaaaacacatgaatagaaatgggtgtgagccagtactagttattatattgtatgtagtgtaatctagcgtatattagtggtactggtactattattagcagtattcctgttcatcttgtgtaagcgtgaggaaagcaggcacctgcaggctcactatgtttctgaggctgtgccctgagtaagtgccgagccgggagttaattctcaggtcagctttcaccatcccgtgacagcctgtgcattaaatgttctgttcttacctgggagcttcacagcagcatcctggccaggcatggtggggattcatcccactgggcagtggaaatgtccttaatactagtgggccatgcagtggactttgtcagctggtgctggcttccatgttgttgggaacaccgagtaatgatgccttgtgctatcgaatggaattgaccattccaaggatatatttagattcaaatacgtacatttaaacagaaaacacaataatacagatttcatttctctcctgagttctgaatttccagatcacaactccagacataactccagcagccttgagaggaggctgcccatagtataatttagtgagaatgacctgcaagcctttctcctgttcacttaggtctccacaaaagcctttgttcatggaatgagacctacacagtgtatgtttatgcggacctgatacaaacttactgttcatacagtatgcactctaaaaatctcttttttttttcctgcagatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccatggctgcgctcatgccaggtgcggttgcctcgctgtttgcagggttatgtttgtgactattagcaatggttttgtaaatcacctttaaagtctagcatagggcatgcttagtttgtcctcttttcttcagtatctaaactaagtccctcctggtgctcctgaaagagtttggctgatgctgtgggatgctgtgattcaattttctctttaaaagcttcttaaaataatatgcgttagtttcagtgatttctgggttccaaaaacatttgagtattgtttatattactatatataaagattatgttaatgacagaatgtcttcaaagtttaccttaatagatggttttgcctttttcttttcaaaatcagatataggattaatatttcagcaactattcaaactttaacaaattgataagcagctaaatctccccaaagacgcttaattaaaaaaaaaaaaaagtaaaaagtcgaattcatttttagcctgtgtgtttatatgccgttcagccctttctttacttgtatccagttttcttcggaaaggaaaaacaactttgttccctccgtgcttgttaactgacattcaatcagaacgggcttgcctgacgctccttgttcaagaatattctagattacagaccttgaaaatagactatttgaagatttttctgggatatacaggatgaatactctgtctttagaattcctggtgctaggggagaaaaaaaacagcagttatgtgagtaatcttggatttaaaatgatattaatatgaagcatacctacttttgaaatgtatgttattatttatatttatacatatgtccaaacatgtggattgaccattcctgggcagcacacacacacatgcaaacacacaccctttgtaatcactctgtctgcatccactgaaaatggtagtgtttgtgaatctcaggcatgggtacgagcatcgtgatactcagttctctgcatctagtgtctttctgcaccatttgcacatgaagttaccttgataagtcttggtgaacacatccatacagttactatatacaaatttaattgtggtaggaccagacacacacactaaaatttaccattttacctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatctgtgaacaaagataattttgtttcttcctttccagtttggatgccttttgttgtgttttcttgcctaattgcctggctgagacttccattattatactgtctagtagtgacaagagtgtgtatccttgttgtgttcctgaacttagaagaaaagctttagtcttcattgagaatgatattagctgtgaacttctcatatatggcctttaatatgttgaggtagttttttttttctgtccttaatttgactgtttttaatcgtgaaagggtgttggagcttttcaaatgcgttttctttctgcatcaattgcggtttttgtttttttttttttttggttccttattctgtaaatgtggtttcatatgttgaaccatttttgcattccaggaataaacttcacttgttcatgtatatgatcctttcaatttgctgtggaattgtttgctaatatcttatttagactttttaacctgtgttcatcagggatattgatctgtattttgtttttcatatagtgttttccatgtttggtagggttctccagtgaagccatctggtcctgggcttttctttgtggggaggttttcttttattactgattcagtctccttactacttacagatctgttcagattttctatgtcttcattttttcccccttctcaaaatcatcagggattctctgtcttcatgattcagtttgggtaggttgtgtgtttctaggaattcttttatttcttttaggttatccaatttgttgtcaaaggatatgccaacaaatagtattctcctttatttttgtggcattggttgtagtgttgccccttgcatttctgattttagtcatatgagtgtttttgttttttgtttttttagttaatgtagctaaggtttgtccataaagttactctgtgactgagtgtcttttgtgactttacaaagcactcatgatgtatgaggcatgcacgtgtcttatttcttccatatctacccaagcctttcacatggttttctttctacactttttgttctatattctaaggatatacttgaaatatgttctactgcaattcttaaaaagaaaaaaatgttttatctagatagtctggtagtttggctggagtgctagtgaatctgttttatggaatctacttggtgatcccatcaacgtagtgtcttcatttggctttctaagcgagcaggtatcagattaagtaaggtgccaatcatagaaactcatagaaggtgaacaaccagccaggagctagttcttcaaagatagttcagtcctatagaacttatctagatggctctcttttctttctttactactttttgacctctttaacttttttttttttgacttgacaaatcatgttttttggcatatgatttgtgtgtgcgcgtgtgtgtgcacacgcatatacttattttaacttttactagccgctcagttgcgagtagggacttcaatactgaaagtctctctttgaaaatgatcatatctacatgccatatacacaattagctgtgctttgacagagcagagcatgcagaagacttgaagagtatacagaaatgcacaaggtaatgctggagagaagaaacttaaaatcatgctgggatgctggctcagatgatgtgcagggacagtggtcagatgatgtgccgctttggtattctgaaacgagttaggtgtaggataagacaaaattattagaaatcatacttaacctgaagggaaagcaagccagaggaggacaatgttggactgaatgtatagagcagaaagacaggccgtgcctaattccaatccagaaatgtgttcttccttagggtttctgctcaatattataccagtcacaaaaatgaagataaaatagctcttctgtcctgaaagaacattcttggagacctagtttccattcattttgcactcctcccatctcctcttttatctgcgccaaacctgaattcccctcggaaggtgaccttatagcgtcattgctctggtgactagattcagagaaacttgctgctgtagtctttcttctaggtgttcattttgctcacttactactttgttcctgttcttaaggtgtagatgataatataacccttgactttgtttcttttccttctggaagtattttctggtagggtatgttaggttgtggaaatgaccttgagctctttagaaaagaaagctgtctgtagggagggctttttaattcaacgtcattctttttcacatgctttcagagcgacagccgaacccaaggaggtatttagcaagttaaattgccggagtgaatggtagattaccaggggaagcagcccctgatcatgctgcaggggctgtgtgctgtgattaggctgcaggagggtgtctgcttgggccagtcaccagggaatcagcttgattatgctgcagggacatgactacctgggccaataaccagggaatcagcttgattattctgtgggggtgtgtctgtcttggccaatcaccgaggaatcagtccaattatgctgcaggggtgtgtctgccttggtcagtcaccaggggatcagcctgattatgctgttggtgggtgggtggtagggggccggggagggggacgggatggggtgaggtgggggtcggatgggtgtctgccttggccagtcaccagggaatcagcctgattatgctgcgggagtgtgtctacctagaccaataaccagggaatcagcctgattatgctgcagggtgtgtctgccttggccaatcaccagggcatcagcctgagtatgatgtgggggcatgtctgcctgggccagtcaccaaggaatcagccccctgattatggtgcagaggtgtatctttggcttgatcatggtatagaagtgtatctttgccctgattatgaagcagaggtgagtctgcctggtcatggtataggagggctctttgcctgggccagtctagccactaagaagacaaggtggacctaatggacttgaaagacgaggcagagtggccctgatgcactcgcacatcagctgcctatttgctatcatcacatttctggaaggccctctctatgaaaaggtgggtgggcctacgatgtcctcagtgggaaatccttttgagcagttagttctgtaggcatttcttatatggcttcatggttccatgtaaactgtcggtcagccaaggcttaaattattttaggaaaataaacttttaaattgtggcacaaattttagaggaaaaaatgcatgtggttcatctcttgtgagttttctagggattttaaaaataggtaccgtattacaactggaaatgtatgtcacattacttaaaaaaaatcttcacttaggatatcagaaaatcttgtttaaaacatagcctatgctggttacctccattgtatcttgaacaaatcctttcagtaatgaattccttgggacagatgaaattctacatttcattataactcagcgagggtaatttggattcaaagaccaataagaagaaagttggtgccttttattgtgtagaatcccccaggagttttttctgttgtcccagctctctgctttcccatgtgttttcactaagcatgagattcctagaggaagagcccagggcatggtatctgggccagtagaaaggacagcctgccttgcagatgtgctcctcagcctggccggctctcccctgcatctcttggccggctctcccctgcatctcttggccggctctcccctgcatctcttggccggctctcccctgcatctcttggccggctctcccctgcatctcttggcccttaccgcctgcaccaggctctctggtgttaacttcctgccctctactttccccctctcagaccatctggagcagaaaaagcaaactagaaccctggccccctggagagtcgtggatgggtgccagagctccccttaggtggctgaggggagggagcaggtgtggcctgtgtggtagaaaggatgggtccagtcacagctctgcagcggagcactcctcctgctgtccagccccagtccccttaggacagtaggagtactgactgacatgcccactgtggggtactatgatctgaatgtgtcccccaaatctagtgttgaaacttaattgccagtgtgataggattaggatatggggccttcaggaggtgattaagtcctgaaggtggagcctcatggatgggattagggctgtcatgaaaggactagagggtaaggcctgctcttccattcctctgtcacctgaggatacagcattcctcccctctggagggtacagcaacaaggtaccatcttgaagcaaggagcagtcctctgcagagacagacctgctgatgccttgatcttggacttcccagcctccagaggtgtgagaaatacatttctgttctttacaagtgtccagtcccagatattttgttatagcagcacaaacagactaacacctggggcattgctgtaagacaaccttggagcatgtgtggttacacctggcccagtgagtggctcctagcaggcacttgtgtcatctcctaacccaggaggatccagtcctcaccctgaatcccaccttgaggagttagtaaggtcgttctccatccctgctcggcttcgttgaaaagcacacaccagccatgacatggacaccatgcacatgacatgggctctagtcctctttctgtccaagctgtgtcttcctcttgtaagtaagccttcctcctcaggctgacttaggtaattatggttgtttccatccttctactttttttctttttaattttgttcttggtttattttcttacaccgttgtcttcctggctgttaacagatacacccccaccctttccattaggagcatctggcaggaaggcactcatcctcggaagtcagctaacaacttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcttttttttccattggagacacagtctcattctgtcacccagggctgcaagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttgtcttatgatgcctatgtgtttgtgtgtagacccacaggcacacagagatatgctcacctacactcacctacatgcacctttatggaatgaggccgctgacataattcaccaagatccagagcaagtacctatagattaatgggacagaaatcccaaatgctttaattaaattgttagtcaattttttttttttggaagtaggtctaacaaaagtgaggacatctttttcctagctcttaaatgaattgtcactgtggatccctgaaatgctggacatcccttgggatgggaaggcactcagagcacttcctgcctgggagcacttacaaggttgcattagtccatgcagtgctaacatgattcttgtgtcaaggacagcttccagaagacctcagcaggcaagctgtgctgctttggtttgtcctccttagtgatggaggtattgtgctgtccacacccttacagtcctgtagattttcatatgtccacactgacacagtcacatctcttgttccgtctcctgtgccagtggcttcagggccagctgttacctttaggaaccaggaagcacccaggtcagcttccaggccaagaaggaagccagcagaagaattatagcccttggtttataggccgctctgataatccattactttctaagtctgggcagcaggcctcagtgttgaggggcagtataacacctaggtggcaggagcctcacagagaagagggacccatttgtgtacatggcacaaactgtgtctccacctgcctgtcattcctggcctatcctcagccagatttcacagctcggtgctggggctatgccagttagatctacccagggtgttggggcttcgagtctcattaagatggacagtgcctaggaaccccagaacacattctctgtgccatgttcaggaaacatgcacctgaagggtattcatgccacttttccttgttggtgtccactatggtcgtgttggctcacaagcattgaggactcactgcatgtcatgctctcagtgctttcactcgtgggggtatgtgtcagcctcctgccgccgctaagaagcagtcgctcttagcacagggaatggcaggtaggactgcaggggtcaagttacttgtccaaaagcttgcagcctctgattatggaggctggcctcgaacccaggtggggaatgaagagtccatagctcttagccacggcgctctactgccccagatgatgtggcggtgaccttctgttgaggtagacaacatcagagtacaaaggggagaagatgtgttctgacacgggtcacagggctgagccctttaaggccatatataacccatgtggagaagtccccagtgctcggggactctgcctcgtccagctccgtttctggtggtggtctcgatttggggcactcagctgattctcagtcgctggagaggctctgctggcaaagctggacctcagggatttttacttaggcagattgtactccttggataacagcacaattaaaggacacacacaacaagcgaaaaggaaaattgtacgctgacagtcatggtaacacattcaacttacgctgtgttccttttccgtttaacaaatcgaattagccccatgttcaggaaaatttatgatcgtagggaggaagaagcccatttgccagtcaaatgtaaatgtaaatgaaaattcttaccccccttttcctttaaagtatcagcttattggccaggcgcggtggctcatgcctgtaatcccagcactttgggaggtcgagacgggcggatcacgaggtcaggagatcgatcgagaccatcctggctaacacggtgaaaccccgtctctactaaaaatacaaaaaattagccgggtgtggtggcaggcgcctgtagtcccagctacttgggaggctgaggcaggagaaaggcgtgaacccgcggggcggagcttgcagtgagccaagatcacgccactgcactccagcctgggcaatggagcgagactccgtctcaaaaaaaaaaaaaaaaaaatcagcttattcaatgatgtatatggacattattcctcttttctgaatatagtgactttcataggcagctaattgccttgttatttagtaaattgtaatgaagacatcctagactaaggagaataagatacaaatctttgcttctgatcatcctagatattacctcactgcgcatgtggagatgtttctcaaagaattacaatttatattttttgctttgtttgtttgacacaggatctcactctattgccaaggctggagtgtagtggtgcagtcatggctcactgcagcccttgacctccctggctcaagtgatccccccaaacccaagcgatcctcccaccttggcctctcaagtagctgacacttcagatgtgtgccaccatgcccagctaattatttctttcttttctgtagagacagggccctactatattgttcaggctggtctcaaactcctgggctcaagtgatcctcctgcctcagcctcccaaagtgctaggattacaggaatgggccaccacacctggcccagtttctgtttctaaatgtgtggtggttctcctgtggatttctaagtctttaggagtataggataatgaacaagagaaatccttacctcaaggacctctcgattcaaaggagaggaaatgagtagataaatgaccacaatgggttgaatcaagtcactgtccctccgggaggggtgtgctcacagcataggacagcactgtggagctgcacagacaggctttgaggggtgttaggtgccagcactctctgcacactgcagtcaggacgagggagtggggagggcagtgacttttaggtgagcatccaggtgtagagcgctgccagcttgccccgagtcccagcacccgctcacagcctcctggcgccagtagtagaaatggttgcacaaagcaaccaatgagaaatactttcagttttccatctgccacacagagaaggtaggagaggcttgcaaagggaatagcatccagtccttttgttacttgggcatggaaagttggggttttccttttgattgagttctgggaagtcagcatgaatcagctttcggttccctgcctccagaccctattctcctgcttcagtatgatgtccctagagttgtcaaatccatagaggcagaaagtagaattgtgattgccaggggctgggggagggggatggaggttttagcatttaatggggacagagtttcaccttggggagatgaacacgttctggacatggatggtggtgatggctgtacaacaatgtgaatgtactgaatgccacagaattgtacactgagaaatcattaaaacagtacattttatattgtaggtgttttaccacatacaacaatagttattctttttcaaatggcaagaagccattcaaggattttggagttgtgttttggcaaagctcctgtgcagatgaggtagaaagcctgtagtgagtagacacaaatgtggtttttcacataagtgttgtggataagtgcatctccttatccccaacagaatcatacactcttatcagggaagacaggtgtctctcatacgccccaagcacctgggtcatggggacttgggcccagtgtcatgggcaggtttgagtgaggtcaggagtacctcgcaccacgcctactctcttgaggtggtttctgcaccacttctatacggtgggacctttcatctccatagcatggtagacacaagaatacagggaaagtcttactctctcctttctagaggattccttagagagtagactgtaagagcaagactttaatatttgagactattgacagagacaccatcaacagaaactcctcacaacaaagctctagccataaaactgaaatttctatgaaatatttgcaaaaaaaaattgacaataggaaactatgatattttatagtaagtagtccacaaattaggttaagaactttaaaattagtttgggattactataacttaaagtattctgttatttttgtcttattgttgaatgcataaggcaaaatgaatccatttttgatgtgagttatttaaaagaagaatacttttctgttacctcttatttgtgaagaaattgaaaactgaaactctttcccaatctttatatcatttgcacttttatgtttgttttgtgacgtagtcagggttgttcttatttgcattatgtaggtgaggatacaggttcagagaagtgaaacggagaaggagaagtttgaccctggccttgtaggccattaccaggctgcttttattgagaacctcaggtatggcattctctacgatgagttaaatgccttcttcagattgggttttataatacttgtgcttgtttaggtaagagaatttacattgtttaatcacgtagagagctatagtagaaaatcaggaaaattgaatgagctattatgttaacatttcctagtttatatcttttcctttggctattaatcataagctatttaaatagctgttttatacatttattttgtagtgatagatccttagaagtagcaacccgaaaagtgattcaaagtaaatgaaattagtactgtaagcagctttctggcaaatcaaagaagacacaaaatcaaatatttttctgaggatggtcagtattttgagatagttggtcaggttctccagatcttaagaaagccaatgaaagaaaaagtccatttaaggccgggcgcggtggctcacacctgtaatcccagcattttgggaggccaaggcaggtggatcacttgaggtcaggagttcgagaccagcctggccaacatggtgaaaccctgtctgtataaaaatacaaaaaaaattagctgggcatggtggcgggcgcctgtagttccagctacttgagaggctgaggcaggagaattgcttgaactagggaggcagagattgcagtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgttacataatacaaaagaatgcattttacttgattttcagggcaaagagcagattctgaaactgatagcacatttgcacactgaactcagaatttgccagtggtagtaacctttgtcacatggcggggagcacaagattgtgtctgattgtgtctggcctggttggggtgaagtcggggctagtgggtcgcttacatggtagcctccagcctcttcattgtgacaacacaggagcttctggtgttgaaactgcctgtccctgtaagactgagatgagatgtgaggcatatgatcaaagggtcacttaccagctagctagggggaagtggacatttcctgaatgtcccacattttagaaaatagtacgaaattcccaatgcagatactgtctgggttgtatgagtcttattttactgagttttctttgtaccatgcacagcctattgtaagcgcaatttaataaggagattttaagcatgttggtatatcaaattgatttgatctttatatacatcctttttgtctattagggatttatatgaattcaatttcacagggctaagaaaaatttttttaaatttaaaaatttctgctcctttggttgcattgaaatggtgggtctatggctcataaaatattctatgcatggtaagctaaaatatatctgtatttggatttagctgcataagtacaggaactgaacatcagactttaataaacattaataaacccttatgctatatgtttttcaatgagttattatatagtatatataatatgtagatactatatatactttaaattctcaacattgttttgataatttgctctaataatgctctaataatttgagcacttgtagagaatatttagttaagtggttaatggaagaaactcgttggggatttttggattccgtttctaggagggcagttctctcatgaggtaaatttcctatctggtctgtgcatgaatttcttgaagaactgacaataattcttcctattagtgtcacaggcaagggggcaaaggggttaggtgtcaatgcctggctgatttcctgcattacaaaatgtacctcttacttttctgtcttcctgatgttaccccctcttttctttcacctcttgggcctgcacatgatttgtttgctatcaggggccaataagctttctctgtgttttcagctttacagaccccatggtatatgtgtgaagcctttagctttgctgtgttaagaagcaagtagctgtaaacagtgcgtgagtgggtgctggtgctgcactccagtcaaactgtctctacagacacagaaagtggaacttcatctcattttcacaggttataagatcatattttttgactcttttcatttaaaaacaggtagtaagttgaatttgtgtttcaaaaaaaaacaaaaggcaggataaaacgaagagctaaaacaccacagagcaggttgaaatcccggatgtgaagtagtggagccattgggccctccaccccaagctgtgcattcagaatgccacctggggcagaaaacaggtttatacacagagccagagagacttcagatctccggtgatcaggcacagtggaggacgtagataaaagatccctgcaccctgcgctgtgagcccaccaggtcccttcacctcactctcttttatgcacaaccaaaaaagatcctggagaactcttctctggggaaggaagttacctcatgacaacaactcttaaacaccaacatttcgaggcccactgatggaaaaactgactacaggtagtaacttcgagtttggagaaggctcccacctgtgcccccaggtggtgctgtgtagcttactgagaatctgcctggcgactcagcccccactcttctgttgtggcaacccacatctgaaatgttgtcctctggggaacatgcatcctttccagacactcctgtaatctatatatttgttcctccctttcaagaggcttagaacttaaactttggttgtcatttttgttgatattatgctgttcattcctagtatagccgttttctaaaaggagagagaagcaaggatcatggatcagtagccaacgttagagtcagagagcagtttgcatgcaggttgtcacagaggcacatctagaacacaaggaaactctcatgcattccatgtgcttattaaaagggcattatactgcgaagtactagtctaataattctctgcaagggatttaaaaaagggatcaggggttagtactacttgctagagtcagagggcaatttgtatgtaaattgttacagtggcaaatctggaacacaaggacactcacatgtatcccatgctattaataaaacggcattttattgtttaagtcctagtctagtcattctttataagggaaaacaaggatcaaggatcagtacaccatgctatagtgagagggaaattttcacgttaagttgttacagagacaaatctacagcacagggaaatattgagtcatttttaacattaaggtgtcaagtcctgcctggaggaggggcacttagggtcagtaggatcaggtggagaggcttttcttctaaagtcctagtgcttagcagaggaatgagagagaccattcagtcccactatcacattgtacacctgtagttgcagcactgtgggaggccaaggtaggcagattgcttgaggacaggagtttgagaccagcctggtaaaatcctgttgctacttaaaaaaaaaattacacgctgtagtcctacgtttacttcataaaaactaatgtagaaatgcaaaattaattttccttaaataaaatttctgcattactctctatattactttgtctcttttattttcaatggctgaaaaaaatagttttgttttaatttttattatttgatccatccttaattaccaggcattgatcagtggtttgaattgccctccctggctttccattttaatctaaaattctgctataagtctatgaaattggaccagaacacaagctgtgccatcagtgatactgataacgagattctagagaaaggtgcttctttggctggaggagtttaggccgatcacatttcagtgaccccggagaacattagacagcacctattgccacaaagcaagcagccagctgtgggtagaacagcaaaggcagtcggatgctcatcgcctgtattgccctgggaccagcagaccaaataaatgtaaactggactcttgcaactgtttgtttgaagatttgaaaggagttagtttatatttattttcataactgctttatttctgtcagtatttaatgtttgccaaaaaaggaaacacaggtttcccacactgtctccccatcaagtatcacaaatttgtgtgtcaagtaccagaatttgagaaagataattaagatggtttaaggtcatctcacagatagaacctcagtctatccaagttttctcctccagggtcaacccactgtattagcttcctggtagtgctgtgttaattaacaaactccgtggcttaaagcagcagaaacttaactgtctgacacctcagaaggctagaagtccgaagtcaaggtgtgagcagggctgcactccctctcaaggctctagggaaggatccttcctgcctcttttcagctgctggtagttgccggccacccttagctttccttggcttgtaccttcaactccccaatctctgtctccattttcacacgccctccctcgtcctgtgtgtctttgtctccaaatttccctctcctttctttggatttagggtccaaccttaatttagtatggcctcataataacttgattacatctgcaaagaccctatttccatctaaggtcctattcccacgttttaggtgaacatgaattttgtggggagagcactgtcaagccagtacacctccacccatactttcctactcccagctcagactgccactgttcaggttgccccaggagggccctgagctggggcgcggactcagtcagtcgtgtttggctggagtgttccatgaggttcagccagtcttgccagagccttgctcctcttccagcccctcaacccaattcctttctcctgtttcctttccttccacactaccacactgtcttacgtccaggatataggttagtcactcaattccataagccggatcctgtggtgcaaattccataagtggcgatccctgatattagctttgagttggtgccgggtccctagtaaattaggactgaagatctgcacacagccaagggccctctccctagcagcaagcaccttttcaaaagagcagaattcatttggaaggcctagaaaaaggaaggaggtgctctgccaaaatcaatgatgtctgagaaagaagcatgctccctagagcttggagaagatcagaagagggatagcctgaggcatggctctgcagtaaatcattaagagacgcccactcacagtggctgtggctaccagaggtttcctgtgagggaactaaaaagcgcacagtagtgtttgtaagtgatggttccattttaatagataaacatacagaacttataaaaaatcaagaatctatattagccagatttcctaaattagttaatatttcttttaaatttatacttaaagtcacagtttttaaaactatatatatgaatgtgaatactatatgctttggggaatttgactttggttattttctagtgtcaaggataaacacagccagacagtagttaaagcgatcagcacagattttcttccataatatactattgcaatagagaaaagagaccaatgtgaaactgggctcaacatcaattatcccagaggtgactgggcattttaaagggaaattcagggagtagggaggggtcagcaggggctcagcagagttggggaagtgaaaattgcagaaagcaggaagagggtttggtcagtgtgaagccatctgggtttcactggtgctgatagaagtcaggctcctgcccttccacagaggcttgtctgcaggagtggctggaaccaacaatcagttattttggcagccttgagttttcgtaggcaagtactttaagggggctagagtcatgtagcggtgtgaccttgagctgttgaacttgttcaagtctttataggccagtgtgggggccttgtggagaaaaagactcagagcagcctgagtagagtctggtccaggagacacttttgtcactgagcatgaccaatccatttatcacaatggtagcagcgtgtcctcatggaattatgtttccttcgataaatcttgaacaagaaataaatgcatcagcgtatgtttttaaaagttaaacagatgttaaacttaaaggaagtttgctaaaatccatttcgtggacccctttgtaaatacctgacctacacagcttaccccttatgatttaaagttaacttgcatccattttatggaatcccaggtgcctgtttgacctgcagacatctttctcccttcttggtcactctctcagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaagctaatgaacacatgcatcatctcactttctcatcatgttttgtggggagaacacttaaaatctagaatctgagtgattttcacatagccaaatgttatttttaatgacctttgccttaattgtccattcaatatcggtcatagatatttattgagggcccagcatgtgccagccaagcgtggcctcctaattggaaacacaaaccctgagaaactctgagcattgttgtgtagtgcaggggccatcctcacacccccacagccagcattcagcttgcttcataagccatggatggagtcaaaggaaaactagctcaccttcccactatgtatctgaaatcactttctattccatgctgcacacatgtactgcaaggaaaaggaatgattcctgcccccaccactgccttccattcctaagaacagagaggatggagtacgaggatgaggaaaacagacggcaggaaataagcagtttattcactggatgtctgcatggggtcttgggagtgcagaggttgtgactcattcttgagtggaagtttctaaccacatacatacaaccgcaataactgcagccagctgctggaggtgttgtggtgaatcccagcgggttacaagggtgtgaggagcctggtaaagtttccaggaagtgaaagcacatgagctatgtcttcacggcaaagatgcaggtaacagctcagattctgagtcttaggaagaggatggaggccggagggtgacagggtttctctgtagtcctcaggaagtgaaactgcctcacaggaaataaagcaatatcaatcaggcagtttctttctgtgtatatttgaatattgtcaatgttttaaaaatcacgacgtatttctttttttttccttctttttttttttgttgttgttgttgttgagacagtctttctctgtcgagtgcagtggtgtgatctcggctgactgcaacctccgtctcttgagttccagtgattctcctgcctcagcctctcgagtagctgggattacaagcatgtgcctccacgcctggctaatttttgtgtttttagtagagatgggatttcaccatgttggtcaggctggtctgcaactcctgacctcaagtaatccgcccacctcggcctcccaaagtgctgggattgtaggcatgagccaccatgcccagccaaaccggacatatttctaaggaacgagaaagagcagccgtctgtccaccacctgccccccacaactgccttgaaccgcatcccagacagcttggtgtcgtagctgacattgcctgtgtcggccctcctctcctgatttattttaatcctcatatgttctttcttcttctgggaattgttcttttctagcattctgtttttgttttaaggactcagtaacttatatgtctccatgaatactaattattatcatgactgttgcttcctcgcccacttttctctggattgtcatttttttctggcagattcctgtcttctgcctgtttgagtcttcttccacaaacacctggcagtgtctgttctgctcattcacattcaagaacagagcacctgtgtgttcatttcctggggctgctgccacaagatactgaaaactcagcaacttctaataacagaagttgactgtctcccagttctggagactggaagtctgaaatcaaggtgtctcagggccacactccctctgtaggctctaggggaggatccttcctgcctttcccagctcctgggggctctaggcatccctgggcttgtggccacatcacttcagtctctgcctccgtttccacgtggcaaagtgagctcatctcaagatttttaacttaattacatctccaaagaccctttttctaaacaagacagaagtaccatgggtgaggacttctgtttgggggctaccgttcaacccactgctctcagtcacacaaagcttttgaagcataacacctgctgttcaggcagttgcaaaagtagcccctaagaaagacagcatgccaaagcaccttccccatggtggggtggggtgacgggccaggcacccttaggatgcccatgcaggaagtggaggctcagcagaatcccacaggtgtgtctggtcctgggatagcatcagcgtcttctcacaggtagccaggtggcatccatcagctgaccacatcgtctgccccagtggcacgggctgtcttccatgtctcacttcatagagctcttctagactgaggcccaggacatggttctcggcacacagcgttaatgacatgcacggccctctaagcggttccctctcccactttgcgttgtcaacccccggtaccccccacttgattctgttgctcactgcaggtcttaggtagtacagagaatgttcaggcttgtagggttctgatggccagatcacccaacaaaagaatgccacgaacacctgagaccgcgcggcagctgcctgtcttctgcctctttcctttgtttaatcctgtttaattgcacatccctgttctcacccaccttgggtctctaggatggaggaaagcaggagcgtttcttcccactcacagtgctgattctccacattccccagttcttcccctggagatgtgtcctgtgagctgattgtttggagcaacagatacctagatatctgtctctctgcccttcctgtaaacccacggaagcacaccaaattctaggagctgggaactggagttcatttatacacataattaaccagcttctccctagaacagaactccatttgcattttttcgtcttttacttctcagggaaagccactgagtgagacaaagtttgtgtgcactctttaaaagatgaaaaactttgtgaaggcatcaggcagttttgaatcaggtgattaggatcgttcattcctgatgatacactggagctatatctgatgataacgacactacctaacatttatctggggcttcctcacccatgtcattttccaggcattgttcttcttgtgaattaattccatgaggaacgttaatcattgctctttgacagatgacaaaattgaggcccaaagagggcgtataattgacggatgtcccgtaatctctgactgtggtcatagtcttgtcttggctttcatcttcataggagtcccaagcattttggagatctcagtatgttgtggtggtgtaaagcagtcgtccaaaaccgtttttgattcattctccatcaataagaatgttgagctgcattccagtctagacacattggtgtgtgtttgtttatctactccaccttagaaataattcacagcaatagaaatgcaagaaggataagctaaaataaaataatcggccgggtacagtggctcacatctctaagcccagggctttgagaggccgaggcaagaggattacttgaagcagaacttcaagactagcttagctaacatagggagaccctgtctctacaaaacataaaaaaatttaccaggcatggtgacatgcacctgtagtcccagctattcgggaggctgaggctggagaatcgttttgagcccaggaggtcaaggctgctatgattgtttgactctgctccagcctgggtcacagagcaagatcctgtctcaaaacaataataataaaataatctgtttaagtttttaaaattaatagcaccaaagtactttaagaaaatttttatacagtgtgttttacagagccatgtgtttaagtgtgctccattttttaaaatattggtttaaaattgtgtgatctagcaatttaaaaatcttgttttaaattcagattgttttgatactcagctttaatcactgtttatatccagacagaagttcatgattggctaattttttttttttttttttgagatggagtctggctctgtcacccaggctggagtgcagtggcgctatgtcggctcactgcaacctccacttcctaggttcaagcgattctcctgcctctgcctcccaagtaacgggttacaggacgcactgccacacgtgactgtctcttttttaaaaaaattagagccttttatctcatccatcagttaggttaaggtttaaattgaaatttagctaataaatatagtcctctgtgatactaatcagtggttgttgcaaactaatgaaatagtgtggcattttagtatttttaactaatggattcaagttctgtagaagctctttaggtggagtacttctacactgattgaatattgtttttatgcgtggaggtatgtgtatgtatgttcatgagatctgtcgttttcttgtctggcttttgtctggttttgggatcagggaagtgctgatgtaaaatgtaaaatgagttgagaggtgttccctccaatttcctgaaaagtctgtttagaattggcattctttttttcttgggaagttggtaaatttaccagcaaggccatttgatcctagatgtgggaaggaggtttttaattacaaattcaattcctttcataggcagaaggctattcaggttatttgtgtcttcttgagggagttttatatctttcaaagaattatctcatttcatctaaatggtcaaatgtgttgccattaatcctataataattaagtttttatcattttatcgatgttaggatctgtagtgatgtctgtcccctctttccctgctaatgttagtacatttggatcttctttatttttttgatcagtttagctaggagtctactaatttaattgctcttctcaaacaactcgcttttgatttagttggttttctgtattctacttttatttcattgattttctctctcatgtttattatttccttccttttatttgttttgggtttaatttgctcttttccttcactttcttaaggtaaaagcttaaatcattgaacttctttctttcaggttttcaatgtggcaacttagatcacttatttgagaccttattatttaacatatcactcaatgccatcagttttcatcgaagcaatgttttagccacatcccagaaattttggtagtttttagttctctacaaaatattacctagtttccctttgtgatttcatctttgacccatgtcttacatagaagtgtaacatccaaatatttgtgattttccacattcctattattaatgtctattttaattctaccatcgttagataaggtattctgtatgattttaagtattttataatttttgagaatagttttatccttataataggatatttcttgttgaatgttccacgtgcacttaaaaataatgtggtttctgctgttgttgggagaagtattacataaacgtcaattaggtcaggttgcttgacagtggttctgaagtctgctgtgtccttacttcttttctgtctacttgttttatcaattactgatagaggagttttaaacttccttctacgtttgtgtttctccattcagttctattggtttttgctttatgcattctgaagctctgctatttgatgtttacacatttagaattatgtcttattgatgaactgatctatttgtcattatgaaatgtccctatttatccctgatgatagtcattcattgttctaaaggcttgtttgttattaatgtaagtaacctggctctcttttgagcaatagttatgtggtatgtagttttctatccttttatcttcaatctatctgtgtagttatatttaaagtaggtttctgtagacaacatgtagttgggtcttttgtttttcttttttattctgatagtgtctatcttaggtgtgtttataatacttataaagccgttacataaggtcatgatctgctaattccatctgtctctatcatttctgtgtctatttctcctgattgtgggtggtatttgcttctttgcagcatggtaatttttgattgaatgttagacactatgaattctacacccagtggagtgctagattttgcttgatttcatttgctttatttaactttgtcctggaactacattatgatctgtccatgccttccttttaaaaatctttagagggtcaggtgctccagatatctgttaccttatcctgaatgactgtaggtgttcggaaaaaatgactctgttgattgttttgtgtaacaattgacaaagtagggacattaaatcatgacattattaaaataggcatgattatacaattatttaaaataattttaggccaggcgtggtagctcatgcctgtaatcccagtactttgagaggccaaggcaggcgaatcacctgaggtcaggagtttgagaccagcctggccaacatggtgaaaccccatctctactaaaaatacaaaaattagctgggcgtggtggcacatgcctgtagtcccagctactctggaggctgaggcaggagaatcgcttgaacctgggaggccgaggttgcagtgagccaagatcagccattgcactccagcctgggcaacagagtgagaccctgtctgaaaaataaaatgaaattttaggcaaaccgtcacaccttgtgtggatttagatgttcctgttgtgctagtcgcataagttaaaggtaggaaggactcctggtatttttgattctttctgataactagtcctctcatgattggctctatgatgacctccatggacctgtgtggtccctgtagttaatccgtgtggctaatgacagtgtgaggatgctcttttcatatggcacgttgctgttgatcagctgtgttcagcagctttcttttgtcccctgatcccttgttaagtagcgctgcagcagtccctcagccacagccttcttcagcatctggtggacgcctttgtgtaatttcctctccttagcagggtgaagaatgattgaagtgttttctgtagaatacagcatttttgcagaaaacaccaaaagcatagtccttgtgtatttactgctctggaaaaaaaagtatggttcagcgaggccctgctgaagggccttccccggtgccctggccagatcccaggtccagtcacctcctgggcctgctctctgcccttctccacgtttcataaggaggcccagcaggcaaagcagcagtgcctcccagtgcgctcttcttctgttcctttgggaaacgtatcgctcaaccgccaatagcttctttgattttttggtttgttttatttgagcagggatgttgtggagctgacaaccgcttttagacaatctgtcctaggtcagaaattcctcaaaaggagcagcctgagagtgtgctgccacacagctggagggactgtccctgcaagaaggtcttatggtggaggcctcgcccctcacctcagtccttccctcctcctccccaggggcggagaaactcatcatccacctgcggaaacatggcatcccctttgcactagccaccagctcggggtccgcatcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaaggtaagtgggtgccggtgacacgggccgtgttccacaaccatgttccaccaaataatatccatgtagtgtttgctaaatgtgaaaagttgtggtttgtgctgttgaaggccactttgcaatgctccctagaacttgggtatgtgggcagggagatggtctggttggaagattttgtgaggaatcgtggccgcacctaagtcaccaggccagggagactcagccagaatccactgggtctcagggacaatctgagaagcttacagtgccagaacaaggcctattcagacattttccagggaagcggcggttttaatgatgtggggcttaaaacagtcttattgtctaggtgcaggctttaaggtgagtattcactgcagttcagatgtaaatcactaaaactcacttcccctccccaactgcttatagagtgctcgttggttgctgcagtttttgcttgtgtagtgacgctgggtttttatcgccaagtttttggacttccatccatttctccattggaaagtggcagctggtgggcttgtatgccgtggcaccccctgtcccgcaccacggctgcttgaccatgcagggtatgcagtggagacggcccctggctccctcttcttgttaaataaggctcctcctcaggtgacctgggcagagcgtttagagagccgaccgcttgtggtggctgggcctggctccagattcctctgaccgttctgtgactgccaagatggagtccttggcctgaacgatctgcaggtacagattccagaatcacaggaagtcacccttgaaaggggggctcccgctggcgatgtaagtgtaagcagctggggagggcatccgtcggggagtctctgcaaatgcctgcttcccctgggttcctgcatgtgaggacttttgtggtttgtggggaagagcctttcagtgagaggtctttttcaggcctcacctctcattactaaccagtgacaccaatcacgagctcagggaaattactcagaaaccttcccaataaagcggagctaccggagtagtcttgaaagacctgttttttgttgttgttgttttgttttgttttgttttttgcccagggtgcaacttactaccttgagcctatagaggcagccggaacctgtgcctcagtacacaggcctctgattctctgaagctaagtgggcatccagcaattcagttcagttctgacactgactcctacggttagcccagaccccgaaggttaaggccccagtcccacaagacgcccattgcacgttccaggggccacctgtacttctgattggctacaaattgggggttcctgcaatcctctcttcaggtctaataatcccctaacatgactgacagagctcaggaaaacactttcatacacttgctgctttgttatgaaggataaaactcagggacagccaaatggaagcaaggcattggccaatgtatggcgggtggttgcaatgctcccctgccctctctgggcacctgaccctcccagcacctccatgtgctcaccaaactcaaagctccccaggccccttatgtagaggtttttatggagctttcttacgtaggtgtgagtgatgacatcactgacgattgctcattgaactcaatccaggccaaggtgccctccctggagatgagggggagggctgaaagttccagtcttgtttgtttgtttgtttgtttgttttgagatggagtctcgttctgttgcccaggttggagtgcagtggcatgatctcggctcactgcaacctccacctcccgggttcaagcgattctcctgcctcaccctcctgagtacctgggattacaggcgtgtgccatcacgcctggctaatttttctatttttagtagagacagggtctcatcatgttggccaggctggtcttgaactcctgacctcgtgatccacccgcctcagcctcccaaagtgctgggattacaggcgtgagccaccgtgcccagacctaatcttctaatcgcatatttggtctttctgatgtccagaccctgtcctaaagctatcctgggtccactagaggcatcttattaggttgaaaatggcttattaatgactcagaaattccaagtgttttaggagctccatgtcatgaactggggacaaaaaccaggtgtgtagtttttatgatgccatagctataaacagtcattgaaagacagtggggcattcttagcaacacacatacctgggctgattgaaatctcattcttgatttaagtctcattattgaattcaacttgactgcaattgcttaacgtgggacgtgcctgagacctcccagctagtaagtcagagagtcaaggctgagcctccaggtgcggctggaacagctcccagtgggaacatgtatctgcttcttatgtctggacatgtgtatgtctgcatgcttggcaccctgttacaaattcctctgcaacatgttcatttttccttagaatttcccccttgtggaagaattattccatagcttcaggctataaagccttcttcccagaaacaccatttttgttgttgttgtttaacctgagttattgttcactagaaaagtgaaggtgctgcactccataaccatgtcccagaagcgatcagagtatgttggcacttgcattcagttctgtatttacaaactgataaagacaaggtgaaatatttgccttgttaacatgagctgttcctatagctaaggcaattaaacggaatttcaagtacaggcagtccttgttttgcaaggtactctgttaatggaaacatggtgtttcatgtggggttttttggttttggttttgttttccttttgtttttcagatagggtcccctttgttgtccaggccataggcggtggtagcacaatcgtagttcactgcaacctccatttcctgggcgtcagcaatccttctgcctctgcctcccaagtagctgggaccataggcacacaccaccatgcgcagccgggtgtggcagctcacacctgtaatcccagcactttgggatgctgaggcaggaggatgcttgagcccagtagcttgagaccagccaggtcaacatagccagaccctgtctccacaaaaaattagccatgttttaaaatgtatatggaagcaaagtgtatgtggaaaccacatgctgccattgcatgggaccagttatggtgaaacccacagagcaagggccctcatgaggaggaatttctctcacaaggtaccctgcaaagaggcccatggaatgaattgtgttttaacatcttggtgttctcattgacaatgtttgttttagacttgtcaaagaaaaatgagcagttgcattttttaaaagtcatttagcttttagaaagttctaaacattttccttattattaatctacatttacttacagatatatttctcttgcagaaatgaaatgtttcctctcatgcttcttacttagagacagtgacacattgtgggtcttcctcctgtgatgtgcatattgtaatactaaaggaagtttttcccaagctcctgtcagggaagcagccctggttttgtacttggcgtttgtgtcaggaatacaggaggcagtggccaggggccgtgtggacgatcttggagctcttcagtcaggccctgctgctgcttcttgcccgcagtgtgggtgtgagctcacaggagcagcatgcctccagagttcaagggcattccattaaatcatcagtcactgaagagacttctgaatctcttagggaattgccttagggaattgatcatgccataggtgtcaccaggttaattaggcatagtagtagtagtagtcataggaaagtagtcaaaaacaagtaggatcaaagggttattaattatgttaaatattaattcccatcttactaggagaaagtgtccaacagagctgacattaaagaatcaagttttcactgagaatattttctaagttattcatgtatcattattttgttctaaaaaatatcaagcaaacataaggccaccttcagaagccccccagaaaccaccttcaggataatgagcacccatcgagtgaaagcacccgcccactgtgtgccaggcagggtgcgacatctgccaacacatcccctgaaggccagagacccagtgggtagagggcctccatgtgccgaacgccaggtcctgagacttgcgagtgtgagcacactcattgcttggtggggacttgagcgaccaagctgggaggcaccccagggctctctgttcccagccacaaaaatgccatcattgttgtgaaacaaaaatgatggcattgcttacatatcacttctagggttgatatttattacaagtaaaaccagaaatcggaaatcagtttttttttttttttttttttttgagacacagtcttgctctgttgcataggctggagtgcagtggcacgatctcggctcactgcaacctctgtctcctgggttcaagtgattctcctgtctcagcctcccaagtagctgggattacaggcacacgccaccacgcccggctaatttttttatttttagtagagatggggtttcaccatgttggccaggctggtcttgaattcctgacttcaggtgatctgcccacctcggcctcccaaagtgctgggattacaggagtgagccactgttccggctggaaatcaattttttacagcctagccatcactactttgcgtgttttagttttcttgtacttgttagtgttgttttaggagctgaatttcaggttttaaaaaaattatttttgtttttgtttttctgttctattttcaagaaagttatacatgttaaactgcataaacagatagagtagactcattttgccagcctaagttttgtgtatattcggtatctgtctttttttgtataataccagggttgaagttgtgagataatattcacaattaataaacaagggacgtggtagattctactctttttcgtggaaacctgcatatttcttaatgaataagggctaagtccacataaataggtagactgggctcatttcaaccagcctttagacatttctactcatagcccaaactattatgctatcaccttgttaagaatacagtcttacaggtggtggttcatgcctgtaatcccagcactttgggagtccaaggtgggaggatcacttgagctcaggagttcaagactagcctgggaaacatagtgaaaccgtgtctctacaaaatataataatgatgatgatgataaatttgccaggtgtggtggcgcctgcctgtagtctcagctacttaggaggctgaggtgggagaatcacctgagcctaggaggcggaagtttcagtgagccgagatcatgccactgccctccagcctgggtgacagagcaagactctgtctcaaaggaaaaaaaaaaaaaatagagagtacattctgggtggtgacttagggatacaggtgttctgtgaaattctttcaactctgctgtacgctggaccatctctacagtgcaatgttgggggaggcagctctgcctagtgtgacagtcagaccaaaagttcactcaggcacaaattagagcatcataggggaactggggatggcacagggcctgagataaatgctcagcgtttttacagagaagaacagagggtgggattagtgctgaacagaacaagtccaacaggagtgcagccaacacagaatcaatcgtgaggactttggaaaccaagcagaaaagtttacacatggtacaataggcatttgagctcactggaaattcttagaaggacacattggccatgtctgtgttttagagctcagtggagtactgggtgacagattagaaataggcagtaagggaggaggaagtgccaggtgtgattccaatgtgatttccttcagggaacttatagttcaattagaaaaaaataagtaatgtcaaaagttataggaggcttaggagaaagtgaaattaagaaaactgtcgctgggcatatattcatatcaacttgtaccaaatttgaagaactttttgcatctctgtgactctttcctagatttaaaaaaactgaaaaaaagatgtagctagttaaaaatacatgtatttttctaatacctgtaactgcatgtgacatttacacaaagtttcatcttaacttatccttatcgtacattgcatatgtcccaaaagaatgcagacaggagcaggcaggctgtcagtgtgagctgacctctgtaactggaacttcttttcctccgagaataatagagaacaaatagctgtatactacttatgtccaatttaaagttaatatttgggccaggcgtgatggctcacgcctgtaatcccagcactttgggaggccaaggtgggtggattacttgaggtcaggagtttgagacctgcctggccaacatggtgaaacctcatctctactaaaaatacaaaaatcagctaagtatggtggtgcacacctgtaatcccagctactcgggaggctgaggcaggagaatcgcctgaacccgggaggcagaggtgcagtgagccgagattgtgccattgcactccagcctgggtgacagagcaagactccttctccaaaaaaaaaaaaagttaatatttggtgaccagctgagctttgctggacctctggttttggggagattagatgttcttgaatcagcttcttaccctgcaacactgagttacgggcacagccacactggagctgctccagagggtgaggaccgtcacctgccattgtttgccaccctctgtgggcctcaggaccccacagcctgggtcctcattgctccagcctcaaggccacctcctcctgtcacccatcatcgctgaacaaaataggcatgcctctgctcacttgtccttggtattatttcatttccctttctcccttctttcgttatttaaaaaaccgtaataacaaggaccttcacggttactgtccttacacttcttttctttcattgaacttgcctttgggcttggtgtcccttctgaatttcctggcacgaggtcacttgcttaaaccaaatttcactgtcagaggaaatgtgtttcctctaccctcttaggtgcagtgattgggggcctgtaaatcagactaacaaaagacagactatcaagagtaaagatagatttgtatttacatacaacgaaggagttcacagaaaaatgtgactcaaggaggcagttagaatttcggatttgtatgtcatcttaacatggatgggagagaggcagaaggacacacagaagaataaacttttaggaaaacttttaggaaaactaagtgggccgttaggagactagatggtggataagatagttttataacaacatcttttggggcgatttctcatctaggtgtgacaggtgctgacttcttatctttggtgataagactcacacttccctggttgtgaaactcctgagcattggatgtatgagggctgagggctgaattcttctggaaggctttccttagaaagggaagggagtgcagaagccttctgttcctgtacttgatgcttactgtcttcagctctaataaccctcatgccactgtggcatgttcctcagtccatggaggccccatctgcttctccccaacaccccatcattactcccctgcccccttctctgaatgcccagcacccagcactaataagaggccctctgcctgccgagcgcacgtggcatccttgtttctaaacaaccctgaggtgcccggcccctggttctcaggtcctgcctttatccagcccgagtagccttacgtccgtgtccagaacactagccttggggcatcttgctctcccagatgacctcggtgtccctcagtcttgttcccacattagctgccaggtgccacaatccctgtttctgactgcatcctcgcctcctcacctcgcctcggggggcatttcatcctggcatctgccgctcctgactgctgaaaccacagacatccgtttcccacgctcctctgcaacgtctccctctgctggctgcaccatgcccatccgccctcatccactgctcccactgtttctctctgcacttcctctcacccaggaactcggttcagcaatccccaaatgtcagcatctgtgtgtgtgcaggtgttgttttggtgttcatctcactctgtcccatccccctgggtgatcttatctgctacttgttgtcactgtgcctgactcaaatcttggtttctggacatgggtagagtcctgggcccagtggtctggaaaggggccttgggaaaatcttatgtaaaagttcagccaggccacacttactaggagtctcaatagaggttctcctaccttaaatctactcttggggaccctgctgcttgtctgagccccaggctcatgaatctgcactgcctggaagtcatgagcacctctgaaaacacggccaacactccattttcccacattttccttcagcctgctcctgtccctccaggcaccctggagtccctcagccaaccttgaagcttctcattgcacgaggattctctctcctcacatgccgtctgcagccagcaacctcctttatccatccacttcttaggccctctcttctgaaaacctcccttgtcctcatttgtacgtttcttcccttcctgaattgaggctgtaggtagcagctgctgtgttgacttcaaggtctcattcccagcctgagaacacagactcctcccctgtccccacacccaaatcagaggctatcaatgcacgatatacggaagcagaagccaatagacacagaatccagtcactgattctgtaggtaaagaaacagattcacaccaagggactcaattcccctctgtaagcttttattgaacctttcgtgtacgtgccattttatcagattgcaagatgccaggaataccgagtgatttaggagcacacactgtcatttagttttaataatagccaatgtcatttcttattagaatttagtagttatttcttgctctttgattttcagttcttataaactttggcaaagaaaccctacattcccagctatagtgtggccttctatattagtctgttttcacgcttctaataaagacatacccaaaactgggtaatttatacaggaaagaggtttaacggactcacagttccacatgactggggaggcctcacaatcatggcggaaggcaaggagcagcaagtcatgtcttacatggatggcagtgggcaaaaagagagcttatgcagggaatctctcccttacaaaaccatcacatctcatgagacttactcactatcacgagaacagcatgagaaagacctacccccctgattcaattaccttccaccgagtccctcccataacatgtgggaattgtgggagctacaattcaagatgagatttgggtagggacacagccaaaccatatcaccttctttttcttttcccgtggtgttccccacaaatagagaaggcattcctcttctgtactgttatttcacaaaccctgactgacacttattctcgtgatccttgtctccatctcctgccactacagctgcagtgatgtcaatggggaggctgtctttttcaccttcaggctctccctctccccttgggcacatcatcagctttgataggaggtggagctgtgctttggccaggtcacagctcagtaagtgttctggcttcttggcagacccacagccacctgcgttcctccagactggtttccagggcttacagtcagcggcagaatctgtcctcctttgatggagagctgctcgtcattcttggggaacttggggcactgcagtgttgatttctagttcacagccctgcagagacctcgacacaggttgcatgcacacgggcccctgtactgttctgcagaattacgccagagctgagccattcctggggcatgagggtctctgggaaaacacaaattagaggcatgaggcccttctgcactctgtcaaatgcagagaagtgaagaaataatttcactaaatgctagagaaaaacagcaaatctcagaacagaatgaagttctgtcctctcataattactcttcatatgtcttgccttcagatatcttctttatgcttggctggagaaattccaggatggcactgtgccctgtgctttgtgtggagaaaatatgatggatgaatccctggtccactatttcccttttaaaggcagatacttgtatgacaatggaaaatgtaacaaaacttcatttaatcagcactgtgtgtgtgtgcgcatgcatgtgcgcacacgtgtgtgtgtttatgtgtgtgtgattgatatgtgttatggaaaaagctcatgtctctggaaatactttccagcaaaaaacatctaatagcttaatctttatagcagtgctggttttggccctttaacttccccgaagttgtaaaccaaaaaattgcagtctccatatatgttttattgcatcctctaaaacaggagtccccaatcccctggccatggaccagtactccatggcccgttaggaagcagggcgcacagcaggaagtgagcggcgagtgagccagcattaccacctgagctccgcctcctgtctgatcagaggccacattagattctcacaggagcctgaaccctagtgtgaactgtacatgcaggggatctgagttgtgtgctccgtatgagaatctaatgcctgatgatctgaggtggaacagtttcatcccaaaaccagcccctttcaccccccacctatctaggaaaaattgtcctctacgaaaccggttcctggtgccaaaatgctggggaccactgctctaaaacatgtatttttttatttctggactgtcactcaaatgcctcaaaaaaatccatgcctcgtagttccttgaaacactttttaaaagaactagtagccactattagtacaaatgccactaccctactcggggcatttcattaggttggctggtaaccagctgtgcattttttgtaatgatactgtgttcactgagtctttttgatagcaaggtttcagacaactagccagtaaaaatacaatctagtcactattcccccatacactagtgcatcaagttcgttggtcctgcattaccagttgtcttttacaattgtgtcaattttcaaaatatcttttagcttttaactagtaattattactaataattattggatgttttgggctaaaaccttgctaaatgtttagcatctcatttaatgtagtaccacagattattggcaaatttgggcattgtttctcttcactgcgattggaggagaatggtgtattgaatacagagaacacgtgacccataagtagcactagtgctgtttgtatgtatggctccccaccttgcattgcataacattgctgtagttgaggaatccgctttttaaaagtgtttggcctgggctaatttgcaataaagcccgtgaactctcccacccctggacatgttgtaccttccttgtaccttcctcacccgatctggcctccacaatgcttgtgtacacattctcggacttgccctcacccaaactagaatagggagaataaccagtgaattcagcctcgttatgtttggggatttatgcgaggatcaaggtggcatttcagattgttgtgaaacagatggatcagtcaggaaataataccggggtagatgtcttgccagtggagagggggacataaaccccaaggctctggcttacttccaacactaaggtgaatcctactccaatcaaatattaacatgtaaaactcgaaccaagtctccttctggtgataggacctaagcaagctgcgctaactctccccttaagaacagtgagaaaaactggacaaaaactcgaaagcatctttttgaagggatctgattacccagcaggtagggaacggtgggaccctttacccctagagctgtccccagaagaagtggctaatgagaatgagaagcccgagtttgttttttgttttttgttttttctttttttggtttgggggcaggggggctgaggtgggagaatcacttgaacccaggaggaggaggttgcagtgagctgagatcacgtctcttatatagaacctagtttgaaaaggaagggatattttaagtcttttaagataatgttaactatttttctttctttagctctatttctgtgtgtagctgttttactacaccagaattcagcaagtgatagtttcttaagagttagttgctatgtggaaattgaagccctatcagtaaccttttcctcctcgtgtatcttcaaatctattaccgagccttaaactttgaatggatcttgtatccctagcttattcaagggttaagaaaatacgttttctgtagaaaagaagacatgttctgtggctcatccagagtattatttgagctgcatgtctatagtttaatcacatactattggaggtcttcctgggagatgctggaggcccaggagtcaaggggctctgtgtgccgttctccaaacacagctctctagaaagaaggttccagcatgactcaggagaggttggtgcaaactgggaccctctgggcacctctcagggacacagactgtccagctggttacggaagcacatctcccacctgatttattcctaaataggagcgaggagggggacaatctttcccttcacccccacatcttcctttcctcttccctacctccctgtattaatactgagaaaccacacctgaacaatgaaatgactaggaactacggtttctggttgtgttcccaagtgggaatatgggctgttcacgacctcggaatgtagaatgccctcattatttattcagtagacatccaataaatgcggatcaacagcttgcctatctttgatagtttttggcagtgtgtgctggttttaatctttgtacttgtcccataagtgaccccatgactagagagtgggctcttccatcttgtaagagccttctgttcacgttctgttctttttatgagaaggaagttccagtgcatatcccaacataaagagaaacgttgaatacgtactgtttttctcttatatatatgctcaaaataacgactgtagtaaacagtcgtcatgattataggatgaattacgcagccattcatagatttttgtagttgtcatttacaagtggactatgcaatagttcataggcttatgaatacataatctaacaatattagctgggtgcagtggctcacacctgaaatcccagcacttagcgaggccaaggtagcttgattgctagagcccaggagttcaagactagcccgggcaaagggcaaaaccccatctctacaaaaactacaaaaagaaattagccgggcatggtggtgcttcccggtagtcccagctacttgggaggcaaaggtgggaaggtcacctgagcctgggggtgtcaaggctgcagtgagctgtgattgcaccactgcacccgagcctgggcgacagagtgagaccctgtctcaaaaacaaacaaacaatattatacttgtagtatttaaaaaacataattatctggtattcccatagctaatggaatgaaaggggagactttatctccctagacaggaagcacggtacctcctacactctcttctccccacatcaactggataggtgtgtgaacgcatttcaaagtcaagtatggttagtaattacttgatctttttccagccccttcagataagctgaattgaacacccaaaagtgatagtaacatcattttcctttgcaattacaaagaccattaacccaacagaatctccatgctttacctgtttgtgatgtttttgttccattttattaagtatgactcctgataaatgaatcactacacaattaattttttctcattctttagattcatacacacagacacatatatcaagcaaactataaattgctaaaatgacaggccagcagtgactacttgttatcacgtgtgtaacatctcttgagggctgctttgtaattcatttgtatggtgttgttgtaccagtgtaactgctaagtggtttctctggttccatgtgcatttgtacatgaagttgtgcaatctccacataccagcagtttcaaagaatgacagtttgcatgaggccatcttaatagcaggtagcatgtaaccaacccatctgaattaagccaccattgcagaataaaacatttgacactaagccaggtatttcagtggatgagttgtattttggatttccaaaaaaaaaaaaaaaaaaaaaaattaagcagtcatgctctcgaataatcttactagacataaacaatactgctagggtaggggggcactgcctttaacaatggtcagagtttcttggtaaatcagtggttttgcttctttgatgtttctaaaacactgatatgcccagttgccctgctctgacctcatctcaccctccccagcttccctccccacccacctcgtaaagcacagacctctcagcctgaccccttgctccctacctcactcattacttctggtttccttttggggccttgtcttctgcctgcccccagtacaatgtttatttttctgcatgtccatctcatcctgacaagcctctccacactggagtgcagccagtagctgtctctgctaagctcttccctctgcctgcatttctcaccccacacacaccttccatttcccagtggctacatacatcatgtgcgattatgcctgtctttcatgacctgcctctgaccagacatccctgagtcatcttccctaaacccactccttcaaatccaccttccaaatcctggtgaatggactgctgtccctgctccagaggactgtgtgcctcaaacagggctccccacagtgggcttgtattagcagggattccccagtgcatgtttcctgccttggagaccatgaactccagggaggctggagagctgtctgctctgctttctgtcttctgcctgcccaagacagtactttatgtaggtgttaatttcctaaaaatatgtctaacatgcttgaattgctgatagctattgattaaagcccagcttctaatataaatatgcatttctgatgaatctcacaaaaaaacaggaagaaacaaatgccattaatttgcagtttatcaatatcctggctagtaattgagatatttagtggcatagtcactagaatataaggtgctagtcccagtcccaacacgagcttgagtaattttaaacttcatagtgaattttttgtaacgtctacagaatggatcaccattatcataataatagctgatagcgacggagcatgtcccatctgccaagcactggatatcgttgattcattcatttataaaatttgaagttggtgggagggcatatttaaagactgctacctggaatagtgttatttgtcagagattcatttgtttgttctccacattcttcaatatatgaattattccatgcaattgaacagctccccaagtacgtcatagttatgaaatgttgtgtgttgactttggaaggttacagttcatttgtgatcttccaggcagcgggggtgggggtggggggattcttctctgtagtgaaagtgtttttctctgaaatcttcagctactttcctactctgtgaagccttcttctcctgggtcagtgggacccttccttgagagtggtttcagtaggttctccaaaaactgttcaactgagtaaaattgaatagaatagtccatgcattttgtcccaaggtataaaaattggctttggggaggtgaaaatgaaaccttacttttttttaatgtatcaagcaccaatacacatacagaaaaatatagtgtatctgtgttattataacatgttatggggatagactgttggggaaaaataactggaaaagcttttttgggggtgatcatgaatgaaatggttgagaaacactgagttagtcatacacagtatcagacaagtactgtgtcagtagccccagtaatttccaccctcaggccaggccccacatccagcacattctcgctcttctctagcccccacagccaggtcagtcttctagcccaggctccatcggcatctcaggttagagaaaggaaggcaagatgccttccacctctgttttccaggattgagaatatgctcacgcccctctctatctaaaggaaaggagagagggatggaccaggccctgtgttgccctcacaggtgccctgggcgccattttgtcatgagtggtcagcagagcccattgccgaggggcctagggagggtgccctcacagagctggtcccttcagttctgaattaagcagtagcctcaatgccatgtaagcaaccattcctgcaagaggataggcatttaaggtgaaatctgcctcatctgtcgttatttacaggtaagattcagaatagttcaagaaaacaaggcaaatgaattgcatttgcattgacgtgagtcatgccacattcagctactctttgtgaaaacgtccccaaaatagattcctcggagtgctgctttgcgggaccttcattgatttgctctgaagataggtgtccatgcctgagaggcctcagtgaggtttcaactacacagttatccatggcagcacttctggaaacatttctgtgctaattgtacatggcaggtccccagttcctcatttaatgggaggaatctcctttttctggaaaatttctctggactgctgtgtcacagaacattctagaaaccccttaccccatgaacattctactactagacaatttagaattgaacgttaatatgggcatgggaggccagtgaaaacaacataagcctcacctggtactgcaacacatctttgtttgggaaacactgactttgcaaccacagctataaacaccggcttttatttcaggagtcagcagttactatatttgcaggaaggagaactgagggcatccctgtgaaaaccagaaaataaatccatcctgaagggcattggctttgtaggcctctcatcccctgttgagtaggttgctgggccatgcacaacgggtgtcagtatggaaaggaccaaggagaggaccgaagagaggcctctgcattgccagctgccacgtgctcaccacacagacagctcattggctcatccaccagctcatttaatcacgaagtcttttaatcccctccaggtccaatgaattccttaggcttttttctctgtgtttatcagttcccattataaatggcagcttcttctacatggcacatttggagatgacatggaaaaatcactcacacaggccagcaaaggcactctctttatgctgtgataatcctgtttggggaagccccctctgtagcttctctcaaaagcaggcaaacatcgctgtgcttttgctgtcctgacaatgtgtggagtcatattatacagcaagcataccacaagcaagtcacatctaaggcacctaaatgtggtttttccataacgaaagtgctgttgaaaataaacacaacttgctgctctacaggttagagcattttaatcccgtacatggctaatcttcccgagtctgtctgaagtcataatgtccctctaaacacacaaaaccgataggggcctcccgtcacacttgcggatcatgagtctcatgcagaaggctacgtaagatgaattgatttcacatgttttactcagaggatgtggaaaaagaaaatgattctagtgaccatctagaaacttgcggtttgtttttgactttaagacagtcagcacctttcagggccttgctgggttttcactggtttctgacagattggtggacgcggcatctgtaccattaaaagaggaaatcaggaaggttttttgagctgtcttgaagtcttttgctcaccacttaatttacatacatacactttaatatgcatgctaagagtgcccgtaatgtacttttattgagtaaaatgacacagagagaattcgttaggaagctttcctgcccaccccccaaccaagtcgttaaataactttttcaaaggctgttctctataggagaaggaatcaatttaggggtgtagttcattcatttacctagcttgtaactctaaagggttttgttataaacatgtttatatcaataatggttttatagtttgattttcagagcactatcgattcagtaaaacagtagctctgcggtgcacaagggatactgacctccacctcagcactattacttagaggaatgcagcaccatatgtagcttactagtaggtaggtggatgtttggatgaaggaagggagagcaggaggaagggagggatggatagattgataaatagggatggatggacagatggatggattgatgaataatataaacaaaagtactaattaataacaaaatacacacatacctcagcagtcattttgacagcagtacttaaaagtttcatgtttaaacaaacatctaatagtgtatatgtatccaacatgacaacattgtggtacttatttacagatcactgtctgacaaggaacatgaagtcaaacagaacttaaaccttagatatgagcactgccaatcaaaattaaaaacaaagtttaaggcccccttgaagttttgatgtctcaccatgtgaaaattgaacttcatattacaaaattaatgcataggaaaaaacctcctatgaaaaagcctggttttggtgatgagattcagatcatacatggctttataattgatgaatagttgtgagcagctgctgtactttctgtgcttccatgtaattccaggaccgcttctgggagccctgaaagtacccttcagtgacttccttccaaatgttgtatttcactaagcaaaagggaaagctttattccttagagatgatatagtaatatttggaaagctcactagttccaatgaagcacataatttaaaacagacacatcatagtttaaaaggtaaaatcggttacgaaatgtgatcccaagtaggcacgggcagcactctgcctgtggcctggaggaggtcccggtgtgcaggattggaaaggggctggctccttccctgctgtgactgttctgtctgcttcccgatgggacgtgctgttgatcccagctgctgagaagaaatggtgggcaagtgccacggggacaggatttgcagcagggaggagccaaaggtggaagcatcaccgggaagtgagacctggggaggaacacgagagcatcacaagccgcgggcccttctccttccctcttgaaaacctaacctagctcctgacactgcctcctactgtgttcccttcctgcccaaactgtacctagagctccatccatagacctcgtctgctcaccgcacagaaatgccagggctgccgggatcccttctcagcgctcctccttctgtctaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatggcggccccaagacccaccacatcagaaacatgagaatcagcttctccatcaggcttaacatcccaggtatcatccagttccctattgcttctcagtttttcctctaatcccatccatttttattcattgctcttgtgtttggactgtttccctcccccaattcagatgctgaaatcctcacccccagtgtaatgcgttagggggagaccagggagccagagaccacgctggctccctgatctcacaccgcctggccccagacctatgggaaatccctgtctggggtttaagccacccagtctgtggtattttcttacagtaacctgaagggactaagacaccctgctgctgtcagacaaagatactcttatgtgcaacttgctagttataaaatggaacttttaagctatatgatatttgtcttttaagaaattaaagtacaaggactttttaagtcccctggacagagaccatccccaggtcgctgctgcgcttcaacatcgttggagaagtcagttcatcacctccaagtgataagccgccaaggtgcttcacctcccttgtcgttggaaatgtcatgctccctaaattaaatccctcaagctacagtttaattaagctcatctcctcgcctggagatggaaatcagatatattttagccttcagctgggtagagtgaaaagaacattggattctgcagacctggattctattcaagagttctgtcttccgcctgactgcatgacctccagcttgcctctgaacttcccttgcactaagcagaggagatgctgcatttgctctgtctattccctagcgctgactttccatggcccctttgtggctctaagtcctgtacccaggacacctccaccatcttcactaatttagcagacgttcatcagtgctcacgatttgccatggcatcctgggaaggtgcgtgaaaactgggccttgcctagttacagccgatatgtaggctgtacaagctgcgtcaagaatattcttgaccagatacttccttgaagatgtggaagtcagccttagaaggtccactaaatacactacaaaatgatcacaaaattaattaaaatcatatagaatatgcatgcatacacacacatccatgtgcatgtcctgacacagagatgatatgtggggtgaaggagggagatttcagggtaggccgcaggcctgccgggagcatgtgcaggtggcagcgccatcccctggaccaaaccccagttctccggcttcactgaaggtgcaggagccctgctagaaaagagaagggagccgtgggcacttccaccttccctgtccctggccaccaccctcaaaggagcaacccaccaagtccgtgcagagaaaagtcagtctgcctccactccccacttgcagaggctgaagtcccttggcttagagagaaaagtttctttctacagatgcaaacatacgaatccatgattcactgtatgggtggtggtatgaatgagttttaggtcaagtgtaattggtcagtcatggtgggacaggaagggctgccccctaagtgaaaacatgaggtgcttaaaaggaagcatgagagccaggtgcttaaaaggaagcatgagagccaggtgcttaaaaggaagcatgagagccaagttcagtcagggtgaacctcctttccctgtagctgggtgtggcagacggaaactgtgttgagatatttctgccttcgaagataagaaacatacttcttccttaattttatttgtgcaaaatataaactgtatttagcttatattctttctttttttgatgcttaagtcctgtgattaccagacacagttgttccaagatagcttttaaggatttattcttaaatccttaagtttcagtagacagacagccatgctgtgaacattctttaaatggttaggcttttagataccaggtacttttcttgtaggtgtggtcctatttacaagtgcattagatctttgggtgtaacgaagtctaaagacgacataaaaatcttttggggctgggcacggtgggtcacgcctgtaatcccagcactctgagaggccgagatgggtggatcagttgaggtcaagagttcaagaccagcctggccaacatggcgaaaccccatctctattaaaaatacaaaaaaaaattagccgagtgtggtggtgcatgcctgtaatcccagctactcgagaggctgaggcaggagaattgcttgaacccgggaggtggaggttgcagtgagctaagatcttgccattgcaccccagcctgggtgacagagccagattatgtctcaaaaaacaacaacaaaaaaagaaaataaataaaccttttgggacatttttaataggtgcttcaggacacagtagttgttctgctttataattctactgtttctaggggaaaaaaaccaaaccaacaaaacccaaacttccagatgctgtggcatgaccccgaatcatttcccacgtgcaggctgtgtgtgtggtgcagttgccatctgggcctagcaccagggggtttcttctcaggactcatgtttgatgtcttctctttgtcctgtgtctggggctttctttaaattttgtgtgcaaacaatgcctggtattacaggctgttttcctgtaaaccactcacttctgctccactcctgttctgttgagttttcctggcacgtttccatcatcgaccacctccagctgactattctatcagcttttgaaacttcaggttccgttttcaaattccatcttgatcaaatggaattctcgttagcggacatgaagtgtaagagtccggcaaatgttggggaaaggtatctcctgacagctgttagcaaagcggccacatgagaggaggaagaagagggtttcaggtgccaggggtgtcatgtatcccattgctgtttgttttgggctgagatcacccatggctgtttacatcagaggctgtacttacttttgaccttttagaatagttaactctgcaagggtcttgtgctggaaaacccaagccaactggcctgtcttcctaggtttcccctcaatcatttgaacactgagggttttacttactcacatggacatatttcaaatggcccttctgttgcataagcttattatgtcaccttctctctttttttctttttttttttttgagacggagtctcactctgtggcccagtctggaatgcagtggcacgatcttgactcactgcaacctctacctcctgggttcaagccattctcctgccttagcttccagagtagctgggaatacaggcatgcgccaccatgcttggctaattttttaattttttggtagcgatgtgattttaccatgttggccaggctggtctggaactcctgacctcaagtgatccgcgtacctcggcctcccaaaatacaggtgtgagccactgcgcccagcctacgtcaccttcttattgtgattgattgtgatagcaaccagttaccaaccttgacttttcgccactcttcatgcttattcgagtcccccttactttatgtacgacatttgtcttacatgttgtgtgtagtattccagatgtcagtgccattttggattattcttaaaaataggtgaggacagattaattgaacacagaggaaccagcaaaacgtgaaagccatgagaaacagtaaaaaggtctccaagagctggtgtcagctgctcctgctgtcagtgccgcagacacttgcaagtttccctcctcactcacagccctcacttagttgcctttaaacaggggctgcctttgaaaagatttctcaggtgtgaagggacaccatggggcctgcatttccctccactgcagaccccctgtattagtccattttcacactgctgataaagacatacccaagactgggtaaattacaaagaaaaagaggtttaatggactcacagttccacatgaatgaggaggcctcacaatcatggcagaaggtgaaaggtatgtcttgcatggcagcaggcaagagagagaataagagccaagcgaaaggggtttccccttataaaaccatcagatcttgtgagacttattcactaccatgagaatagtatggggaaaactgcccccatgattcaattgtctcccaccaggtccctcccacaacacgtggggattctgggagctacatttcaagatgagatttgagtagggacacagcaaaactgtatgaccccctttaggtgagtgcaggtgtattgggtgccttccattatctctttgggaacagccacagtcagctactgatttcccgtcccacacacctgtcttgctccttggaagcagcctcacgcaaatagagaataaaagctgctttcacaactttagccaagcagtgttaccccaggggataatccatctcttcctctaccccagtccacatttcacaggtggaccctgcacaaagcttcagaatccccggagaaggtgacggatattttgaaatgtcatttgacatttaagtgcctatctctggtcccagataaaaacagtggagggcatttagaatacaatcaagtcataacttttaaaaaggcaagggcagaaatatcatgaacaggtagtcactgaatgagataacagagaaaaccaacttggacagtctaagtggagtcatttcttctcgcgtcctacggtgaccagtgtctcacaggagaaagaaaccagggggcatcagaggctgttggaagggaggtgttgggacggactactgtggcttgcctgggactgtccaggttgtagcacggaacatcctgccccacagctgacccttcagttccaagcaaaccgaaacagctgggccaaccaagttccctctgtgaaagtaaggtagcattcacattccattgtcacatggattaactcacttaatccagggttcagccctgttgggataagttggctaatatgatattttagccccagattgaaggaaagaatggggtaatggaaagaaaaagggagggagggaaaaagaaaaaagtcattgtgctggctacagcacagaccactagtagttaagactgtgtgtgtgtgtcagtgttttctactgaaaacgccaaagaatgcagagcttctctttcagacctggcatcaggcttccgtgagccctttccaggacaccagtgcattgagtcgctgctatatacctggtgatgagccgaagaggacattttcataatgaaaggcaaagggggccaggtgtggtggcacacacctgtaatcccagcactttgggaggccgaggcgggcagatcacttgagtccaggagttggagaccagcctggccaacatggtgaaaccctgtctctactgaaaaatacaaaaaaaaattagccggcttggtgatgcatgcctgtagtcccagctgcttgggaggctgaggcatgagaattgcttgagcctgggaggtagaggctgcagtgagccgagatcgcaccactgcacttcagcctgggtgagagagcaagactctgtctcaccaaaaaaaaaaaaagaaaatgcagagggacaaaggagacaaagaagagatgagtggagagctgaaaggccccacctcaacaactcgtggagttctaggccacatgtggagaagagcaggggagactcctcagcataggtcgccatggcgaggacctctcttcccttacagatgtctgggcctctgcagagtctcagttaaaaagcatcagtacatctgttttcacatgaagtgtgtgccattctaggaatgcagggaagaagcttccttcctaagtgtatgtcttcctgagagggtcggtgatatgaagatagcacatgtggattatgcttgtttatactatggagcaggctctggggtgtctcctttggagggagccctcatgtgaaacttactgtaacattgtcaatgtggtggcacctttaggagctcactgataaatgcagtgtacaaacaccccattttatgtattggtttttcttttagtactttatttttttcctttttaattttaatttttattttaatagtctgtagggtacaggtggcttttggttacatggataagttctttagcagtgatttctgagattttagcacacacgtcaaccgaacagtgtgcactgtacccagtatgtagtcttttcttcctcaccccgctagtccccaaaatgcattatatagaattcttatggcttcccatcctcatagcttagattccacttataagtgagagcatacgatatttggatttccattcctgagttacttagaataatggcctccagctccatccatgttgctgcagaagacattatttcattcctttttatgtctgagtagtattccatggtgtatatatgccacattttctttatccgctcattggtggatgggcacttaggttggttccatatctttgcagttgccagtaggaaacaccccattttcaatgtgggtatctgaatgaagagaccacgggttttggatggtgttgtgtctgtaatcccaataataaagtggattttcgcgattatccaaaagagagcatgcacgcacactacgttttcgtgctcatttgtcacgtcacactagcacacacaggaactgaatttttaacttaaaagattctaaccatttaattttcaaaccacagtacataaaacaggagcagctctgaagtggttttatattttaagagcatgatttttagttttgcaattgcctctcacactctgaatgttcaattattgattgaacagattgttatgatcccaataaaataataaagttttaagctgagaatcttgcctcaccacacagctgcgctccatttcaacaatgctttggctgcaacagaaacctctcccctttaaaggagccacggcggggagacccccggagccagtaagaaacagcatgctgtcctcaccacaatctctactctggggagcccccactgtaattctgtctctttctgcacagttgcagagccaatggtgacgacgataataaacacttcatccacatgtctggttccataaaaggccatctcgactttctttttcttcctacagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgttgatatttgtatgagagtcatgattttaccttaaaaagaaaaaaacagtcttccaagaaatgtaaaatatatatgtgactaattaaattttttaaaaatcccaattagtactccaactgtaaacggatatttatatattttaagtgagccgtcctgctcctgcagtggtgaatagaggctttcaatgaaagacttacttctttgatttagtatcttctccttcccaagtatttatgttggtgttttctaatcattaagccattttgtatgaataagacaaatgggtgtaatgcatatctaagtgatgtgcatctacatctgggtgaatttcctacagggtaaatttgatctcatgtccgttactgttttttaaccaaagctgctgccagattcttatatttttagacaaaggacacacactgatgcttggccaaagcacatacgttcttttttattcttccacattagccaaattgcttcaatacattttagtgatgttactccattgaatagctcatggatttcacagagatatggtaatacaaatttacactagagtgatacatgccaaggaagtttaaagagtaattatactttcatagctcattgaaagtatgtcgtattagggacacacagtgattagtagaatgtatacaggtgtgctgtaactagcagctaatgtttgcttatatattgtgtgcccctaggaaggacctgttatactgctgatatcatccaagagatggcgctatcaacgtcatcttaatttcacttaaatgaaacatacacaacacttaagaacttactgattactacttattagactttttttccacctcataaatcctcagatggagtttggtgttttatataaaaaaataatctggaagacacctgtcttatacttgaaagaatcggcattctaaggaataggagtgatgctgctgtgcaacagtagtcagtgtctagacactgcagtttatatttctttgattacatttggcagttatgctaaatttggcacattttatatggtgtttcaaaattttaaaaaacgtgcacattagaacaagttttgtaatgaaaaataatgagttttcacctatctgtaataatgcctctgcagaacattgttctgtagtctgcactgtactcttctgctccacaagcagtcggctaaagctccttggtctcacatgagactctttgtctcacaagcaatctctagaactattatcttctaaaaagagaaaatgaagtgttaaagaacaagggatattagtatcatttcaaagtctgtagtattctctggtggttattgttggttggagagacttgctttacgaagatgttggtgagaatatttgttgactgaggagtacacgttatctctgaaagcagatcttcaggatggctcaaaatattctggttctttatgagtctcttgaatagataatattttgtacacataagcaatattatttttttctccttcattagccacacaatatttccatggattgtaattgttttcatcagaaaaactgttatccagatagaattaattcaggaaatactgtttacttacatgacagtcattgtagatgtacaaaactgaataagaacataacttagggtattttgtctgttaaactttagtcatgacatgttggggttggtttcgagatctttttccagcaccatggaaaacacaagggacagagagaagtgttggaattcgcagtgagatcattgtgttacctgttccgatttaattgctcctcaaattaactacatttttttctgtacatcttttgacctaagttgtttgtgaaggattaagtcgttgcctccctttccttggttcccaacagtatggcaggggcttctcacagagtccttttgaaactgtaaaactatcacccttgtattaaagcattggatattcttcattgcaaaatgcccataattttcaagttctacattaatttcaacaacatggtata

SEQ ID NO: 14090 - DNA, 108441 bp, Human
gtggagcagggagaccctgaagcccagggcgagggctgccgggttgccctggatagccaatgtttgctcaggctggggagacccggagacggtggctggggtgtcctcagcccgggagagctgagtcagccgcgccccgcacacagcatacttaggagccaaggacttggacctcgcttctcgccggtccgcgagacgagtattaggattgggatttgaagggacctcataaagcgcatcgcagcctggggcgaggtggggggcggggaagcacacccgaaaccgcgctggcgaccgaggcagccggggcatgccctcgccgagcctcgccgtccccataggtgagatgtccggtggcgctgggtcccggatagattgtgttcccggggctctctctgggttctgcaggcgacccccaactccccccgcgcgccctccagggtcctgacttttctccttgtatctccacagccgcacggttgtttatggagctttgggcgggggctgagcccgcggtcgtgcccccagcccgctgcccaggccatgccgccccatctgcgcgcggagcctcggctgccgggcctccggggctgagccgggagcgccgtgaggaggaggcgccggcggcggatcaggagcgggagccgtggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatcaggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtggtaagtcttgctctgagatttgcccagaactcatgctgatttcagcagacttttgatgccctatgcatccctttttcttaactttctacacagtcatgaaaactcagaccagggccctgggacagtcacagtgaataattctgtccaggtgtgtttgctgaggtggaagcagaggcactgaccatgcattttagcttggacagtgaatctgagtctttctactatttccatgcatatcttaaaaaacaagttttaaaagtatttcatgtaggtcaccacgcttcttgggaaaataatattcataaatgtcaccaaaaacttctggactaatccccaaagatagtgaactgagctactgagtgtagtttttgtctgatcaggtgaaacacttaactctgtgtttcattcaggccaaagaaaattgacaaggatatcatcaaattaagttagcctctactaataagccaggaaaatgagtgatgtgaatctatgacaggaccctgaaacctgtagatgtggttgtggccagtcaactgggtgaggaatcactgagcctcagtaagttaagccagaccattgcaatatttgtgtggtcagtgtaaccaaggtgcagtttgatgtatgaattaaatgaaaaccatactttgagctaagcagatggtttcttcagtatcataggcacctgagtgttatctccggagtaggtacctcctaatggatgtacatgtcagttggtacaggttgacatttcaggtatgttttcacgtgcctctggtttgggtcatcacactgacatcttgttctggttatggcagtagacaggagtttatttctattacatggttaatcgaacttgtaggctgcttttactcttaggaggatcagagtatcttacagaagacataggagttgaagctagcacttctgaaaaggtctgggctttctcttagcttttccagagagcatggggaatttcctagttcagtgtgccaggggtggttgtgctatattgggggaaagtctgcattttattatagtaggtagccttccgatttcatcttgaatatcaaatactcttcactgtacctcaataactttctccaccacgactgggagctttatgtttctactctgcattcttcactaaggtattttggaccacaaaacatactcctctctgattccctattcacgaatcacagtctggatttttgaagaccaggcattccttttcatgaaactctgctttttgctgatgatctggaggcaaatgtgtatgcaaaatcgccccaatcagcctggcattttgtggctaggacagggcccctgggcattatgcacctgctgtcaggcataggcgcaccacctttagagggggaagcggtccacctggaaggggatggtggtcaagggcaggtgggaaatacttctttctgaaggcatgggccagatttctctttctgcccagcagttagaggtctactgaataagagatggtcccccgtcccatccctcccagttgcttttgaactcctgaagcatagctgaaacagccaaagtcactttaacttgttccctgactgtccattcaccctttctagtggtagattagcaacttctattggctggttgtcaaaacagtttgtgtcccgatgtttgaaaacggctcttgtctagaagagaattaacagggagatcaataacgacaggtgacttttttttccatttgccagaacgatgccatttgagaaaccagagggttaagtggtgtttttaagttagtgaacatatccagaggtagaaacgaggccagcctgttgtccagtctacctcccacctttaaacaggttttcagacacccgcagagcagagccagggaaaaatcccctgccggctttgctctctgaatcacatgagactggtgggaagtggggtgggtgtgtgtgtgtgtgtgtaggggggtaagggtgggtaaccaactggaaattatgggatcctagggacttttgagctttggttgagtgcttgcacgataagcaaagttttcttcttgtacagattgttacgctggagccttatctgtgacacccaaacatcagctcattgggtcaaaaatcacttgattacctgcaatagatattttgtctacagaaggccagacatcttgatggagtgagtcttttggctgggcctttctgtgtttgatagataaaagccccaccagctctgtctgaggttctaccaaactgatgtagcattctcttttctggactttgctgtgtctgtccagctactgcacaacgctatagctgcacactctcatgcttgctcacacttgcttacacttgccctcacacatgccctcacacatgctcacacttaccctcctatgctcacacaggttcccccttgctcaccccactcacacaggtctgaaatggcatgttcagcgttccagtcacataaccaacccctggccctcagacccacactagacactgagattgtttctgtgctgccctaccttcccacagagttaagcctttcgggcctcctgtggcgctttcttcatccttgctgaggaatgagtgtgtatgacttggtgtgcaggcagggggtgacagtatatctgcttagtagggatcagacacttgaaatttgctcagaaatagttgcattacacgcccagtgtgcaatggctgaaattcaggcacattcatgcttactgttctctgagatctgaacaaaatcaaattgcactgagcaaggatagtgctcaatcttttgttctttctgacaactaaaaattaaccagcggttgtttacttccctatataattctgtttaagagaatctggaccattgagacaccaggcttaaaatgttgtattaagatataaaagtaccttactttaaaaatagatttttattgatttatttcaaaattgttctgtcagttatatgtacaaaaaaaaaaaaaacaaaagaacgctgggcacggtggctcatgcctgtaatcccagcactttcggaggccaaggcgggtggatcacttgaggtcaggagttcaaaaccagcctggccaacatggtgaaaccccgtctctactaaaaatacaaaaattagctggcgtggtcgcgggcgcctgtaatcccagctacttgggaggctaaggcaggagaattgcttgaacactggaggtagaggttgcaatgaggcgagattgtaccactgcactgcagcctgggctacagagtgagactccgtttcaaaacaaaacaaaaaacaaaaacaaaaaacactggcctaattacctgtggggtgtataaagaagtgtaatacaaaacccttggcttcatggtgcttactgttttttaaaggccattggaattttgtttccttcgctttttttttttttttttttgatgttgactagttttgttgtcttttttttttctgagtgaaaaacgaactcatacacatagtaaaaaatccaaacagtttaacatggttttatgtggttttgaaaagtgtgtaaaaattttagtttggggtaaaccaaactaaaatttaaaagcctagaggggcactttaaaaaatgcatctgttggtgaatacttttaagtggaaaattcttttctagatgagaatgttgaaagctcagatttgtggggttatgagctcaggttgcatatgctgttttctgaagatggggtacccttcttctctcaggtacatggagaggatctttctggcaagggctcagcagctttgagatctgggaggaccccgagtcatttattttgggttctgggtatgactgatctgtttggggatgaggaaataaacactcagaaagtcaaagggaaccaaggacacactcatgggctctgcttctctagcttagttttctcctctgaaaatgtgggtattgtatgggaatgatctcatggggtcatctagttctgtctgtgactatgtaattgaagacatctgatttaaagcctagtgtttgtattagggtatcagaaaatgcgacaagacttcttaggtgtgggtttccggcactgaggccaaaactgggcacttttacttttgtgcttttgcttgagaccaattgattgatctgcctatcttctatctctttgccataagaaaggctctttgtaatttcatactgaaaaagtatcatcaaaataaatcatcagtaccatacctaagattatcattaataattagtctggtggtagagacagctggtaggatgccagaacattaacctgaacagtaaaagattcattctgtttaaaaacaaaaagcagggcattgtcccccctcagatactgaagtctagaaactgaggccttgcccacacagagccaaaacatcacttcaaagaccttgtcttatcaaagataaaagtattcagccagcttaaaacattttcaagtaaaggtgaggtatacagacaaagagagattgattctaagcgttgctacttatcatgcaaatgcttagactttgcaaaacatacagctcaagactcacccgcttttaggtactacaagaaaacattaaaccagtcagtcggtgtttttagagaaatatatttgaggtgttacataagtcattttcagaatttttgtttttaagtgctgaattgctacagagtcacttttctgattttgttggcacatacctgttaaatgcagttccagattagattagtactggctagtttatttatattcctaggagtattgacaacattgtttaggcttattttattttgtcaggtctcaatttagttatctaaaggtagaattttaaggtatttaatggaaagaattttatatcttggtggaaaaaaaactacagactttggataatcaggaggtggttcagaattaacttgggaagtcttctaaagcatgttgtgatcgcagcctcagggtagaaggttctgtggattttggtgggagaggagaccttgggatggtaggtttatgcatatggtactctcaactccatgacaaggccttgctgtgatttttcttttcctcactgggtagaattggcatcatgaaagatgtatttttcagccatcaggggagctcattgttaacaaaagtcacaccaaacccaactatgaactctttggtaatttgaaaagtggagtggcagctgcctgtttgggattttgtattaccagttctaagatggttgcccttcctgtgttaacttaccaaaccaagtgacgatggtgctacaggcagtcccaaacaacatggagcagaaacaatcagcatctccttcagacccatgggtctggtccatctgactgtggagggctaccttggtgatctggaagaatctgctgacctggtcccttgaccttgtagtcaaatttgactagctaaagttctgccagacagctcttcattttctcactgggcccccttcattcaccccaactttctggtgaagacagcagccctgatccatttttccaggagtaaactattatcttaaatacagttcaagtctccttggttgacagacaccataaatatatatgatctcattaggaagttaggcctctgtgcttcctattaaaaaataacaaaaactaggccaggtgtggtggttcatgcctgtaatcccagcactttgggaggctgaggtggatggatcacctgaggtcaggagttcgaaaccagcctagtcaacatggtgaaacctcgtctactaaaaatactaaatctactaaaaatacgaaagttagccgggcatggtggcacacacctgtaatcccagctactcaggaggctgagacaggagaaccacttgaacccaggagttggaggttgcagtgagccgagattgcaccattgcactccagcctgggtgacagagcaagactctgtctcaaaaacaaaaacaaaaacaaaacaaaaacttttcgatagcttccataattaacagtatcgaaatctgggtctgggacaggctttagagctcatttccttttttttttttttttttgaggtggagtctcgctctgtcacccaggctggagtgcagtggcatgatatcggctcactgcaacctctgcctcccggattcaagcaattctcccgcctcagccttccgaatagctgggactacaggcgcatgccaccatgcccggataatttttgtatttttagtagaaatgggttttcaccatgttggccaggatggtctctatctcttgatcttgtgatactcccatctcggcctcccaaagtgctgggattacaggcgtgagccaccgcgcctggcctcatttcctttaatatccacattttacagaggaggaaagcaagggtggaaaatagtcaataccattacaggacccatggttacacccttcaactaacaaacttcctcagtggataagctccttactcgcctttgcagatccacctcagctttgaacacagtgcatgcttttaaagcatttgttaaaggaatgggtgaatgaatgaaggagagaaaaaatccctgctgcattatctacccataaaagaaatacagaaccatctggaaggtgaagaacaaagaaagggaatcaagccctgggaatgcaagtttgttgcttattcctgtgactgctgccacagggataagggtgctaggcttgggtttaggagacttgggtgaaattccagtctacacatggctagcaagctctctgaaaaatggggagagtaagtgtgacctcatggagtggtgagcgttcaattatgtcatgtttataaaagtgcctagcactgtacctggtacatagtaggggtgtagtagtagtggtttccttttgttcagttgcagggttggggattactttaaggcttagactcaaagcgataggaatgaattgcttggtcagcagaagtgcacactgcacaccagcctcaagggacaaggtcaaccacgacacgtttgcaaagtgtttgtgcggggaagaccactctgatgtttcttacttaaaggcagggtcttccaactttgtctgatacggaatgacttgttacaatcatttcacaggcaagccaacactcaggcttttgactaacttgtctggcgtgtttctcaacaactccattaagaattcactgttagaaatctgatcttttctcctctgttgagctttacttgggcattttattgatttgatatcacttagtagaaacccattcaacaaaaggtatctcttcaggccactagtcaatacagcattttttatttgctgagatttttacttctattttgccccacatcagctggtaagttttataagtaagcaaaaagtaggagctatagacaataaggaagcagaatgaacctctgcaattcatatttatgtatgatttcacttggagtgggaggagatgttttttttccccatctttgaataagtagaaaaacatctcacgtaacctggggtggtggtggtgaattttcagctgaagggaatccttcctcgtgaagctcactgctatcctgttaatctagcattttacttttgtggtaagattctgggtggaaagggaaaatgaaatgatacagcatctcaaacataggca[450 bp omitted]aatctctcttggtatgctgctgagttggtgggacctgggcaattacaagggaggtcactgcacccccaggcagttcccagcaagtgttttttccaatttcactgacattctttccgggctcaactcaatttgttttcaacttctctatggcaattgatgactgactgtgtaattcagcaggatctcctgtgaagtgcttcttccccagttgaataggagctggtgtttgtctaagcctctgcttatgcatgaggtataatgctttttatatgttatataatgctcttacgcgttagctatctgaatgatagatttaataaaatatacctcataatattatggggaaaggatgacgactgttatagagaggaacttgggagtatcacttctgtaatccttatctaacctgaatctgttagcaggaaactgaaaaggcctgtgtatgacaatgagataaacaattttaatctcttagcaatgtcaagtggaaaatctaactacctgccagtagtttaagaaatggctaagagattttgttgggcacaaataatcctgagacccagattgctgagccaagggtaggaaaattggttttgctatgtgttacagctgggaagtgagaaggtcactgtttgacaaactactaaaaaaaccttatggattaaacattcgccagtgtaggggacattttgaatgtgttataattgatattttagtctatatgcggccgctgaacgctttttcttttacaaaaaaaaaaaatttatgaatttgagacagagtctcactctgtcgcccaggcaggagtgcagttgtgtgatcacagctcactgcagcctcgatctctccagctcaagagatcctcacacctcagcctcccgagtagctgggactacaggctcgtaccatcatgcctggcttattttttattttttagtagagacatctcttgctatgttgcccaggctggtctcgaattcctgagctcaagcgatccttccaccttggcctcccaatccgccttggcctcccaaagtgttgggattacagctgggagccactgagcctggccttctctttttcttaacctttctccttcatcatcatcatagtcatcacagcattaaacactcattaatattgaccatctggctaattgcaagtagttgaggagactcaagacctcctctgagaatgttttttgtgcttaacaagtgaacgtgcttgaaagacttgtgactctcagatccagcacttgacctcattgggcctctttggacttgggtatcctcaatctgtaaaatgggtatattgatagtcttcctacctcatgtggtctttgtgagtccaaataagacgtgtatacagtcatttggggacagtgaattatttcctgcctaaatgagtttttaattatgagtacgatgactttgcttttttacaaaaagaggatggacaagggcaagcactcactcatgaagagtattctgaccttgttgcttgaaaagaaattgctaaggactatgttaaaagcaatctctgcgtccacagcagagccagttctgaggtggacggagcagtgaggtcgggttgggatgaggagatattctggataacgccccggtttcacttcagccgcagcatcgtctcctcttgcctgtgtgaccatctcggccattgtagactgtggacgcagcctcctccggctgtggtttgcccattcgtcagtgggcatgcagatgtaacagacaccagggaaggctggagtgagcaaggagggggccccaaagcaggggtctcatgctccctgaacagggctgccagctgctgaatcatgatagggagactgcactgcactctagagtttgagggtacttaatgggggcatggacttttccagtaccttgagtggttttctcttctgtgtcatggaaagtgaa[450 bp omitted]tgtggaacagggagtaaaggaactggatttgggcaacagcctctagggaaggagtctggggtaaaggtcttgaggaatttgctccctctgttagaagtggtagatcaaagagactgttctggatccagaggctcacggaggctggaatgaaagagggcacccctgccccagtacttgatttggagcgttggattctgcacaaattgatgctcagcagttgcacagtgcagagcccagtcagctgcactgttgctatgctctcgggaggaccccgattgaccagaaggacatggtcaggagagctcggcaggggtttttctgcttagtacacgttatagagtcttagctatggaagagctctagggggaggggaagaaccctgaggtgtagtcctgggttgagtctaaactctgttacttcctatctgtgtgaccctagagaaaactttctgctcctcagttgcatcatctgtgaaatgtgactgataatacccaccttaaggctgtgagccttaaacaaggtaatgtgggaaatgcctagcacagcgtctggacatactaaatgctcgatacaatagcatggacctcagaggcagctgtggtgtcatttgttagtattttatgccgaacctgcgacctccaccattctctttgattgggtgagagtgaataagggtgtctgaggcagtgttgctgacttcttcccttggaagaggagaagtcatggggtctgggagctctttgacattgaggtttgtaggaagtgtgtgctgggggaggcttgctctgctgagcacagaagcaagatggtctgctggggagtgtggagcccgagccagccagacctgaacccacaccctcactctgtcctagaccttggcgtgggctgaacatctctgagtctcagtgtcctcatctctaacatgaggataatgagcctctctcagggggtgctgtgaagatgaaaggagataatgcagctcaagtaccgggtgcagaacaggggtggaatagaggacacccctccaccagttgtgaagagcgtttttaagtggatgccctaatcgccttcaccaattggctcgagtcacgttgtcccaagtacagctaattgtcgaagatgatgacaaaacaggcagcaggatttatttttccagggaggttctttagttgcaggagaggcctcactttgttactagggattggaacttgaagtttaaaaaaacaatcccctgtattcagctgccggcaagaggtgtcaggttacacaccctggggaccagcctctttttattctgttttgtaggtggaaactggctgaggtcatccagacacaaaatgcccagcatttggggtgtgaaagcctctgtcccttccctcccttccccttgttcctctgctttcttggtgcatcttttagagtcactgtagctcataagagagccaatgaaatatatacatatatatctctctatacacacacacccacacacacgtgtgtgtgtagaacaacactactctgtatcggtgtggcttttcttaccaaggaggtctctggacgtgtgtgatttaattagtcttcgtctcttctctgtgccgcatctggtgccaggccaggcacgtgcttattaacacaggctctctctgagattaaggagatgttttatcttactgcacacccagtgaggcccgtcacgtgtccattcacagggactcaggtccaggtggctctggggtctctgaagtacactgtgcgtcaccctggcctcctcttgaagtgagccacagagaacctacccaggacttcccaagtcacaaggccatactgtgcccttgtcatctgggctgggatggtggagtggaaggaaaagccagtcaggtgactggacggagctgatgaaccccgagcacaccagctcacttccaagtcccaggagggcctactggaacccatgcaggatccgggctggatggctacaggttccatctgagcagcacggactggcgtcaccacagccctgggcatcctgcctgccaaaccctggtctctactctgctacacacaggatgtgtgaaatggaactctctccttcctttcagctgtaatgggtggggggcagggggagcaggtagcctgcagggttgacccctgggggtttgcatcttttctgtccaggatgatctattcaaaccttttctagccccaggacccattaggcatctgtacagagcttccaggctctgaatgtgcagttttgagacgttgcccctttctagacatatgtgtctcaggctcagcctgccctaacacctccccaagccccagtttctttctgccctttgcaggatgaagggactgatgtctgggaggattgaaaccacgaaaggagcttgttagcacgtggcagtgttgacctcaggggtggtctgatggcgaatgtgctggacagtaactcccttattgccccaacctggaaatatacacagaatggtaattagtttcgatctcagggtaaagccatatggagcagcgtctgggatgctgtttaccttgcggtattacactgtacattaaaaatcagctgctctctcctgagagccgagccgtctcccgcctctgcagactgctggttaaccccaagaagctgaacggagccctgcaggttctgggtccttcctggcatcctgtctttggcattttgaactggcctagattttctggtcagtcaccattggcctcaaataccacattcccaggggaaggcaggagagtctcctaggagttggagtggcaaggagccccaaggatccatgttgtgcttgaagggcgagtgccctgaatgtaccaggtggcaggttgctaggaaccttgagcctggcctctgactgtagtttgggaacactgactttgcaaagaagacttgagcaacttcagaaaatagtttatggctgggtgcggtggctcatgactataaccccagcactttgagaggctgaggtgggtggattacctgaggtcaggagttcgattccagcctggccaacatggtgaaatcccgtatctactaaaaatacaaaatcagctgggtgtggtggtgcgcgcctgtaatcccagctaatcctgaggctgaggcaggagaatcgcttgaacccgggaggcgggagttgcaatgagcccagattgtgccactgcactccagcctgggccacaagaacaaaactccatctcaagaaaaaaaaaaagaaagaaaagaaaagaaaaaaaggccaggtgcggtggctcacgcctgtaatcccagcactttgggaggctgaggcaggtggatcacctgaggtcaggagttccagaccaccctgaccaacatggtgaaaccccgtctctactaaatacaaaatattagccaggcgtggtggcgtacgcctgtaatcccagctacttgggaggctgaggcaggagaattgcttgaacctgggaggcagaggttgcagtgagctgagattgcaccactgcactccagcctgtgcaataagagcgaaaccccgtctcaaaaaaaaaagaaaatagttcagtatgaccccatgaccagatgtcataaaagggaacataagttccccataaaggtatttaaaagtcagttgcccaaaggataggatggaggagtcctggctcatcaatatttcttttatttctttttttttttttttttttttgagacagagttttgttcttgttgcccaggctggagtgcaatggcgagatcttgactcactgcaacctccgcctcctgggttcaagcgattctcctgcctcagcctcctgagtagctgggattacaggcatgtgccaccacgcctggctaattttgtattttttttttagtagagacggggtttctccatgttggtcaggttgggctcgaactcccgacctcaggtgatccacccacctcggcctcccaaagtgctgggattataggcgtgaaccactgcgcccggccaatattttattttattttttgagatggagtcttgatctgtcgcccaggctggggtgcactggcatgatctcagctcattgcaacctctgctgcccgggttcaagcgattcttctgcctcagcctcctgagtagctgggattacagacaggtgccaccatgcctggctaattttgtgtttttagtagagatggggtttcagcatcttggccaggctgatcttgaaccgcgtgatctgcccgtctcggcctcccaaagtgctgggattataggcatgagccaccacgcccggccgcgcccggccaatatttcttttgaaattcactgggagttataattttactaccagttcaatatgaattaacaggtggtacggctgtaaaaaatactaaacagtcttaggatgcacaataataataaaaataatagcagcaatgatttcagaagtgcctattatgtgccaggcatgttccgtcaaatactttatgtaatttttgcagggcattcattattttcctccttttagagatgaggatgagacatataaattgttagtcccaagcccacagctgatcaatggcaggactgggattttaactcatctgaatctcccaagttcctaccctgtcctctctgccacccatcagctgtcgcctggagaacagaggaaggtggctttgaatttagttctgggccttgtgctttagggggactggggactaactgaactgaatgcagaggtggatgggtggagcaatggggcctctgaaccacagccctgggaggtggctgagggaattaggattggttgttgccgtggaaatactggaccccgggggaaagagagtgtgttcacataggtcccctggagtaccgttttagtctagttaaaaattttctacttgaggaggtggaactaagagtggattcttttccttataaatgaatgggcctttgtttaaaaaagggatgtaatagatgcaactgcagcaaaagtgagctcctggagctgcctccttaggctgatgaactggaagagaactcttaaccctaaagggcaggaaaaggttaaagctcctcattgctgcagacatagcagggcaataagcccctgatagcagaaaaggggagcaccccaaggcactcactctgtaatccgggtccccagggactcagcctgcctcccacagggagaagggcagatctgcccacgggaaagagggtttcagcagatacagagcatggatctgcacgtgtccagatgcctcaggccacccagagagagcatcgtgggcctctgtgctgcgtggggcttgctaggtactgctatactgtgaagcacccaggcagcctggagctgcacggcctgcgcatgagtccaacaggtacaagctgttgtgggcttataatgtcagcacctaagcaggaattgaatgcaatcgagttgagttacctgcctccaggtaaattaagttaaatcctcatttaaattaggagacatgggtgagggcctaaaggggccaggacacagaatgcccaggctttcaataggtgatattctcaataggtgatagaggtgaagggtgtggcacctccctggaaaggagcacagctgcggtcaccaagtgaggctgtggcctccatcgtaaaggccatgtggggcggcaagtgaccgaccacagggcacggtaagtcagcagggagcgaccaccaggattccttaccaaagttggattcctcagtctctgctatgctaccctcagagattcagattcaattttttgttttgttttgtcccgctctattgcccaggctggagggcagtggtgtgatcttggctcactggaacctctgcctcctgggttcaagtgattctagtgcctcagcctcccgagtagctgggattacaggcgtacgccaccacaactggctactttttttgtgttttttagtagagacggggtttcaccatgttgcccaggctgatctcaaactcctggcctctaagtgatctgcctgcctcggcctcccaaagtgctgagattacaggcacgagccatcgtgccggcccccgattcactttttaggaggggacatctgtgtcatttccaggtctggctattttgaataaagcagctgtgaacattcgtgtacacatttttgtgtgatgtaagccttcatttatttgtgataaatgctcaggagtgcagttgctgggtcgtacagtagttgcacattcatttcatattttacgaaactgccacactgctctccagagtggcttcaccattttacatcccacagcagtgtatgagtgctgcagcttctccacatccttgccagcgttttatttagtagctaagtagctacttttattttagccactctggtaggtatgcaggtatgcaaggccatctcattgtaggttctttctgtgtcttgttttgttttgttttttttgagacagggtcttgttctgtagcttgcccgggttggggtgcagggggcaatcatggctcactgcagccctgacttcctagattcaagggatcctcccgccttagcctcccaagtagcgatttataggacaacaggtatgcagcaccatgcccagctaattttaaaattattttgtagagatggggtcttgctgtgtcgccaaggctggtctcaagtctcctggcctcccaaagtgctgagattatgggagtgagccaccacgccagccttcattgcagttttaacttgcttttctctttttttttttttttttgagaagtcttgctctgtcgctcaggctggagtgcagtggtgcgatcttggctcactgcaagctccgcctcctggtttcaagtgattctcctgcctcagcctcccaagtagctgggactacaggtgcccgccaccacacctggctaatttttgtatttttagtagagacgaggtttcactatgttggccaggctggtcttgaatttctgaccttgtgatccgcctgcctcggcctcccaaagtgttggggattacaggcgtgagccaccacgcccggccaacttgcttttctctaatggctggcgatgttaattttttcactggcttatttaccgtctccttctgtggaatgatctggcttagaaaatgaacaattccacagaggtgctataaaaacgggcagggtgtcaaaagccttggcctcctgtttgggctttgcctctcagggcttcaggtgaaggtgtttggtcatctctgaggtcgcttcctgctcccagtgtcctctgactccaggatagagtcatgccccttggcgggcagcccggtgggagctgtggtgtgtaggaggcccggacggcggcccctgcccacatgccatcacctcccagctccgtctccacaggagcttacccaggctgactcacaggtgctgtattatttaaggaaagttgtttattgattgttggggcctggaaataaaaagaaaaacaaagaagcagatgcagagtgtctccttgccacctccctctgggcgcctccgagatggtggctgaggaccaggccccactctgggtgaggcttcctttccgccactggtgcttccctttgtctctctgcagcctgggcctgtgctttgggtttagttttgcaacatagtcatgctgaaggtcccagagatgcttcccctttttattgtaattaagccaaaaaagaaacatggggtatgtaatttagaactactcataaccacagagatggaaggaattttctctttaaagctagcactagatttcaccttgcaccctaggccacttgcccatgtccttgccatcttttaactcctgtctcaggagggggcagcagaaagtagtcttgagagttaatgggattgctactagtttgagtacctgcgggaggatttggtctccatcgagaaacaggggaagatgtcatctgcttaagaaggtatttatgtttgtttttctgcccggtgatatacatgaacccggtagtgtgtgaaataaagcatcttagtcctcatttcagtgaatcagaagaaactaaaaggcatggttatttctccctcggtatgatgaagtctatataatatttgcaaaatctcctttggtgaatttgtataaacaatctatcacaaagaaagtattgttttctatatgggcttaaaggatttttggaaaatgggcagaggattttcccatgtattccctgagcctggggaatggaaatcatctcatggagacagatgaccacaggctttccacccagtccccgtggcccactagaattgtccagcatgtttcagtggttatttgattgggctcaagaccaaagttggaactgaatcaaatgatggtttggttcagaatatttttccgttttggtacgttttgaaaacctaggtttgatgctggttgcagttgttcaacagattttttaaaaaaaactttgagtacaacacacactgaggccttttgcgggtggaggtagggaaagcatcaggataaatagctaatgcatgtgggacttaatacctaggtgatgggttataggtgcagcaaaccaccatggcacttgtttacctatgtaacaaaactgcacatcctgcatatttatcctagaacttcaaataaaataaaaacattttaaaaagaaaataaaaagagaagatttttagaaaaaaataaagaaaaagattttagagccacagaatctctttttagagtatgggaagaacagaaattctctgggtagagcaatttttgacagaagatgatttgggtttatatgagatatacaaaactattcttacgcatttttactgcatgccacaacttgggatttcttagtattttccacatcaaccacactactttaagtcgtctggttagaagtgtatgaacatgttataagctcagaaaatggcatgtaaaagcaatagagggccaggtgcggtggctcacgcctgtagtgccagcactttgggaggccgaggtgggcagattgcctgaggtcaggagtttgagaccagcctggccaacttggcaaaacctcatctctactaaaaatacaaaaattagccgggcattatgacgggcacctgtagtcctagctactcaggaggctaaggcaagagaatcacttgaacctgggaggcggaggtttcagtgagccgagatcttgtcactgcactccagtctgggcgacagagcgagacttcatctcaaaaataaatacataaaaataaaagcaatagagtattacagtgtgaatcaggaaatcttgcacgttttgaaggtttcaaatgacttggtttaataaagaaagaaaacttgtaatacctagaaaattgacgttgaatgggaaaaataaaacaaaatattgctatacaaaaacctcttgttacattcctgactcaatctgatatttgtgtttggtttatttgaatacataaaatatattatggccattggtgagtagttagttcattttgattcaagttacttctccagatggcatcattgttataaaatttaatttccgtgaacttacattcttccaggatggttgtgtgtgttgatcttctggtttcttaaatcttctgggtcagagttactatacttgcatttgtgcttcgcaatgaactagaataaatactttctattaaaaccagcagaggttttgctaaagagaatgcacgcacaggccttgtctttttggtgcaaggtagagggttttatctactacctgcgactaactagctttcagaaaagagtgaactaacgctttacccatggagttcacaaacgttcatggtgtactggcagtagggatacatgtacaagcatagcttagttcctaccttctagggattcgaagtttagtagaggaggcagattgtaatacctaatacctattatgcttttattatgtggtagtcattgaaggagaagttaagtgacatgtctaaaatcatagtaatagaagagtcaggctatgaaccaagatattcttagagtttctcatcgttggcatttagggacagatacttttcagttgtgtggggctgctctgtgtactgtaggatgtttagcagtatctctggtcagtagcacctccccccatttgtgacaaccagatgtctccagacattgccaaatgtcccccatggggagaatcgcccctgattgaaaagcactgctctagagcctgctcttgtgcccaccactctgtactgtcttcccagatgagtgaatgctatgggagagaataagcatgtttacagtgtgaagtcccaattcctgctgacagcagaggacagatgccaacactacctagggtggtggagaagagaaatattctcagatatggtgccattggagttgaattttgaagggattcacgtagtcagagaaaaaggaagactatctggagtaaagggatgtgtgtgcacaaaagcatggcagcaggaggaagcagggcaaccttgaggatgacaggtagttttctatagaccctttaatttactcttcagtgctgttctcttgtttcctctgttcaaacagcaagccagggttacagcagctcttcatgtcattcttacttcaaatcaaaggtgttgtgttagtcaggatgagctaggttatgttgcagtaacaaacagccccagaattggcagcagaaaacaagaaaggtttattttctgctcatgccacatacctgatctgggtcagctgtggtctcatggtgctggttactgtacagagggaatgagaacatggtgaatcacatactgacttgtaaagctacattccagacaagcaacacttaccacttctgctcacatttaattggccaggtaagtctgctgtcctcacctaattttaaggggccaagagagtagagtcctaccatgtgcccaggagaactagaaatatttggggacagcactcaggtgtaccatagatgtcagaggctcatacctgaaatgttcaagcacacacaactcattgtctgctctctgagagcctcctagcttggctttcaagaagggccctttgccatagacggtcaagattttaaaaaatatcaattatctgagtaagtcaaggaaagtccttgtgggaccaggtcacaagccctcagtttttagagtcaggatgttggggtgggagtgatagaactgattgaagtcaatatagcctggatgtggtagattgttttatgtggaggggtagttgttcaggacactgattgttatctgaacacccaggatgctttctttggctgtcactgtagtaaaaagaacagttttaaagcctgagccaagtgtcaagcagcaggagggtgtccttcgtgaactctgaatttatggggctgagtctgagagcgaagagatgccaacagtagcgactgagaacattctggatgattttagtaaaccccgaacaaattccttatacaccaaggagcattctccttgttagaaattcctccagaccacgactctggccctggccctggggtgaggagatagggtgcctggccgtagtggatctaaaacgggatgacaccggaaacctgtggggaggacgccgtccttgtcgccccttgacagagggggcacagaggccttagagaaacaaaaataaaaatagcaattgtttgccacttccctccctaataaagtgttctctccaaacctggtttccactctatttctgaactgtttcgccccatggtgtgtaggaagccagggtaaatgtgggagtgggaggaaggggacacaggcagcaactcaaaggaaggcagaattagtagccgtctgggaaccgggggcgggggcattctagaaatgcgaagaggtcgaatagccagctgggtccggagtctcctcacctctggtgtcttagcggagcatgagtgtgtatgtatgtgtgtgtatatgtgtgtatatttatttgcgcatatgcacgtgtgtatgtgtgtgtgcatgcatgtgtgtatatgggtaagtgtgcagtgtgtgtttacgtgcatgcatgcatgtatgggtgtagatatgtgggtgtgtagataagtgtgggtgggcacatgcgtacacccactggaggggtgcgatggaagttgtgtgcagctgcgtgagcgttactgaccatcctgtggtttgctgatagctgcttaatctgggttgtgtgtttcctccctccccaagcagacactcagggtgctccgtgatgcaccgggacgctaatattttcacacctgcaatctgtattgttcttttctccttcggagagcaatattgcccttctgggtgcttaagcaggaaacacaggaccagataatttaagaggagccttaatgctcagggccagaacagacagacgggcctgaacaaggtcacaggccgtccagggagtgcagggctagggcaatgccagcccacttccttccagccgagcgctcccttcacggtgaccaccttcccttcaacgtctttgtttcccggctgtaaaatgggcatgttgcatacagctatgtaggaagtgtttgcaagtgcccaggctctgggaatttgagtaaagaaggccctttgtcagtggcgcacacagcctcggctttcttcaccttgtcagttgtccattcaggtggagtagctatgaacacccacttacccttcacgtatcctaggatcaggactgtgcctgcagtgaccacgaaggctggggagccagatggctatggacctcacgagggcctgccagttcccaggaagggggtctgggctgccaggacagggggcagcagcaggactcagagagaggggttgcctcgcagtgagccctgcccatctctcgtgcggtgggaaggtggtttaaaccctgcccttaccccatgctctgaggtctccggaagacacaggtgctatatataaaactaagactattatctcactcttgctaagtttccaccctcgcggcttactgtacaccaccggggagaacatttcctgaagcccttctcccggagctctgaggccagggtgagggacgccttctgagagagaaaaccttccccgcagggaggccttttgcagaacagggaggagaataaaaatgtccaggcaaatgcccaacctcaccctagtgagcttcccactagctgagctggggaccaacatggtaccagcctacagggaagcccctcatcttcccccttttgccttttaacatggagtctctgggtcagggatggacacggtggtgagggatgctaagtatgagcagacaccctagtgggttcagctcaaactccagaggggatggggatgggcaacactcctgaggaacttctgttcagcactcgtcatcgccaggacaaatgatgggaggtccaggttgggaggtttccatttaagcgttggttccttgcaatttccctgggtagttttttcaaacaacccatgattgtcattttcggtcggacgatccccattgtttgggactgtccagcacactgaaggtcactgagcatctgggcatctgggccttggagcactatttgccattgtgcaacatacacaacacacacacacacacacacactctctctctctctctctctctctctctctctctctctttcaaaacaccctctagggctggaggcaggtactgcatctggttaggaaccactgcaaggaattatttaccttggcaacatctcaagaggatatcgaactggagtcaaaggattttggggaggtggagtaggaaggaggtagaggatgttaggctgagaaatgtcctgtcagcttggacatggtgttggccaaatttttttaagtgaagaattttcattttttttgtcctatttatgagcacccaattgactgagcaccctcagttaattggagaatcttgtgcattttgtttggctttgttttcattctttcttaataagaatgtcttaataagatgtctcttaataagcactattacctgtggggccagcttcatgaatgcagttgcacaggccgcatgctcagaagggccctgcttttggggttgaatgcctggcccattgctgccttgaaattcttaataattctttgagttggtgtttgtaagtgaagtccagtgggacaatgaagcatgaattctctgggctccagtcccacctgacttccttctccccacccctggcaactactgactcttctgatcccatcaggggcctgggtgaaggttcagggagggatagagttggcgtcactggtgtcccaaggcagggtgtggtggccatccctaccccaggctggcagggccaaaaagtggacaactgcatgagaatccagctcactccagatccaaataccaagcgtgtcccagcatgagtgtgtaatcgctttgggtctgcccaggcaggtgtgtgggaagaggggacctctctgctcctggcccagcacctggtagaggacggcagtagacgcttaagagtggccagagtcaaggggcgggatcccagcatcttgtgagactctgcactcattaaacagcaaataagaaacactgtatcaagttgagagaaaccctgcagaagaaaggaaggaaacggtttattttagtacgttttatggcacttttttcctgctttttgaacaagggcgctgcatttttactttgcactgggccctgaaacttacgtagctggcccctacttgcttacttcattgctatctgcagtttctgtttattttctgtctcccgtttctaaaaagaaataactagttaaaagggctcaccatgaacacaggtgcttccatttgtttccccctttctgttcttctgagggacattatcaccagccaatcaccagctgccccaccccagacttcttttccaatgctacctgttagcacggcaccttctgaaggaggccgtgagtcaggggagaggagacaggggcagggaagacagatttatctgtcactgggatgtggctgaattttgtggtgggtgggttgtgaatcttcccattagggagtgatttcttcccaggtagttatgagctagtgctggccccaggcaggatgctgtcaggatactagacagggaaccataaagcaaggttgcaagaaatgaggctctgctctcatcagcaagctttactaagggactctcttcaagcagggagatagtgctgcaccaaacaagttaagcactgtccttgggcaggagtatcatgccgtaagacatggcccaagagagaatgacagtgaggaaacctaattgcaggtcaggtgggcctgtagacagggacaggtgagggctaggccctgcccactgccgcttctcaccgttggtccccagtcatggaagtttcatatttagacaaaggaaggtcagggaagtatcacgtcttctgctttacctaggaagttcttgttggggggaagttggatgtcaggagccactgtgcctgcctctaccctagtcccctccacagcctgctgcatagtttccaagtgtcccaggaccgcagtgacacccaccccacccatacattttaagtgttagccacttcttgtctgttactataaaatgcacatcagacattcctagacccatcggagacctggagaggccagacactggacatcctcctaccactgggccagacacacccacggcagcccagacaggcagcccagggcaggggaggccatctctgtttctggatgttgctagcctggtgcctcgccagggagggggtgcagccagaataaaggcatgagacatactcatgctaaaaagtcacttgttgtttatctaaaatccaaacgtaactgggcatcctgtactttttctggcagctctaacccagaaggcagttttgtcacagcctttgtgaaatgggtgaatccagaaaggagacagctggtggcccagaggcctctggaggtcccctattgaggggccagacgtctggggctctgctgcccactgctgccacctgcttgctgtaccatctggagttgttctgaggcctggtgtaactcgtgttcaccagtgtcttcttccgtctcccttaggctctcccccagaatggaatacagtgaggggcctggcagaatactggcctagggcagcatggcctgccaggcctgcatcagaaagctgctcaggcttgctgcctcacgagttaagatgctgtcagctgcaagtatcagaaaactgcaacccagtagagttgaacaataaagaaaacacattctttcaccttgatcagtaagtcccagcacaggcagttctagcattggctaattcatcagcatagcagagttactgaaagacctgtgtcctctgcatctctctgccctgtctcacaacgtgttgactcatctttcctcgtggttgccagatgggtgctacagggcctcgtgtcctgtgtggaaatgataatatcccttggaggaaaaaggggatggctcttcatggtgtctaaggccgagacatctttttcagaaggctcccagcagatatcccctgtgtctcattgaccagaatgtctcgagttactcgtgcctaagtcagcctctggcatgggagtggcttataacaattagtattgactctgggagtagctccaaagagcatacatttgggtgggtctcagttaggtcccttgagctgttattctaccaacggtttgaggcaggtttgatttattttttgttctttttggtttttaacaaaaacttaaacattacagagaaagaagctaatgataaccatgactaaataatgataaccacgactaaatgaatgatttaactcattctaggtatttacaatcgttgtaaatccaatttggtctttgatcaattgcctaattttgttttacataattgcaatctgattgtactagttttatcttttattgttttaacgtcatttcatacagtaatcaactgtgtggtctgattcctgagtgtgaactttgagctactacatcatttacatcatcttactcctacctttggtgggtagtttccatattttgttgcagttattgccatatgcagccatgagtatttttgttaaaatgacctcttttcttctccctttagtgacttcttgggaagtgttcccctcagtggtactgctggggcaacgtccaataccaagaatgatgtatagcatatttcatcttcctacactactctctggaaagactgagccaattacggggtcatctgtaaagtctaagtgctgcagtttccctacgaccattggattttgtttgtagtttgatattgtcttactgtcccttgaagttgtaatttgtaattctttagttttcaagagggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttaggaggccaaggcgggcggatcacctgaggtcaagagattgagaccagcctggccaacatggtgaaaccccgtctctactaaaaaatacaaaaattagccaggtgtagtggtgggcacctgtaatcccagctacttgggaggctgaggcaggagaattgcttgaacctgagaggcggaggttgcggtgagccgagatagcaccactgcactccagcctgggcgaaagagctaaactccatctcaaaaataaataaataaataaaaaataaaaaaagattgtactttatttggcaataatgtttttattctgaattattctactaggtccctttatttccttgtgaaattgttcttaattgcgctggcctggaaatagagcccatatggtactggagggtgatggtttttcataatttttcttatgcaaccacccttagtgatgagtccctagaggattgaactgtgcctcattctgtggactggactttttggaaacccctttttgagcccccaggaagaaatttggctgagagctgatgcctggatgctagccagctggctgctggccatatccagccaccccagtcccctggccatctgtgcacctcggcaacagagtggcgactgacacacccaggcccagaaagccagacagactggcggctggaaacttcatggaatccttgtaattagaaatggaaaagacctgttagctcgagtggtatcctcctcctcctcccacaggccccaaccagctttagaaggtgacatataatttgccctgtcacctggagcactcaactgagttttctgggtcttatctgtgaaatccaagagctggaccaaatcagtgttttttaaccccttttgggtcttatgccattttggaaagtggtagaaagccacacaccctttttccagagagaggcacatttcacaggccatgttgccctttcaggacattgataacaagaagcctgtctagatcctagcccacagtcttcaggtttggaacccaaagacttgttgatctctgaagtccctctcagctcagaaaacccacattctagaaagttttctgtcaagaaccctaggtatggaaatggataaaagggagtctcttgtacttaacttggaggaaaccactgtccagcccaatgggtttcactatcaagtatttttatttattgttttatcatttattattttccaggattgagttcaacttgtggtaccacgttctttcccatcatcttaatctttctaaatttcgtactgcctttgatttaaacaattgaactcttacaggtttgtggagtggaaatgggatttacttggttttgaccttcacctcacaggagggggatcatctttctggcaattcccagcagatactagcctctgcctgctgaccctcagcctcctcttccagccctttagcagcttggaataagaggcaacaaactggttgggttgatgtttatgtgaacatatgggtgcttgggagttggaagatgtgaggggaatcccttctgatggctctacaagtgctttcccagcactctgggcttgcatggttcccagggacttcagagtttctaattcctcaaatgacctgcctgacagggagtcctaagaaatgattcgggcctcaaagatctgtcctcaggggtcaggagaaaacatgcagtataagttgatatagctggagaggggatgcctgcaacctccaactgtggaggccagcctagcctcccggaatggggtggaggcagtcacagatacaagtctccttggtgggaaattgaaggtattcaggcccgtatgtgcccataggcacatctgcatatttggatttgacccaggaagcttggggaaggagggagaaaatcagaagctttgacatcattttttttttttttttttgagatggcgttttgctcttgttgcccaggctggaatgcaatggtgcgatcttggctcaccgcaacctctgcctcccaggttcaagtgattctcctgcttcagcctcccgagtagctgggtttacaggcacgcgtcaccacgcccggctcattttgtatttttagcagagatgaggtttctccatgttggtcaggctggtctcgaactcccgacctcaggtgacctgcccgccttggcctcccaaagtgctgggattacaggtgtgagccactgtgcctgaccgacatcaagttgtatgtttctggactctcctctcttcctctggccatcagaatgttctcacatcaaaaatgtgagatgagggataaaggaattagcacctaaatgttttacataatgttaggataattttgctctgtgggagagtggcctgaatgtggggagcctttgagtaactgacctataacttttcttaggcccttctggttttatcccagttactgatgctgttcttatctcctatctattctggaattcatctctgaacatttaatacatttggccaagcaagagcaatgctgtgattcttttaaaaagtacaagcttttgccagtacttctttcaagttgtaaattttatgaggagtttgttccactgtgcaaaggagcctctgactttaagaaaagtcattccagctcaagatttcaaatgaagtcgaggctgtgtgtagtcacaggttttctcatgtcatcggtagagataaaagcctcttagttttagactgggcacagcattgttgaacgtccattacttactgtttaagtagccaatgatctctgaaaaaagcttggctgtaaagttggcagaatgatgcactgctttgtttcaagccactgtaaactgtctttcccagtgtcacttttatctccagtgcttttgtcacatgtttttgctcatttccccaaagcggaaaaatattgcattccccagaatgacaattttcattgctgcccgctcaattcagtttttcataaatgcccaggaaataaactagctgagttattctccattctcacacatcttcattagcacacacgagaagcttttttacagggaattctcgtgttgaccaggtatgataacctgttgcaatgtgggtagtcttggttatattaatgtttttaaagataagtagtgttattactttattggtcatgtataattacatcggagatctaattattgagagttaacaatgctttgtaattggtattttacggcatgctaaacatttttctgaagtgcttgtactattaatgtttatattctttatttcgtagtcactcttttttcatactgtaaaggtaaacggaattcggcttaagattgaattatcaaaaattttcaggggtctaaacaaatagtatttagagtccgaccctcccactgtttgagatctaggaaaataaaagccttgggcggatgggtttcgggcagaaccgctacgctctgcaagctgaccgtggagttgggcacagtgtcatccaaagaaatgaagattttttttttattagctcttgaacaaaattaattaaaagttgttactcttgggggtgagggggacaaggaaagacaggatttgggagcctgctgacctacagttcaaccctacaaaaagtatacccattttgcaaatgaggaaacccagactgaaacacatcctttctcccaagccggaagctggcggccagcagcgctgagattcttttcgtaagcagcaacagcagcccccttgtctttcccgcctgggggagcgcaagccaggggtgcaggtcagcatttcaagccccgctactgcctctgctgcgggcccgctagcgctggcgaaggcgacaggggcggccgccttcccgtcacgtgaccggcaccgccgccgagcatgccgggagacggcgccccctccccggccgcgggcttccgcgcgtgggcggcgggcagagcgcgcgcgggaggagagaggaggtgggggccgggcagcgacaggggaagaaaccgcggcgaagaaaagccccctgtagagcaggccctgcttcaccgccctgcccgaaatcccccgccgcgcccctgcctcggccagccagcgtcgggcggtgggaaccgggcctgagctgagggcggagggactccggcgccgtccgttcattgtaaacaaatcgagtgagaaatggaggcacgcctggttcctgggtcccttggtgcaggctttcacaccccgggtgctagcactcggtctttctcctgcgtaggggataggattgtgtgtgcagtcaggtttttctagtaatatcttgcactttttttttccttcacccactcagacattccccatttttcctcataatcactttctttcgcttcagcatacacacttagcccttggcaggcaaagtggaatctcgggttcttgtcagacctcaatgtttaagctgctgaaacacagggcatatttggtttagatgttttactgttatgaaaataaaccacctcctgcagttacaccagctcagattttccctcgatagggtcagtgtggattatctattggaggaaaaatatttaattagaaaggaatgaaattctcttagttccttgaggttggaaggagcttaggcaaggaacagttagttaaaggtaagcacaaaaaatgccaggggaccaagaagccactattggaatgcagtatctgttggctgctggtttagcacactgccccaggcttcccggttgggactccactcaggtcctagactgacaaaatgggaaggcaccctcccaatgggtcttcattaccatctgccgaataaagagaataccagtagttgtatttcgtgcatttcttggagccaaatgattggattaaatctagtcccttactgtgcaagcgtagtcaattttggtcatctctctctaggcctagtgccagttgttgcctgcctttgtaaccagatagccacagtgaggtcatcagaagaggataggcagcgctgcagaagggaatcctttttctgtacctcaccatgatgaaataggggtagccgtcaagttgaactttccctttttttttttttttccgagagggagtctcactgtgtcgcccaggctggagtgtagtggcgtgatgtccgctcactgcaacttccgcccccctggttaaagcaattctccctgcctcagtctcccgagtagctgggattataggcgcccaccaccacacccggctaatttttgtattttttagtagagacggggttttgccatgttggccaggctggtcttgaactctagacctcaagtgatccacccacctcggcctcccaaagtgctgggattccaggcatgaaccaccgtgccgggccaagttgaacttttctcttgggggaataatttccctgctcaacatagacctggtggaattttcttgtctctctcttccctggcattttctctggtcttaggcaagcatttcctgccttttctgattccctctctgtgtgtgcatgggacttaggggaggaaggaggagggagttttctgttaagggagccgtgaatgagcaggaaatggctatttggtaccagttattctgcagaattagggagtgctgatgctgacaaggagtcagaaggattcagtcatcatgacatctgcagtcacaactgggtgggttagtgagcgcccctgaagtgtgtgtactcatttcaggcgcagccagcagcagaatttgggaagactgtcccacccctcctactccctgtgtgctgacagtttgctgtgtgcgtctccatggctctgtggagcttaagagattaagtccttggagaaaatgggtaaagtgaagttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggccaaagtgaagtttttaagtaggactgttgttaggaagatgttagcacagttagaatttgtaggaattctactgttggggtgtcactttctgttctgttgaaatgatacttcttccaaaagcaggagttctgagcttatatagcagacagccttgctgcggctcacacagaccctgcgtggctagcttctggtcagagtgccaaaagcatttgaagtgcctggaggtgtgttagcattagaatcagtgtcattgggtagctgggacattgtgagaagtcttgtccacgtctatagaaacagtttcagactgactgcttgctggtttctcattgaaggcaccgtgtgctccatgtagtgctctacgtaatctaacatccagagtcaaagcaaaagctgcaaatgatgacaaacccagatccagaaaaagacacaggccttgacaaggtggtgaatttcttctgagcttcccagcatctctttttgtgttctcttcctctcttgcttgaattttgtttgggcccccactcccttctcattctgataaaggtagaggggctcagaaggtggtgttctgcaggcagtgtaacctttgggaagaagaagcaggctctggagtcagagcctgagtttcaatcctagcctggccaatcactaatatcattctaggcaagctattttctgtgaaaacacttttggcattgggtttatgtgggaactcagcaatgtgtgtaaagcgcctcacatatatattaaatcgtattaatagctgtgatgatggttaatactgagtgtcaacttgattggatttaaggttgcaaagttctgggtttttttttttttttttttttttttttttgacggagtcttgctccgttgccaggctggagtgccgtggcgtgatctgggctcactgcaatctccgcctcccggattcaagtgattcccctgtctcagcctcccgagtaggtgggactacaagcgtatgccaccatgcctggctaattttttgtgttttagtagagacggggtttcaccatgttggccaggatggtctcgatctcctgaccttgtgatccgcctgcctgggcctaccaaagtcctgggattacaggcataagccaccgtgtctggccagttgcaaagtattgatgctgggtgtgtctatgacggtgttaccaaaggagattagcatttgagtcagtgcactgggaaaggcagacccacccttaatctgggtgggcaccatctaattagctgcgagtgcagatagaaaataaagcaggcagaaaaacgcgaaaagactagactggccaagcctcccagcctacatctttctcccttgctggatccttcctgcccttgaacatcagactctgaagttcttcagttttgggacttggaccagctctccttgcttctcagcttgcagacagcctattgtgggacctgtgatcatgtgagttaatacttaataaactcccctttatatatttatctatcctattggttctgtccttctagagaaccctgactaatagaatagcttagtgtttgtctgtctttctttctttttctttctttctttctttcttttttaattaatgaagctctgctgtactgggtgctatgaagaatatcccagaaagggctattctcaaaaagctgacagtaaagatgatactgactaacgttcattgaatgcttaatatgctccaggcattgttctaagtggtttgaatattttggcttatttagtcctcctaatgaccctgtgaggtaagtgctattaatatatctattttgcagatgaggaaactgagactccagaggtgttaaatgacttctcagttgtccaagaaaattctagtatgtgaacacagttcttcagagcccagacctgcctggccgcactgttgggctcttaactgctgtagtctacactgctgtagtataggctcacgcactggggaatctgaccgtgtcgtcagcagcccggagggtgcttggcggtgcagagatcctcagagatcatcctccaggtacacagccagagcagtctctgtcctgctcttgcacctttcctttctctatagcattgctgatgtgaccaggaggcattgccttcagccttcctacagaacagatagcgcactgagtactttccttctagatgagacttttctcagttggcctgataggaccttattatcagcatactagaaagccagggctgcttccttatgagaggtagtgggggtgaggggaggccagagggccatggagagttcaaggaacctggggaaaacttaaggcattgttcctgcctgccacctcttccctgtgtccttcatagcagttggtagagtttccaggtgagactggctttctagttctttcttgcactgcccagctcagccctcttaattttaagcaaataggtgcaacaggttggagagggtaccagcctgagatatgaccagggtagcagagctagtcttgtctggagactatcagcagatctgtgactatgcagtcagcaggacaggatgagaagccagtccagagctgagctctagcccagtggcctggagcagggagggctgccccatctgggatgctgctttccataacctcctgcagatcatgcctgtcctcttcctagtctgacctctgccaatagttacctaactttgaggttggcaacctgggaaaaagagtcttccatttttctccagcctctgatgacttagcaacgcctcattcatatataaatgaacaattcctgtcaccttggcctctgtcttttccagagatggtttagttggtttagtctggggagaggcaaaatgaaacgtgaaggcacacactttccagtcttacgattctgaaaggttggtcctcctctaattggcccagtgcctccatactctgatttaagagaggtttctcatccccctagcagtcagcatccctagccctgcccttctggcctctaaggtcagctctgctcagtccagaaatgagctgtcgtagctgctttagggatcttaaggagtctgtgacctttctcatctttcacatgaacagaaatttcctgaatatccactctgtgccaggcagtaggctaggtgctgtggaaacaaaagataaatcaaacagagcttctgccctgaaggtgctgtccaatttgggtgattccccttggccccttgacagttacactggtgacatttaggggacagaaaacaagatttgaaccggttgggcagacagattcaaagctgtccttcagtctacagtgctgttctgccccggggggagtgtccttccatctgtctggagagtgcagtgcataggactctgcctctgagttgagtggctcccagcctgtgggcagccagttgtggctgtgaccgggctgcccccagggggtttggctcctcttggggaccccttatcacccagatgtgagggcacatctgccagggcaggccacagaactgtggtgttcctagggcagctcttatgtggagagttctgggttggtgcagaggaccctagagaattgtctatttcactaatgccacctggggcaggtccccactgtcttcaccactaatcgcctcccttctctagctcccatagttgtggtgaggaaaagtggcttcagtgctcagcagagtgcttgggactgcatcaagcccagttcgcctatcaggtatgtttgatttcagcttattcctcagaagaaatggccagctattgtttgcagagttggagaatcacgcacaaagagattccctcacctgacctctgacacccatctctccagggatgatgagaaggggaaccagggccttccttgctgatgccagggctgtgtctgcatcacagtgctctcttgtctaaagggggaaattctgtttctcattttgcagcactgtgtattcatgatcttttcagatttgcttattggtgcagaaaggggaaagagtctaaagtttcttgaatctttgccagacactgtactatgcctctgaatgcatcatgccttaatcacgcctcacagcaactattgctactttcatctttcagacaaggaaacaggttcagaaaggctaaccaagttgtgacaggcacctagcctgaatcagtggatttcttcctggacccaccaacatttagttgacgcttgcccaggtttctgctttggtgaactatattctattgctctcagataagaatacctccaaattaacatgaatccatttgtttggtggttgttgatatgatttgttcccaagaggcctggatgaatgaacttcgtggttgtgacctctttttaattagtgatgctgtacctgtccttcctgtaggaagctgacatcattgagtgtgagctgtgtgctgggttttttcctgggaatggggacaggttgtgctaaccccccggcccctagtcgggtgctgcagaggacactcaggcctcaggggatggcttgggctacatcacctctgcagtgtctcagctctgagattctcaggccttagtaagtgtgatgagacacttaggaaatacttggagccctaaccagatgtaaagactgcgtgtgtgtgtgtgcgcgtgtgcgtatttcctcattgctggtgctagctgtgagttctatggagaaagccagccatcttagcggttgcttggtctccaaggggaccctgagaaatagcagcagctagtaatgctccaagctagtaattaatactccaactagaaattatgttctcagaaaacagtagaaaatacaggggccgggcatgtgccatttcgtctctaagttttggccttgtcggaagtggaagccggtgtccaagatagtaaaataagttgctatctacgtgccagggatgtacattataactaaaactagctaccagggagcaccttttatgggccaagcatctgtgttgagagagagatacatatacacacacacacacacacacacgtagatctatatatgtgtatatatatgtgtgtatatatttcaaattaagtctcacttaatcccataccaaaactatgagatagatattattatccccatttcacagatgtggaaactaaggcttagtgagattaagtaattggtctaaattcacccagctagtgactagtagagccagggttttaatccagcatagtgaattccagagattcccaggtaggggcattaatgggtgggtaatgggccaagctgggtgccccgggcaagtagcaggaaggaactgaatggaagaagaagcagcatagcatgtaagtgaatattggagggctgggagtaattagtcttttccctctgctctgcctttttcttatcctcttccctttgctggccttgcatccgtttcctccccctcctccccgcttccctctcttccctcatcttactgtcttgccccctgggtttggggggctcacagtgacattgtgggccctgccataatttctccacttcccttcttgtcttctcccccgtgtcctctccctcctgtccttcttctcttccctcttgccatctgtcttccaattctgctgcacaccgactcttgctgcggctgccagaggacagagtgaggatggagcagagccacgttctgtaggggagggggaggccccacaggtagtgtcaggtctgcggcaggtgtgagaagagagagaggatggcggggttcaatgctcgggcagctggcctgggtgggagtgtgagagatgcctggactgcttgccctgtcagtgcagccaagattatgttggcatctgtggagtcatgcaggactgccagtctctgggctgaaggttaaccaaccccctttgccaaccttccatacattaactgccataaaatgccatgagtgccagtctcactttgcacaattgatttatttaaaaccaaaatatggaccttcagtcttttattattggttttggcctagaatgtcaatcaagataattttgactcttgatttttgtaatttatcctgttcattatccctcccagctttcatttatttatttatttatttacttatttattgagacagagtctccctctgtctcccaggctggagtgcagtggcacaatctcagctcactacaacctccgcctcccgggttcaagcaattctcttgcctcagccttctgagtagctgagactacaggcgtgcatcaccacacccggctaatttttgtatttttggtggagatggggtttcaccatgttgcccaggctggtctcaaactcctgaccccaggtgatccacccaccttggcttcccagagtgctgggattacaggcgtgagccacggtgcccaataccttccagctttttgaaagagttggaagaatgaggagacctaaattcaaatactgccctggttaactttttaactgtggaccttgatcaagccagatcaaagtttgatttacccagtggttttcaacaggagtgattttggccattaggggatgtttgacaatgtctggagacatttttggttgtcacaactgtaagggtggtactgctcctggcacatagtgggtagaggccaggatgctgccgacatcctccagtgcacaggacagcagagaattacccagttcaaaatgttcatattgctgaggttgagaaacactgatggctaagcctgagtttctttactatgaaatgaatataataatacctagctccttgacttggaggctcaaatgagataagatgtgtaaaagtacctgataaaactgcaaagtgctctgtgggtacccagttcatcagttgatcagttgttattgaggacacgccataccaattggtaatgttgctgtcactaattaaagaagtcatagatagaaaggttgactaggatcagtctcagaaaagaaccttctagggtcctaataaaagcaatttccaatgttcttaagggtctgttatcagtagcctctaggggtatagttgttctaacagcttcaaaactgttcaaccatactttgacacagatttttctttttctgtcttttcatgcaccttggtgaaatctgaacacattctttatggcattcttcctgattttgtatcctgcatcaaaagaagaaatgagattggtttgttgaaactttttcttaatgaacacatgtatatttttagtgatttctatctttccctgtaaatgctcacaaatcacttgttaggtaatccagccctatgtttgccagtctgaagcttccagaatccaatttggcaaaatgttaggcaaatagttacccatctttagtcctctgacacctcttaaaggttattagcaatggttctgtgaatgcagagttgagttctttcagagctatccttgaagacaaggtgtgctgtgagaacccattgtgggtagggccgcatggatcatttgaattctcttttaaaagtgttgatgtggagctttttgagtaaacttgagttatccaggaaaggggaataaggtacaaatcaccttccctctgacccatggtgtcagcacaggcctttaattcaaaaacgtgggactggctcctatgaccacagcagttttaaaactacagattgtgatcttcaaatggggatcaatttagatggttacaaccaatagattttaataaaatagaatatgatagagtagaatagaaaataacagcattcattgcacaaagcaatggtaagtactgttgtgtgaaacttttgttttcagttgtatgtgtctgggtatatgaagaatatactgagcacaccataaattagattgcttacaataaaacatgtcagtagggggacaggcagtgatctctacggacccagtaggaagtggttctaaagtctagaaattaaattctaaagcagtgactcttaggcaggggttttcctaatatctgtgtgcaaagagctgcccatcatcgctcgacagcagtttagaccagctagggaaaggaagggcatggtggagggtctgactgcttccagaagcccgaagagatctcagctcagtgtcttgtgtgttctgcttctgagtttttggctgtcactattcccaacagaaactgcagtcctgctcctgagaaagcagagctgggtgctgtctgctcaccgaagttgaccagaagtggctcttgtaatgtgctaccttcaagggcttctggaccaccctggaggacagagcacccaagccacggctcacatgcctgccttgctccctgagcagccgaaccttattaccatcacacttgaagcagctcatcagggatttgtttgaggcaaaagttcccaggcccaggaaaaagctgaaagctgtggacttaggagccagatgttgagattttgttgtctgctgattgttggctcttgtcaggaaaggaggaggaggagaaatgagagtatattcacagttgcatgggggagttttttacccttttctttttttaaagaagttggtatgttcttcaaacctgagtatttatattttgagcactaacaattctacatttgaagaataaatcccctgcgtgacatgctaccttcagctctcattcttgggactaagctgagtggtgatttgggggtggctttcccttttagtggccggctcagaaatagccagcacacttattacacagactgccaggctctctggaggaagacagaggctttggagcccaagtttagcgtcagctgttctgtggcagtgtagggtgagaattggacctggtggtttatgttaagaagtccagggctgcagaatgggaatgctttctttagaagtttacccccttaaaaataatttccactttcctatctatttaaaggggcttttgaacttgtgtttatgaaatgtcttcccgccatttcatgtgacttgggacacagcagctgggatgatcttccttttacccaaatggaaagttgggttgggctagggcctatggaaaagctggagaagtttagaagccaggcaagcaggattataaaaaacaagaaccaggggaaaaaaaaaacccacatgattttgagaggcagcctagtgtaatggaaagagtgtaagctttagagtcagatgacttagagttgaatcctagctctgctccttggacatattgctgaatttcttccatttcctcatgtataaaacttgaaagttacagggttttgaaggctcttgcatgtagtaggcccttgataaatactgattccctcccaggcgttttatctttgttttttctggggctcttaacttttcctcactggacctttgtaggcacccatttggggttcagcaggtacctgggagcccagaggaaaaagagtgctacagactccaggtgggccctgggtgaccactgaatccaccttcatgatcagggcccacgcaacacagagctgcttccagagctctgggggatttgctattagcttggggtagtttaaaattgaatccatcacaatgacatgatggggagacataaacagaacatttgggagcagagcacagctgctaaggtggcatgatagactgcttggcattacagcattgttatttattagggaaagttgaaatgggtcagagaatgaagttttcctaaagacctcagtcttaggactagcagtctcttttcattgttcctccataaaaatgttttgctctgctctatattgggccaaatgcaccagccaaaatactgttttgcaaatttcaggggaggggatgcggctgctcattgtgggccctccccttcctgctgttgactcaggccagtctaaggcgttctgtgctgcatttgggggattttctggggccgattttagaatgcttgcttactgtgcatgcagagtccccccagccaggccccaccccagcacggctcctgcctctgtcatctgaagcctcatgggctgaggctgggaagagaatagaagacactggtcatatgcatgtgcccagagtttgtttgaggaagagattatacatccatatttccaaagagaaaaaacagaggtttttttttttttaaatgtggcaaagtgtacataacataaaattcaccattttaaccattttaagtgcacagtttagtggcattacatccattcacactgtcacgcagccatcaccaccatccatctctagaactttttcattttctcaaactgaaactacccattaaataatccctctcccctctctcctaggcccctacaaccattaatctacttttctgtctttgtgaatttgcctattttcggtacttgggataagtggagtcatacagcgtttgtccttttgtgtctggcttatttcatggagcataatgtgctcaagggtcatccctgttgtagcatgtgtcagaatttccttcccttttaaggctgaatgataatccattgtgtgtctatatcacattttgtttatccagtcatctgccgatggcacttggcttgcttccaccttttggctattgcaggaaactagttttgacgtgttgagatgcaggcctgatttccctgcctgcttgtgaggtaggtggacacgttgaattgacggtcctgtgtgtgagtgaagtgtgtgcgactgtgtctgagtgtctgtccttctcagttgacgtaaatactagggttatgaaaagtcctgttttatatctgaagaaactctccctgcccactggcttgtcagagcctcttgatgaaagggtaaacaggaggtgagtgcttgacgtaggaggagtgagttatcctgcctcagcctcctgtcctggagagtgtgtttactgcaggctgctgtggggatgagaggaccagtttgggagcctgacagccccagatcaggaccagtctcagaatttctttgttgtgtgactttggctaggtcactttaacttttctgagcctggttgtctacatctaagaggattttgggatccatattaaatgtaacatgtcaaaagctgttgcccggtgcctggctgatggtatgtattcaaaacaccttctcttccttaaagaaacgcttatacactgttggtgtgagtgtaaattagttcaaccactatggaagactgtggcgattcctcaaagacctaaagacagaaataccattcaatccagcaatctcactactgggtatatacccaaaagaatataaatcattttattataaagacacatgcatgtttatgttcattgcagcactgttccataatggcaaagacatggaatcaacccaaatgcccatcagtggtagactggataaagaaaatgtggtacatatacaccattgaacactacgcagccatagaaaggaatgagatcatgtcctttgcaggaacatggttggagctggaggccattctcctcagcaaaccaacacaggaaccgaaaaccaaatactgcatgttattataagtgggagctaaatgatgagaacacatggacacatagaggggaacaacagatactggggccttttgaagggtagagggtaggaggagagagaggatcaggggaaataactaatgggtactaggcttaatacatgggtgatgaaataatctgtaaaacaaacccccatgacaaaagtttacctatgtgacctgtacatgtacctctgaacttaaaagtacacaaacacatatgcatgcacacacacacacacacacacacacacacacacacacacacacaaataaaaccttccgacaaaggaaaaaaacccacaaaaaccttctcctcctttctccacccggatagtgagcatcttgccagggagacaccttgttgtatttacctataggattccccttccctgggcctaccacagtacctggcccgcagcagcggctgctggttggatgcttattaactttatcctggacactctctgggaaacaaaggctgctccacaataggactttccaaaaatgttctgagaaaacacagccccagtggaatcagcacagagctttctaagggggtaggctttgaagagaatattatttatttggatgggtaaattctggattgtttgaaaaacaaaaacataatactggcctcattacttttttcgtcattgcccctttgtctgtgggtagagtgcttttgagagattattggttggaactttaaaaataggccagttgtcagatgtcttggcacgaaaacatatcccagtggctttctttaggaattttcataaagctaaacgtctctccttggagagggctgtgttgatcaccatctgctgaatactctaaagaggtcggagagcaaacttgctcccaagctagtggaactagccagtggaatccagatgtcagtaaagtggggaagcacttgtttgttgggggggaaaatggagtggttggtaatgggagcaaaaagagtccaaatcattttttctggacccttctcccaattcccatccctatccctacccatctgtctttgactttatcagtgagagtcataccagcgtccttgggtggttttgtgggtcaggcagagagaagggtacaaagattgttggtggattccaaatgccaggtgaaaggggaaggagaaagtgctagcataaaagctctgcctgggacccggcaggctgctctggcacagctgactgtggcagcagctctgtggtctgggcagcccctgagtagcctgctaattgtgactggcttcattagcattttgggcagtggccccgagcagctgggctgctgctgtcaagagttgctttgcagatggaagacctccttttctgtcctctcctcttggccctcattactatctaatgccaaagatacagagtgggggtgactcttggcttgggttctgtgggaccctgaacacacgagacaatcctgatggggggcggtcaggagtgggggtggttacattctgagtttcccggaacagctctgcaaaacagctccccaagggatgttgtctaattcgtctttgcatttccagtgccagcatggtacctgccatatataggcagctgcagtttaaaaggctatgctcttttctggaaccctccagggctgcagggatctcttgtatgataatgtcactatttgccatttcataggggcttaatcattgctgaaccctatcagaagtgtgaaccctatcagaagtgctaagcccatttgttttttcttgccagaggcttgggcctgagacttggtatggcttctactttgggtgtatttctcctaaggaaaacgtagggcaattgggagctttatcctggtttctttttaaaaatagttgttacagacactcccttggctggtcctggcaaagactcttgaggttgtaggagctgctctttcctcctccccagacacctggggaagttggtgagctccttgaggaaactcggaagcagtatctttttaatctttttacctccatccctatggtcttgagtagagagccacacacaaaaggcccctggacaatgaggagcaatggcgatgctgcccagctagagatccttcccacagttggtatctgtgtggcccctctgtgccaagcaaggccacaggagggcaggagggcactgtgtctctaggtaagtgctccctacagtgctggaactgctggggctgcagtttcatggaacccctcagttttgccagcctcaagttgacaagtgcaaaagcagatgtggtttctgagctcattcatgttcctttacagcgggcagcacccttggtctcagtggaaaaagctgttccagggacagagggtagaggctgttcctatgttggcctctgagctggaggctggaaacaagggatcagggtgtgatgtgggagggcagatggcacagaagactccaaaccctagtgttcccctttaaggcccacttttggttgtttcactgtggacagtgggtgagatttttgttttcatcccgaggatggaagccatagactcatgactctgaagagctctcttatgaataacttacggttctatatctcatggtggaaatatttggcagcattctgcactatttctgccttctcttcttgaccagattttattttgttccactctgatcttattttggcccaagtgtaaatgacgctatagaaagattccttttttaaatattcctttttgctcactgactacaaatatacagtactagagacccaaggcagcaaatgacttgtgccacatcagtgaggcaggacgttagtccctgccagcacctggtgatgttactccctggaggttccagattatagcatcccagcctgaggcttgaagacccaggggacttctgttgtcacagcacagtcaaatcctcttggcaataactcactctccctgcacgtttttctctacctccagttctgctctgtcccctcccattgccagataagtcagccatatgtggcccccagggcacagtggcatgtgcacacttggcaccccaggacaagccttaggaaaaacggacacacacctaaaccctttgggatgtcctttttcgacattgtgcacagctacacatgatctttcatgaaagaatccagatgggagacatgtggcaggagatctccttttagtgccagataggtacagagtcctctggtctttaatgagttttacgttgtgttatgtctgtgctgggatggagggcacgttacaccgcacgctgacgcagtttcagggccccagaggatgcacagaggcagggcaggagctttgggtttttcccactgagctaaagggagtttgggggctttgatccttttgaatttcccccatttccccaaaggtcaaactctggacttgacacttaacaagaaatgctcctgggaaccccaatctaataatggtatctcagtgaaccccagggaacttttccacttctttttgaaactgactatggcttccctttcaatctatactagacatgtccaggaatgaaattaggcccactgggtgactagggagttggagacattcttcagccagccagagcctcactgttgattcaagagcagatgcttctgtgatttgccccctgcccatccacccccatggcctcattagagcagacagaactggttcggaagcctgctggcccacatggctttcccttgggttctgctgaagtgccctggtaagccttttagggcggggggtcgctttatctgccattccctttcctttagcaacttgccttgttaacctggggttgctttctgcaataatgtctcaggttggaatcttcatcatccccctcctcttctccctcactctttctcgtttcctcccccatcctcagtttcttgtcttgcatcacattcattggctcagaaccttcctcgtgctgccccacagctcaccgcggcacccagcagccagccgcttcatttccccagctccagagcttcatggatgagaaagtggaattttttttccttgtacaatgttgtggagcttttaattagttaactcatgtgtccattttataaacaatgaactaaacacctgttacatgctgaacattccagcccagcaagccctggtgcctgcccttgaggacgtggaggtgtcactggtcacagagacatgcagtcagatcacagagtcgttgggtagaggctgcagggaggcctgtgagggcagggtcatgccgtgtgggtgcagacagggaagaacagctactgccctggagcctgctgggaggcccagagctcatctgtggaggctctgtgggagaggggacagtcaataacatctttactgttgagttggacttcagtggctggacagggagggaaagatgattccaagttgaaggtccacgtgagcaatggccaggaaacccgagagaatgtggcgggaccgggaaatggtgagtgggtcaatgtcgccaggacttaggggcaggggtggggcagagcgggcatgcgtggagccagggtgctgaacactgagctcagcacgagctgaattttgaagtgccacattctaaggaaattaaaacatcctgtggatggcaagaggacaggttgagttttgaaaggggcgtccgcagatggaggtgtagggaggtagctctgaagacagggactcttggatgaatctcttactgtgttgttcccgttgaagggctgtttccctcttggggcagaggccaactccttcattccccagcttggcttaaatgtctactcaggcattcaaagggaaaaggaaagcaatggtttttcctgaccccattccactctccccatgtaggacctgtgagttggctgattgtgggttcagcatctgccaccctgggaatgttgacccaggggtgtgaacggtggagcgctggaggcaggcaggggccctccatgatgggcagagcagctcagtggccttggcagatctggactctggtcccacctgtgtgcctctagggacgtctttggggccctctgtacttgggttttgttacctgtaagttatatatgagtgactgcttaaccttctggagtctccatgcagagcaaatgaaagaacatatgaggatatcatttgaaaagcacaaggcctgagatctttgcatgcaatcatctgcatttcggtagctgacctttcccagagctggttcaccagtgttctctattgtggaaaggaccctgtgcctgagaagaagggcttttaagagaccccagttctagaacaagtctgatttcaggtttgtatgtactgcctctgtgggtccccttccctggttaaagaaaaaaaaagtgttgctctatcctgctctgctatgctcattgaaagaatggctgctctgtgaatccaaatgcaggccttccatgcaggctttcgagggaggatggtggggtgcacaggttgactgctctgctccctggctggtgctggtctccttctggaagcatgcactaggctggccagctggacagtgagtatctggtaacagatgagcaagtgcttctcctactttgagtttcttgggggtgattctacacttgctttcacatatccgtctggtaacacctggactggtgccatttccttccccttcgttttgttcctaatggccccaacgtcagtactgcatgcgaaaggtgagagagaattcttggtgggagagaatcgggtgctgtgaagaggctatttttctactcacggaagttcatttactctttggattggaaatttccctgacactcagaaagtcagatggtttgtcagtatggaacatgcctcagggaattagcaggatatccataccttctttgactggaatttaatatttcccactttggcccagcaattgaacaaaatctctttgtaatgaaggtaccttgtggtaccttcatttctttaaagtgaagtttggtaagatgaaagctgtgttctgaggcacagatgttgtaagatgtttggtggttgattttgagtcctcctccagcctgtccttgggtagctggctttgccattttctcagatgaagaaaggagagaggcatagaaaagagggaatgatgtgttgctcaaactcagttttagaatggagcatcaagtcggggggactctgagttcagctagagcttagattagttgcatgtctacactccccttcccccgccaccgtctccacttcacagatgtcttatactacacagcaagcaggagggcctttgacatgggtaggcggtcatggggcatagcatggtggagaagaatgggttcttggtacatatacatgggttcaaatcctgtttctgatgagttctgtgactgggagcaagtcatggcatctgcctgagcctctgttttcttaccgatgaatccaggtcatcttagttcctgcagtcagctgcctcacagggctgttttgaacatcataagaaataatggatgagaaagagctccatcaactctacaggtgttaggggagaaaggagagaaaaggaaaaggagaaagaatcatgtaggcagtgggttcctttatgctgggctgctcaaagcacgaagggggaggtgttgcagagttgggattccccagccctctctgccttgggacagttgtcacacattcccagggtctgtgtcttccacccaggtttatgcaagcgtggacagcacagtgacaggttgcagtgctggctgcccctctagggcctggcttccctcagagcatcatggtgtaaagtaggagggaaaaggcaggtgtgagtctgtgggcagacagacctgtcttgggcagagctgcttcggatgacacaatccagggtgacacaatccagtctgattgctacccactttggtaggtagaacgtggccaaatacagctagactctccctgtaaatatacacctcctcctgaggctcaacttgcagagaaaaagggactagagatggagaacaaaggctggaggtgccccagatgctggagtggctgccctgcctgtctcctataccactttcagcttcttttatcttccacagctcctccccaaggaagtctgaatctcattcactaaaggggtcccctctgaagggtactgtcagcccacagcctctcttcataccaaacaccagtcaatcccaggtgtaatttgtttattaacaatcataagtgtcacttatggaagaccttgtatgtgccaggcaatgccctagtgcagctaattcctagcacagtccagcaagggaagcagcctcattttacaggtgaggaaactaaggctcagaatgaatgagtggctttacccaggtcacatggtgggcaaaatgctggagctaggactcaaatttctgcttgctttgctccaaaccctttgctctatgttgctaccttgccttgcactgccagtacacagaagtcccttcggtcattctctgttctcaagaaccctgaatgacctgctgaatgttatttatattttcctagctcttttgggccactttgaccaatggtgtccagtggttcttgccaagactgcactttggaaacatgtgggagcttaacaaataaatccctgtgctagactacactccacaccaactaagccagaatctcggggcggggggggacccaggcaacaatggttgtaaaactcccaggtgataactgatgtgcagccaaggtcaaggaccactgcattgccctcccagccttcagctagtggtggtcctttgactactggagatgagatggtggcagctgcctggggatcctttaggaggctgagaaattcttcagccaggcctttaggtggactgctgacattgcttctacactgcttccacatagctctgagcctttttatgtaatgccctcattcagcctatgagcttataagcagcgtctgaactcccagcttggactcctgagtgacagatgctggagtacaggcatttgttttggaggaggcaggggtatcatctggagagttggaaattttgttttgcagggttgccaaaaacatggccagctagtagacctgcatttgctcccttttttagtgcccaggctgaggcatttaaatgttgttgcaggtgggagaggatgaagcacagatccaaatctgcacaatgcaaaaatatgcaaattgggctttaaaagaaaatgtttatatttaatttttaaatcaaaccttttacctcaatataggtatttttctgtatgccccaggcgattgcaggaaagcagcctggcatagggaaatcctgggttagatttgggctctggatttatcaaattttctgcacttaccaactctgtgcccttgccagggtggttgtgaagaccaacttagagaatggacacacaagctgtcttgcataatggtaggctcagagaacacactcaacacatattaattgctttccctgccttctctgcccaattttacagatggaggtgtctgcaatggtaaactttctggctaaatcaaagggaaatgaagtgtaaccccttaagagcaaaagggctggttctaggtgggagtgttattcacaggctaggaagaaaggaacaatctggcctcggaaccagcaacactgtctgtggactgagaagcaccccacgttaggtcttctcaccagacgactgggtttgacatggtgagaagaggcaggtggttagttttctgaccaaggcgctcagctgaaaggctatcaaggatggcatgaataatttttgccaggtgaggggaggggagtttcagagagcatgcatctcaaagtcttgtcagggcaatgactggacctcagaggctgaccacttcatagctgcggactttttcttagcaacgtgaaagaacacatccacttagggtagtcacagggtgtgtgtgttgggggtggcagaggtcttgcattcacccaggatggggctgaacattttcccgtttgtcccagggacagggtagctctcctgtgccctatgggcttcaaggcaaaagggctttatgaatcctggtgagaaaaagcgtttaaaatgtctcttggccaacagtaccttggtttagttccctcgatctgactttcctgagttgcatcccaactgggctgagcctggtctctgaaaagtccctatcatcaatatccatctctttccaaacgcccttgctgaaaagcctggggcccccttttctttccttcttgtactgtgggatatttgctttcctttttcataagaatcgtggataacttaatacaagtaatcattagagccgactcttcacatcggttcaccagctggtcccggaaaaggaccctacctaacacattcagcattgcctcctctcttggggaaagagctgacacatttctgtgcctcctgctggttctgggatgccctcaggcttccctacctcccccctctctgccaaaagggacttaggatctctaagctgtctttcaaacctcaaggaatttcaggaactcgcttgctcttttggggtcatgctgatttgggcagctgggtgtgccccgccccatccccgccccagcagtcacgtcatggaaaggctggggaggtgggtccgtgctcacgtggtcgcgggcgctgcgctgcctggaggctcagttctgggctttcagggttgaaaacccctccccaagcttagtttgaggccatctgaggccgctggagagttgaccctgctctcacaggtgatgtgttaggatcgaggtgtggttggttccgtaagctggtcggaggcgcagacgctgggccaaagtgtcagcagcagtaggaaatctactgggtgttgaggctttttgcagttcccttttctccctgccctctccgcctggcctgcgctttaactcttcccgggtttgctgcagggttgggagtgagggcagtttcactggtgaaaaggacgctttcagaagccagactcctaaccttctccccagcaaaatcgaatttagagcaataacctttaagttgagttttaaactgtgacatgtccattacagatcattggataaatacagaaaactataaagaaatgaaaatcacccgtagtcacccttttagactttttcctaacattaaaaatactgcttttatttctgcaaaatgtaattttaagtatagtcttgaatgactgatgaggaaaaccttcttttatcgtctttcttctttcaacatcagttcaaaagggaggtagaatatcgacttaggttagtccccacaactcagcttttttgagactatcccaagaacacagcatttcagagccagatagtatttttgagtttatgtggttaatctttccactttctggactgagacagaagtgacacaactttcttggggtttccaaattagctgcagagctggaaccagaagaactcaaagagttctgcttctgaagtcagggtcctcccaaaactccaggagcatggaatatcagagttcacttttaggtcagagattttaaataagatcaaaagcagaaaagggaagaggggagacagggagccacatctgaaaaggggcaattttctttggaattttggtacattttaattcctttttacagatggaaacaaagtgacatttttaagaattctgaatagacgctgtcagccattggaacaaaacacctgcaggaagagatactgggaggcagggagctctatcttagagaggcacccagttctttgggatatgagcgccagtctctgcacaagttgaccccagggactcccctagcctgagtgctggcgtcagtgcttccccgcaggcctgccttctaggcaaccatgtggtctcttcctcatcagtagccctccgcagaggcgtgctccctgagatgcccctctttctgacatccactctgggcctgtggttctcttgctgggagtattgatacctctattgtcacttcctgggaggccttctcttcacacaggaaacctccttcctgacagcagagagcggcctagaataagcctatcatgaacaccgttgtcaagaccacgtaaaaagctcaccaaagccttatcccagtcctggctccttttggaatagataattctccctttttctctctggccaggactgataatgataataataatgaacacttaggtagtgtttagtgctagacactttacattttaatctacacagtgtcccaaattcatttcacaggtgaggaaaccaatggggcacagataagcttgcctgaagtcacagctatgaagaacagagccagaattcacactcagcctggctccagagaccatgttcctaaccactagactagactaatcagcctgctccaggggctcggcctctgccctcagtggcagcactctatttgaggtctgcagccatctgcaggggatttgattttcctccccctttagggaaagcaagtctggggtcactgtggctcctttgccctctcctaagtttgcatggcagccagttttcattttgtgtcgttttattttccataggccacatttatcatatttaataaccaaatgttatttggttattggttattttgtaaaattcttcacatgaataacattagaaaaatagtctttgttagcgtccatgtcctggtttggtatttggacaaattgtggaggtgtggccagagagtatattctggagttggacaaatctatccaaatctagactctactattgactggcaacatgtctttcttttttttaattccttcgtttcatggttttcaatgtattcaagtaatgcctgtacaagcttgatatagcacgttaaataatgcacgcgaaatacctgtacaagtgaaataatacaagatgcatgaaggtgaagctcctcgtctcctccttcagtcctgtccctctcaatcagcattagccacgttctccagggcagcctgctgagcctccacatggttgttttcctgcctataacaggaggcgaacgccctgtgatgtatgtaatgggtgctctttcagtggtagtcattgttatgaggagggaacacatgtgcattagggctgcagtaagttgcatttttgccatgggaagagaaattctccacctttcccgtcagtttctctttgcttctccatcttgcagcctctggcacagcccagagtccagtggtatccggcagaagcagtgctgtgcagctctgagctgggcccttaaggggaagagggagtacctccagcaatattcagggtggatgtgggttccagggcttctgatcctggggctgggcttgtctgagattcacaggaggttagagaactaaggaggaaggggagaaggctttaacccacccctctgctgtctctctctggaggaaacctcaggcagctctgtgtacttccccctctgcacacacacctcttcctgccttctctaccctgacaccaaggtctctccccagccctggtggcatcgtgcctgggttgctaataatagagaagggtgaatctgccaggcagtgaatcagaaggctgtcccagctctgttcttctgccctgatcctggcaaattcttgtgggctgattcggtaaatatccttgtgagcagaataagtctttgtgtgttctggaaactcctgctgtccctgggggtaacaccctcttggaaggatgatggggatgcctttggcctcaagatcttaggacggcgtttcaaattgctccaggcttccaagctagcctgggctctgggaggagggtttgcaggtttggagaaggagctgcttcccaggtgctcaggggatggaagtgagaatagggagggtgtggagggtacaaagagactgtttagttcttgcgtaaaagacaacacaatatggtccttccagttctttttagagctcaaaaggtgaaataagaataaagaacagcgatctgcagttttcctattatccaaaagcctactacccaattcagtggattgttttggcaacttgcttggataaacttatttagaaattatttcagaattcctccaggcagttaccctacgtcctttttaagtcaaggtgtggtataagtccattaacgaattaaaatacttccagatttctgtgttattctcaaggcacttttgctagataacaatacctcacacttggacggtgttttgtggtttgcaaagcactttcacatctgttttctcacttggttgccataataaccctgggagccgggaagggcatgtcttgttattatccctattttgcagatgaggaagccaaggtttttagaaggttgggtggcctagtcaaggtcacaccggtaggggaattggggggatggaggaaactagagctgtttttccttaaccatcttgcctctcactgagatgaaacagcaggatggttcctgggacccaggatccctttgaacgcttggattaaaataatttatgagttctttgtgagtgtgtgtggacctgctggtagtggcttttcttcattagaatttgcatgcaagattgacactaagatggctgactttcaccatcccaaaccaaccctgtttttgcaccgtgctgtagtggtatgaattaccttgcaggtaattgtggcttaggtgatggtacacaaaaggcatcatacagcagccagatgttcattttactaaatggaaaatatgactcagaacacgggccaatctgagcctccaagcaggcaaattagccattgaggatgaagtcttcacctctggagaggagagaatgtgggagcacagagcccagagtcaaatgatttggttgagatccccccactttggttatttagacttgcttatactcctctgaccagactatgggatcttctacagaaattctacagaagtgtgggcagaattacaagtaaggtgggttgaggaagtgcacaggtggaagtgtagccgagaggatgcgtttgaggagcaagaggctgggactcaagaaggctttatgcagactcgaatcttacattgataacaagcatttgcgtagcacatacgagtttcatcctatgaaggattccataggattctcacagcagcccaaggatgtgagcagagcagtaaacaatatccctgttttatagaggaagtagaaatcgagaagcaggaaggttgggtaatttgcccaaagttccaccactagtaaatcgcagaactgggactaaagcccaggtcttctgaccctcactgggcccagcgttctttccaatatgtcatcctgccattttccccttccttcctcctccccacagctccttgcaagttcagcctgctggaggtaagggaagtgatcatgagagtttttccagtgctgagacgttctggaaaaaacatggacctgtatctgtgtcctgatctgtgcttcgtgattggactgtcttgacactcgtctcaggactctggggagtgcttgtgcaagtgtttcccagtgtggccggcttcttgaacgctgctaatggaaagttgtaagagttctattttcctgtttcaagcgagcgtttcccccttggggttatagcaaccacttcctcctcagcacccggtgggtcgtggtaaacaccagttacagcagagtatccccttctgacaacctcattggttcctttttttttttttttttttttttttgcctgtaagcacatacacacagagttctgaaggctaggtctcctttccttctggtttagagttttcagagtaccctgctgtggccttggaaacagaaaacccacacagaggtcaaacgcagttctcgtggagtcaccttgtcatcctgctttgttttggaaggaactgggtcggaggcagcacagtaggactacagcatctttaacccttggtaggatggctggatccgctgaacgcttgtgggtaaacaggaagctcacagcctcagtggatcattaagggtgatacagaatagacacgaaaatcttaagtgggatgggagcagagcaggacttggtgggtagatagtgaggaaaaggaggcaaatagggatggtgaagaaatcgaaagggaatgggggatacaaggaaagggtcaggaaagggtgagtaaaaggtttaaagagaggtgctaattttagatacttaaaagtattttaagtatctaaaacttgtggctgggtgtggtggctcactcctttaatcccagcactttgggaggccaaggcgggcagatcacctgaggtcagaagttcgagaccagcctggccaacatagtgaaaccccgtctctaactaaaaatacaaaaattaggccaggcacagtggctcacgcctgtaattccagcactatgggaggctgaggtgggtggatcacgaggtcaggagttcaaaactagcctggccaagatggtgaaaccccatctctactaaaactacaaaaatcagccaagtgtggtggcaggtgcctgtaatcccagctactcggaggctgaggcaggagattggtttgaacctgggagttggaggttgcagtgagccgagatggtgccactgccctccagcctgggcaacagtgagactctgtctcaaaaaaaaatgtgtatatataaatacttaaaaaatatttgtaattgctggtttggggttactagaatctcttctgaatctgtctcagtttttcttacagcttttaaaatccatggaactctatcaccaggagatgattgtggtatggagctgatcaccccggagttagtggggtggcaactgagatcggggggaaatggagcagtttgaggatatatgggccgtgaaaacctcccagctctgcccccagccatgccatgaaagtcatggggaagaaaggcccccatttgtgtgtttgtgttattaaatagaacagtaacagagcaggtctctgagcctgcctggcagaaatctttctgtagcaggagtgtcctgcaactctctggtggatttgcaaaacagtacagatagaaaaacttaaatgggaaacaagcttgtcttgtcctactttgtggagatagataataaagccgaaaggccaagaagtgtaaatatatagcatatatctaatgtatatggtatatgtacatatcaatctatagctatgcaatatctacactatttatctatgtttatacgatgactctaggcttcagaagacctgtcaaagatttccatacatctagagaatttagaaggatccctttataggtgagagttgagactttttggctgcaggttgggatttggtggactagttcctggtaccaccacctagttgccgtgattatctttagactaaccaaggcccttgtgttagccttccgtaaatcatccccacccctaagcaagacagcacctataccttcacagtttctccagttcatccctgttttattttatttattgttttttgagacagggtcatgctctgtcacccaggctggagtgcagtggcacgaacatggcagcctctacccctgtgttcaagcaatcctcctgcctcagcctcccgagtagctgggaccacaggtgcgcgccaccacacctggctaatttttgtgttttttatagagacaaggggtctcaccatgttgcccaggctggtcttgaactcctggcctcaagcagtcctcctgcctcagcctcccaaagtgttgggattacaggcatgagctactgcatccggcccatccctgtttaaatgggaatatccagaagattgtccttgtcatacactcggtgcattttagagtgtcttcaccacttgtcagaaacaggattctggttgggaagggccatcattcacagtgtggcaggtttttgctttgttaattactggaattggggtacagaagccaaatgcaggttctccacctgggaccttcttcctgtttgtctgcccacttcacacctgtcttagcagctgcagcctgaaatagtgagatggctacattgcctgatcaaatctgggatttatgtagtgataacacctcccaggagatagatttcttcgccctaccccagtgcttcccacacatgcccatggaccagctctttatctctggcatgaagattcctcccacttccctgttgctgagatccttaggcctttagagggcaattctttcagcagggattgcagctccaggttagagtgggagtgagaagaagccatatgcctcacaccgaaagacagccgtggtcttgtcgacctaatatctgagccaaggtggaggacagctgcccaggacacacttccaagttgccttggggagtgctctgtttggcctttgttacaagcaggttttcaaaggcaaaaggaacaaggaagtgggctgatacaaagttgtttgacaggaatcctccctggtttacagagataacattggatagtgattgctctacactgttgaactatggagtacgagtgatggtgtcaagcatatgtcattttatggctacttagcatcagttagtcttgagcccacatagcaagtggcttcaagaggtgattatttagctcaggcggggagtgagacgtgatcgctgtcacacgctgtcacatttcggtgcctctctgggtttgataattaaagggggcttggattctcagataaaaaatttttatttctcagtctaaaatggagagttttaaaaaaatccatcttcctctctcacttggacaattacagcagcttcaaaatggatctttcttgttttcaccctttctcgcctgctttctgttccccaggtgtacacacagaagcagcgtgagccttttagaacataagccagactatgacactcctcactcaaaaccctccagcagcttcctatctcactgacataaaatccgaagtcctaagaacagcctaaaaaactctgcaagaactgacctcatatgtgatatattctcctctttgtttactctgttccagccactttgctgttcctgctggcctttgaagctgcccacacacctgtctcaaagcctgtgcacttgaccgctccctctgtctgcagtgccataccctctgcctgtgtatggctcagcccctcacttcctgcagaaagaccatggccaactaagccagcacacccctctccccgcctccctggggttctcccttttcccctacctggctttatttatcttcaggatgctcatagctgcctgatgcaatatgtctttatttgtttatcatctgcctgtccccacttagaatgtaagctgctttaaggatagggacttcgttgtgttcactgctaaatcacctgcggctagaacagtggcacatctgtaaatatttgtccaacagtgaatgcatgtgtgcatgcatgcgtgaatccattagcaacagcatttattgggttcttttacttggcatcacatttgtagcaaggagtacaaagatggattccacggtccctgccctcaggggctcactcctttgatctgttctttgtggaagggtttcccacatcagtctcttttctgatcctgttcttacccatgttgtttgaatattgggaaggcgcctccaccctaggagtctagctgctgtctgtcatccgaatggtcctccactaatgttcctgggcttctagagatccttggggtcttcacggagcagtcaacccattcagggaacagttttcagtcctgagctcacagaacctacaggaagaaagccctatttctcccttagctgaagggacattttggagagtgctgtgttctcagatcaaatataggaaggagcactgaaggtgtaagatatggtagcagtttctttatgttacttgtttatttggtgttctgtatattttttacattgtaaaagcaaactaaccaggctacagaaatttcgaaaataaaaagaataggtatcatcataaccctacgatcataatgatgaaacagcttgattctatgcattattaattaattggttaatttgtattctaccttattcaaaagatttgtggatacttacaaatatgcatgtagtgcaatagaatataataactgagaaatgagagcaaagggttaaatcgttgatcaaagccagtataaagttaatgtgcagaaatgcgtattagtacaactactcttataaattggtatatttcttcttagcctaagtctgtatattttccgtagctaattctgctccctgccccttaatcttatagcaacattttccacgtttctttcttaaccctgatagttaaggactgaacgatccatcccaaggatgtgcctctaatttgtttaatcatcctctgttgttggaagttgggctattttcactactattgttattagaaacaatggcataattaacatcttggtgcatgtaactttttccgttttttggagtatttccttaagtagatttccagaggtaaaataaataactgaaaggttgaaacatttttatggcccttgcagaatattcctgggctgctttcccaaaaggtcatgtgtcttggggatgcctcccagcagtgggttggcatgtatcacaccttactctcctcctcaccaacactaggattcactattgaaatttttttttttttttttttttttttttttgcggcggagcttggtggctcacgcctgtaatcccagcattttgggagggcgaggcaggcggatcacttgaggtcaggggttcgagaccagctgaggcaagtagtgaaaccccatctctactaaaaatacaaaaattagccaggcatggtggcgtgcatcttctagtccaggctactcaggaggttgaggcaggagaattgcttgacccctggaggcggaggttgcagtgagctgggattgtgcagctgcactccagcctgggcgacagttcgagacaacatctcagaaaaacaaaaacaaaaaaaaaacaaaccaaaaaaacattttttttgttgctaataggcaaacatatattattatttcattatatgtatgttgaattatatgtatgttgccaggttatctactggcacctgagattgtttttacccatttgtttgagttctttgtatataaaacttaacccttcaagcatactttattttgtaaaatattttctgcagtttatttgacttctgctttggtttgcaggtgtctttgcttttgatactttgagttttcacgttttggatagtcatagttcttggtaattttctctgttatttacctagagacagtagtccaagttcattagcctggcagttgaggcctgtggtgatgttggctttgttattccagaagactcaccttctgttctcttaggaccttcttgttgggaagctgaatcagtggtgcatctagcatattttacaccaggagtacatttttttttttttttgagacagagtttcgctcttgttgcccaggctagaattcaatggcgcgatctccgctcactgcaacctccgcctcctgggttcaagcgattctccagcctcagcccaggcgcccgccaccacgcccggctaatttttgtatttttactagagacggagtttcaccatgttggccaggctggtctcgaactcctgacctcaggtgatccacccgcctcggcctcccaaagtgttgggattacaggcgtgagccaccatgcccagctcaggagtagattttttaaaatactcccctcttctatagtaacaaaattatttcaataattaagaaataaataataatgatgatgataatggccagaaaataatttcagacagttaaacatttctattattgaattttgtgtatatgatgccagcaataaaaaaaggggggcagggagtaatgaatttaatgacgctaatgcttattttgaaaaaggggaaaggttacactttcatagtggtctgtagcagtaatgaataaaaactatagtttctggttttgagtcttctgtaaattgatcagacttcgtaaatactgatctttccctattcatcatgatcaatagacaaagccgcatttgttggtctatcttccctcaaagctggtcgcagagcactttttattcctgttaattttgaaaaatttcttttggttgaaacagcagatatacaaataggataaatcttaaacataaaatttggcagaaattcacaacaatcccatttcacagtaaattccagacattgcaacaaagtcctgttcttcagttcttcaggattgattaacatctcattgttgaaaagtcagaaacataaatagaaactcccaagtggtctggtagaatgagaggatggaatagcccaggttctatttctttgtctttacaatgactgtgcttccagcctttatttttggtctggtcttcaagcttaggaacacatcgtaccacaggactcgggggacgagccaccccaaagtgagtgccactgataccgaatcctgtgaacttgctcttgaaacatgggtagctgagtccacgggtgtcaggggctggctttgcaactattaatatgagttatttgaattaacttccatagagaatgtaatgtttatgaaaaggtaattagtctgtgtgaatttgaagcttacatatattattaaaagtcaagaataatgcagcaattgttcagaattagacaaaaggttgttgggggaggtgttggattatgtttaaatcagaatcgccagctcatggtcatggtaaaaagcccatcagtttcagtattgttttaaattccttacagacaattttccctctttttgcctccctctggggcaaactgctccgtgccaggcccttagtgctgagctgagccaagctgttggctgtgctgttggctgtgctgttggctgtgctgttggtgcttttttgcttctaggcttttgcttatgcttttctcaatcctgaaataccaacctccacttcgcacgcgcgcgcgcacacacacacacacacacacacacacattttcctcatctttttaagacttagcttaaatgtcaccttttccatgaagcttccttaatttttaattttttccctttttctcccaaagtaatagcttcctcttctgaattcctgtagccctatcccagatctgcaggagaaagcactcacagctgtgcccagtgcatccagggacagcactgatgtcagaaaatgtgggtggtctgattggacaaaggagtccaggagccagcccaggttacctgcctgggtcctggttccagagctcctcttgtttgcctctctccctgatgggctggccctggttgtgggacctcactgagtctggatgctgctgcctctggttcttggcctctgggtgtgaggcaacccttacttaacttacctttctgcttcagaaaccccgcccttaagccagaccccacagtaagggctaggcattctgagcactcttccgctttctcaaccagactcttgggtcttggcggggttcccacatgtttatgttagcctatatttatcgattcccaactctgggaaagcagtgtgccaggtagggcctaggggttcagcaatgaactggccatttccagtcctcaaggaatgctcactctagtgggggtaacactcatgtcatcaccagatcacgtgaatgtcctctcagcagagaagcagatgcgtgtgtgaggtataggggagaagcgattagcctttttgagtgcattgggcaaaaagtgcaaagaggaggtgataattgcgcatggtaaagaatgaagaagagttctctcggtaggttaggggaagggtcttccagccagaggggccagcacaaaaggttcaggagcatgaagcagtgtggtgtgtgttggcaaacacaaccagatcagttttgcaacagcccagggagtgaagggacgcattggtggggagaggcgagagcccttgagagtccatgtgtggtctgtggtctttgtcctgcaggctttagggaagccacagaaggtttaaagcaggggagggacatgatgaaattggcatgatcagattgatgttttagaaagatctgcaaggctgatgagtggagagtgggttgcaggaaggcacacccaaggcaggacaggctgttgtgatcctggagagataggaagagcaaggggtgctagccgtagggagagttgtcagggtggtaaattaggaactttagtgattgactggctgttttggcagccctgttccagaatcgccttagctgtccctgagggtagatcttagggtctcccatggaatttgtgatcctcatatgttcagcatggtcccattagatctgtggggtcagtgtgctggggcatgacgctgcacatgctctatcttcccagagcccctggagcccctggacaccagggagccatgtccgtcacatatgatgccttggtaaggagctggtaagaagcaagatgacctcttgctcctgagagcagcaagcacttacagcttctccctctgagcgcctctggcttgatgggagctggcagaccttgctgagtcttgccctgattgggtggcctgagtcattgctgccacgacaggcaccagatcccaccgtgccatgtgctcccttctggtatcacagctgctcgctctccacatgtggccttaaggagggctttggggcagatataggactgatgcctttatcatttaaacctctctttatcttctgagaagcccattggtagccctctgcggtcatgtctgtcatttctttcatttttaggcaggctggtggggaagaccgcagatggccaggagcttttgggtcacccctcaaaatgcagttggccgctacactgtgaaatccccagaggccacagtgccctgtgatttactcctagcattttgagtgttgagtttcattgccaggatgctaggcttcctcctggccccaccacaggtgcttccgtgagtgtctcctcgcctcacctgggctgggccgtggctgcaagtcccaaacgccaaccatcccgggttctaaattgtgttgtaactaattagaggcagaggttggtcagagtcaggtactgctcagccacgaccacagtgatgttccacttctctgggtggggaggtggtaccgcaggcagggccaggttggtggggctgggtggtttagaaatcctggcttccatctcagcccccgccggtgaccaccgaggtagcttttgtgtgatctgtcgtttcctccgctactcatctcatcagagaggcccgttttgtcttggtgttctatttcatctttcagacccgaagggccacatcttacttgcatggtgtgtgttcaggttttcaagcatgtcccgtgttttcctacctagtcctccctacagttttggggatgaggccttgctgtgcattttcatttctgtttgcagagggagaaacagcagctcagcaaagtaggtgacttgcccgcgttgacatggccagtgagtagactacagtggaggtctttggctttcctcagcactttcccctttgtctctaaatccagcggctcaaactcaaatgccaccaggggccgggcaggtgacctgtgtcagcgggacccagtgacaggggaagagaaggtcccatcttaagtggctgctgctcagccccaggcaggggccgctgtccgggattacaggcccaggatttcaaagagaagttgggaattcggatttttgtgtggaatctgatttttaaatgttagcaactaatttagaaaaaaaatgtagccaaacaaggtgagtctgctggcctctgccctatatcacctggctgctagtcactcacccacggcctttcctcctgactcaggtttacagggagcctctgctggctggctatcctgttaagggaaagggggaaaggaaagggaagaggaaacagttctaggagcttctggtccatttgcgtcgtgctggccacacactgtgtaaatagctcagctgcccacattcccaaggcaaatactttccatgcgcctctttggccaccttgaatcccggggctctttggcagtttatcggctcgcttccttttccgaagattcaaatgacgactgcctgaaaatattttcttcagctgggtttttccttggtgacttcactccgagacagatgtgccctaataatagcattgaaagttaaggggaataagtcagccagctggttctgttccctagaaatgatgttaacagttcctaaatgtgagctctccccagagaccttggaggggctgagcctgcaagaggccgtggtcattgtgagagtctggagtccttctccctgggacagagtccccaaggctctcccctcgtcccaccacgatacgtgtactgcccggcacacagcagatggacattgcaaaggaggtttgctctctttggagatggtcaggggctctcgttcagctcctgcctcctgagcctagaggccccaagcttagtgagacctaaatcctgactgcacaaagcagaccattcctccaagtgcctctctcatgcctgtgttcaggctcactgactggaaggactcccagaagtcatttaagcccgttcttcagcctctatcattccagaatacatttttcagataacctgcttgcattccctcaataatgtttcatttcctctaactcagtaggaaggagatgaaacaagtctaagagaaccaggagccttctgtaagctgtgcaggcaagagagtgacttttgtgggggccaagctttaagatctcttagatagaaaactggaccagcctctacggatgtcgatgctctgtttcttggttttgcttctctgtaaatctgagggagaagacaggaaggacctggggtgcagcccttctttgcctgtctcataggagatcctcacctcactttgtgaaaacccatgctgtctgtaatgatcccaaaagctgctgcaaaatacctcaatataaaagacatgttaacctggacgtggtggctcacgcctgtaatcccagcactttgagaggccgtggggggtggatcacttctttggtcacctgaagtccaggacttcaagaccagcctgggcaacacggcaaaaccccatctctaccaaaaaatacaaaaattattcaggcatggtggtatatgcatatagtcccagctactagggaggctgaggcaggaggattgctgggttgcttgagcccagaaagttaaggctgtaggtgagccgtgattgcgccactgactccactccagcctgggtgacagaacaagaccctgtctcataaaaaaaaaagaaaagaaagaaatgttgaatcattgtagcctaaagcaagaagtgaaggaaacagtttcagggtgtccctgctcccggtgggcgggagaacctggctgcagtagggcgtgcaggcttccagggtaggagtttgggcaagaccccaaggtctgccccgattgggacacaaacctaggagcgcacctttgcctctgtttgctgctctggtaataggaggcgagactggtgcctgcctttctggggccctgggaggctcctgtcacgtggggaaagtgctaagtaagcacccactgccactagcagggcctggttgacagagatgcacggggaagggcgatgagtcaatctgtttatgaaaatcacacatatcgtcacacataccgtcaagatgacccgggggacagctgagccctgagagctgatgagtcttgctcatacttgggggttctctggtgtccctttttggcaacgccgtttcctgtgcttccagaggtctgcacgtgaacagatgcatgactgctgaaccgagacacagggtctctaccctgaacagctctggtcaggagagggaagctgggtgactcatagcagaattcagagctgcgcattggccactgctggggcagggctgcagatgcttctttggaaagcagcttggggtttctggttctctctgcgagtctgcattctcacttgctgagtgccatttagccacaggcacatcagcataatctgtcagaaatatgaattgcaccagtgtagcttgataactgcttataagccgtcatgtggtattcaagtcctccctcaaaagtttccttgttggaaattccttaagtgggagttcccaaaactctggctttggatttagaccaggatgacccccttaaccaaatctcttacaaggtcttttttgcattcccagaaactaattaaaaggcagtgttttgtccattaatgttcttggcctagagaggtaaacttttagcaattggaggttgaggaaatcttgtcccttctactatatccagtagtatcctaaggttttaaaatgtataacctgaagttttttcaatctcaggaatctctgaaaaagaaccaggggttactaaagagctgttcacacagaagtaagtgtgtttcctttagcagggctgtgcctgggagagctttggggagagaagatggcattttagattcttgaactttctgcagaaaacttcgttttagattcctggctttgtaaatgtcatcctccagcatgggatgaagaagtctgtttccacttgtggccacctggcagagctgcctgtgtccctgttgctcagctcagtctcccggggaacaggcagagttacttatttcagatcccaggtccctgggggaggtttgggtggggggattttcaggaaacacgagagcctctagtggctctcctgccaggctgcctcatcgtccgtgcactccctctcacacccgactagaaagtagctcctgggcattttggagttccagaaagactctgtttctgtcaaggaataggacttttcattggggatccacttcctcctggctgtggcctacaccttctgccctttccttgtggaaaggtgggattcaaggctgggattagggatagaagaggaggtggtcagaccctactgctaacatctgctgggctcatacagagctgtctcccatacagttcatccgatccataggctcttgaccttgagggggtcagaccagacagtatacgtgagaggtatgcaaaatgtatctgcctctgttgagtgctcttgtgtatgtaccaggcactgcacacagagaatttaatttaaccctgaaaacaatactttaggatacatggtatttccattttatagatgaggaaactgaagctcagagaggtttggtaacttgcctagtgccaccagccaggagtggcaggatctaaatctcagtttatctggctataatgttacctgttccacatgacaggaaatgaggcagcccagcagagtgatgaagagcttggatccgcagccagcctgcctgactacacatgtacagaaccttgggcaagttgtctcatgactctgtgcctcagtgttcccatctgtgaagtgggacagtgacagcacctctgtgatgggttgagagactcttatcacacacacatagcaaatactcagccctgtgtctggctctggtaagcacacgagctatttcttgaactggcactagaacagctcgcatgctatgggctgcgctcctgccctgccttacctctctgtgggctataaaggaaggattaagcaactctagctccccagaccaggaagctgttcccaagaaggtgtgttgggggtggagatggggctgagtcccctggctggcgcctctgagagagcggcccaagatggactctgcgggtgctcggaggttccagaacttcagtgccaattgtctgccgatcagtgaaggcctttggtaaatttccaccctctgtaacttggccttgttgttttgcatttaccaaagtaaaaataaaatctctggggaggagtggatgagcgcagggcgggagaggatctgctgcgtgttgcaggggtggcccttaaccagctgggcagagcccaggcgccctttcccagaggaaaggctgagcccttctgtcctctgggctttatccattaggaagtcagcctcgaaaggctgcccatccgcctcgtgctcttccccagcccctttggccactccctgtttcctcctattgttggtcccctcctagcctccgggcccagcagcctttgaggcctggagaggcccctggtgtgagctctgcgaggcccctggtgtgagctctgcgaggcctctgttcagcacagcatttcctgtgccttcttcctctctcgcctctctcctctagcccttcattatttttagttcttaagaggatggaatccaggagagaggaggagggaagagccaagttaatgaccttctcaccagagatggagcatttgctgggccctgcccaatagggagggttaggaacatttccattttgggtgaaggacacctcgattcttgagtaaccaaaaaaagactctggtttagcaagattgcaggcccctttgatgccagctcctatagagtgtggatgagggaaggagtgcagacctgaaagagtcgctaaggaagagcattctttgctggtgtctccagtgtccctggctcctgcaggatactggggatgcccacgaagagatgtcccctgcctgccagcaagggcatcacagattgagggatgggagagtgagcaaacagtgactaacctgagtgaaaggttgccctccaaacccttgagtgaaaaagacccctggggcctggggccagccaggctgccagccgtggggtcctggagagaaacccaagcagaccaaacaggaaattcccacaaatatgccccctcttgttacttggagaagtctctagaaaaatccaggtgtgagcaggtgaacataaagcagtgtgagccttggtgtaggtgtgctttatcttccaggcctgggcccttagcatgtgctgggtccgcagggtcctcttatcagccagatgccgggagtattggattcctgccggctgtgcagcctgggggacatagagaaggttaggacagatccccagttccccaggagccttcctgccactgggagacatggtatggcacacaagaatcacgaagcaccccagcttcctttcccttccctgccccacctgcaggtctgctgtgcaggtgccctgctgggaagctctccctcctcccttctgcgtatccacatcctgcatctccctccagcttcagggaggattccaggagtggcgtggggctagagtggcctgagagacttcagggacaaggtagggccagcttgcagattccaggggatctgctggaaggagaggtaggatgtggatacacagaagggaggagggagagctttctgggcagagcacctgcacagcagacctggaggtggggcaggtatgggatggcttgccctgacggattggagtgggcacgccagagagtgagtgtggggccgtatctgggggtggctctgtatcccggagggaccctgctccctcttatgggtggtcagggagccttggtgaggccctgggctgctcctggagccctgtccttgccgtctgggccttgggcaacctcctttggcagggtttagggcttatggtggaagaggaagagtggccatgatggagggcccctgggtgccagtctgggtgctgcccttggcctagaaactaggcctctagttgcaacaggaagaaggcagctaatcaggagacagctgggcagtcactcagggttttcctggttttggccagaatgtgctgctaggggtcgattgaccatggtggcgtccctcaaaaagagtcagccaggttgggagctccagccttcagcccgaccaggtctacgcactgcaaaccagggacccggcagccctcgcagcctgattgggtgtggaggggacagagcgctcacctggagctagtttagctagctagttcactgagctggttcgtgtagcccctgcagggggtcccggtctgcaggggctggtaaggacccatcatcctcgttctcctgccccaggcccagcagttgcttctgaaggagggacttcaccaacccgacagcgctcagtaatccctaccctacgctcatgggttccataaagggcgggggagaagaacctcgtgcctggtgagcagcgctgtggaggatgttcggtgccatccagcctgcgggaacatcacacggcgggtggagacgggggatgaaataaagccttactcgggtcttttctgaaagtgcttttgcatttggcatttagggggattttcttgtttgttaaagggggaaaggcagttagtcttacatccagacttttatttttagctggagctacctgtcctgccaagtccttgggcttaatttttccgatccttggtgtcttggttttgaaagcccttcccctccttccctcccagctcctttttggcaggggcaggtttcgcttttggccccagccaggtttctaaccagggctacaggagggagctattgagccaggggcccctacctgcctgggcttgtacccagctgccgccaacccagctgggccctgccagggggaatacaatgaacaaagttggccaccgcctccactctgcagcctaggagaagcaccaggcttttccccagtgaaggaaataatgatcactagggaaaccctaactgcttttttagaaagaccaaatgaagaaggaaggaaaaaaggattttttccaaacatggaaaactcaatgactctcactcagacttttgcaagagcaaaacaaaggctttgacacagaacaaattctcccctggcaggggcgttcttcatccactttcgacgctttgttagatgtgccttccccgagcgtgtgtcagtaaggacgttctgggaacagacttggagggaggggagagtaggcctttgttcaggcctcccccatctgaaaggtcactcttctgacaaagcccttgctgtttatgtgaggctattttataaataggggggaagcagatagccccaggtccgagagagatgatgggagcccagtaatcctgttggctgagacaaaatccttggaattaagtggcacaaacctggaagctgtgtgaccttttgcaagttactaaacccctctcaacatgtttcatcatttgcaaaatggagacaacaatatcagtgttgtgagagttacctgagctattagcttattagtatctaacactatgttagacatgtaacgtgatctctttgcacacacgcagcagagttcggctggcaataccgttttcggagtgttagagggtccagggatcatttcccatttctgatattttagagatttcccctcatctcttttacccaacaacaacaacaaagggagactctttctttacgattatctaaagataaaagccaagtgatcaaactatttaaataaaaagagaagtgctggaggaaaaagtagcaaattgagggaacaagtcaggtgaaaaagaggctaagaagagaatgtaaaccccctctagaaaatgaaatttgccaagcaatcttattattcaccttgaaaatatctttctttggcagtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaatcacacagttagcctcatctgatcaccactggccacgatcaggccctctgaaagtgcctagttggatgcttgccaatctgctatgccttggaggaaaaaatcatttcaatttaagaaaatagacacagaagcaaaaaaccaaagtgagcctggaaggtttgcctgtctgtgacagtctacagagcagctgtttgtgcctgtcacctgctcaggctctcacggtgactgcatggggagggcagggtgtgtgcattgatacctgccgtgcccagtgtacaccgaggtttgcccatgctgcagctggaaggctgcagaacaaaggttcgttccaacctctacacttgaattgcattctgcgtcatcatcctgccttctagaacaacatccaactccgtgggctgccttttaaaatcttgatggagggggagaggagtatgtatgttgcttcagcccttaatttgcaaggtggtgaaaccactatgggcctggccaaatcagcaagaagggggctggaggaagggcagctgtcttggggtacactgggactggaaggagctgccttcctgaagtcctccttgcttctctgaagttgtcccagcacagctgtggcttccgggagaggaatgtcagggccctgataaggaaatgaagtggagcccgcacctgcccagaatgtgaaatttcttcagcagcctctgaccgggctccagatgggcaagtgcagcccctcccacacctgctgagtttgatctccctcctcctggatgctgtgaggcttggcacctgcccagccaggcactcaggaaacctgctgggggtctctgagcgcccaccagggtaaaccaaggtccctttcttgtgttaaagagaagaactgggatggaagcgtgcccagggctctttggaagcacccaggaggggcaatggaaggcttcctgggaagagggtttctgggttgcattttaaaatacacacaggagttagctaagtcctgagcatcctcagtcattcttctgcaaagtccctaatagcagaagctgacacccttgcgggcctaaggtggcgtggggacaggtgtgtggagcaagaagttgcctgcagaactccacaggcctgagagaatatgagcccgggtgcgctgcagatggtgccatgtgtggatgggagtgggggtcaccagggctgccagtgacctgcagtcctcacgacatacaagtgtctgcccccagcgtcacaaccctttcttctacccaccccaaattgcactgagaaatataacattggtttggaggggcgggaattggctggaaagaagacaggaagcagaccccagggggcatgtgggctgagctgaggatcagacagtgctggccctgggtggcttggcctcctgcggagaaggctgggctgggcagggcaagtggccactgactggctcagacagcactgcagggacaggaagcaaggccagactctgaacaacatgcagaaggctgaggtctggttgcatcctcaccgctcctgccaggcctttccaggggacttctctgagccccaaaaagagagccacaggtgccggtggccttgagccctcccctgccctaggattgaggagcctctggtcattggctgtgagcaggccacagaggcctgcaggcctggggtcacctgctgtctcctaacgggggccatttcctccccaggaggcagggcccatttcctggctgagcagtcacagggcatgagaagggccccgagcttggtgaagttctgctttccccatcatgacattcttactgaattttggacaagggacccctcattttcattttgcatgttatgtagatgatcctgatgatagctaaagcattttgtaagtggggtggccagaggcccacacatccccacagcctagagtagggtaaacctgggtctctccttcccctccttcctccctcttcttcctcctgccctcctcttcctcctcccctcctccccacctcctcttcttccttcttctctcctcttccctgtcctcttcctcctcctctttcctcttcgtaccctcctcctgctctcccttctctctcctcttcttcctccctcctccctcctcttcctcctccccctcttcactcttctcctcttcttcctcttcctccttcctcctcttcccctgtccccagcagtccttttttgcctgccttatgaacgacaaaggctagacctggaggttatgcccgtttgccctctgatttgttgaaggcagtgtttccgtacagcatgactgaggatgcctgatgggaaggacccggggaggatggcgtcacccaggaaccgttagcatcacgggagggttgggacttgatccagaaaaacacacagaatcagaccctccccaggcagccccactggctcggggcagctccaaggatgggctggaggtggggaggagtaactgcttgcccaggaaggctccacacccacctgccacagaaccctgggtctgttttatggctctgtgtgttgagcaggaggagatcattctgtgtaggccttggcccccagggagtagattcccatctgctcttcagaccaggaacttctgggaaaaggggaagaggaaaagggagacaaaatgtggcatgccctgagcttccccaaggcgagggcttcctactcccaggtgacgtggggagcagaatcgggagctggggcaggcttctctctgttgcaggggaatgtggctgctgtctgccggctcctcaagctcccttcgcctctgacttcctgtctcctccaatgcaaagatggttggggttttgttgtcagattttttccctcccactacaaatctctctccacattctctgaatattttagctctttcaagtcgggtgccaggggacaaaaccacaccagaggtctccaggcctctcttgagtttcaaagaatcactcccctccccaccaccaccacccctccctcaccctggtccggctgttttctgatcctttctttccacatttctctgagtgaattgaagctccatctttccctgcgcttctggagttcagcacgagactctcttacagagcagggtccaggttgcaacaggcaggggtgacaaatgtcagcagcaggcactgcccaccctgcctgcagaggagcagctaagcaaagctcagaccagtgctcttgtaaccaggagtgcagccacctagggagttccccagctggttcgcatccaagcctgtgaggccgggggttacctgaaagacctcatgcctggtcttcagttggtttaaccaccctgcccagaatcaaagtaaaagccgtgtgtctccagcccactccactgccctttacctacccaggggcacccctgcgttgtggtgctttcctttccaccgaagtgtcctcaagaacatcacaagtgcagaactccatccggagtctagaagtgtctggctgctctgatctgacacatgggagagcttaaaccttgtgtcatctgacagctgcaccggaagtggcacctgagcagccccagggagggatgtatctggggtttcggtggccagctttaggggcaccaggggccctgggctcctctgctaacggagcagccagaaaacttcactgggctggcaccctggctgtccaggggaaccgccctggaggaatcttgctcttgtccttcctgcccagtcttctgcctcttgtcccctcatcctgctgtctcgagactggaaggggcactcggaggtgggccctcactcgttgataggcacggaagtgggtgaactggctagaggctccccatgtgcatggtacctactggcagggcatagaatgggatgactttggagaagtaacttgctgagcctcagactctttcatctgtaaaatggagaaaacactcctaactagaacataggaacaaggccataattctctaacccgggcctgtcacatagcgagagccccataagtggtaacaggtatgagtgtacacaccgtgccatggtactggtgcacgcctgcagaaatgggccctcctatctccccgagagatgacaaaagcaatgccggccagcagcaagtccccctgcacagtactactcagccagcttaggaagaaacccagcacatccactggctaggccgaccccacatctgtgtgtgaggaagtaagggtcacagcagagctggccacctgccccaggtctgccaaagagaggctcacagccccaggaggccagcagggacctgccacacatagggagctttgggagcactccgggaggtgtccacaagggatgtctcgattcccctgatgactgggaggtgatgcaggagcaggtggccagctctgccctgggcaggggaccaggtaccctttgccacaccacgttcaaggcatttgaaggccacttttgtatttcctagagctgggcttgagaggctggagacctgggacggggtctgatttcagacagagaagagacagaggctgctgtggagagctcactcttgaatatctcccacaagggagggctggaggggcacgggataaacccctctgggtgggattcttctgggttgtcctcctttcttgccttgttacctgtcttatctgggggatgaggcctggagtccatttctgaggactggggcttcctccagccagtgcttggagggagggctgttagcctgtccgctcctggaaagcggcgtgtgcctggagtggatttggttcctgaggcagatgctgtggtctccccgaccatcacaaggacattgattctctggaatctcctcccatcctttagttcatctctgctcctaggggctaggctggagtggttggggtcaccctgcagccctccttccctccttcccccagcctggacctggaaatggctttttctgtttactgcttggcagtgacattaggcactgcctgggtgctgctatttaaaaaccatggggaaaccctgtgtgctgctgctggcagagagaaaagaggtctccagtgcaagtgcatggcattctcacaagtggaatattccacggccctcatccaggcagagcagccttgggactgggggactctcagggccttggccacgtgggacctattttcatggtgaagaaatggaggaggtgtgggcagaggggagccaagcggtaaaggtgcctggtttggtcagagctcagcgatgtgagaggcttgtggatcctttgaactgtcagaagacccccaccctggagcaccccctcctttctagacccctggtctttagcctctgggagaggtccaagaactggaagtttcttagcttcaaatggccttgcagaggctaagccacactgtctcgcccagcatctgttcaccttcctgggtcacaggctccctgctcactgtgtcttgtgggtctctggagagctgcaccccaacaggatgggcatgaccctgccccaggctccgaggtctttattgttcagaacctaggccagcaactccacctagcacaggactgaccattcttgaagtaacttcagagacacctgggtcccctccttgaacacagagggctaaagaccctcccacagacaccctggtacccacatctcctgacagctttatctcctgggagaatgggaatctatgtgtcgctctttttacaaacaaggactaagaacttgttcaaggtcagtcattgaggaggaaaaggggagccgggactcgggcccaggttggcctgcctcaacgccccacgctctcccgaggcctcgcctgctcacctatctccctctgtctgcagcccccatgcccatagcaggtctggttcccaaccactcccagttccagtccccgggcctttgtccccacactcccgctgccagctgtagtcttctctttctctccactgagtctggcccccagctgtctctggtgggtgcagcctccgtaagctccctccttctccacagtgagctgccttctagggtcctgggacccttcctccatgcatgctcatttgcctcctcctgtatacataaaatataaactggcacgctgcagctgggagagtagccctctctagtcttcctcggaggggccattgctgttgggatgagggaaggtcactttccagggccctagagtgtccatccatccaaggagcctggtataccagctgtctgtccctcaccggacacaggaaactgaggccccaggagggactgtgaaacagtgcaatgtgtgttctcccctgatagggacatggcatgggttagggcgagccctggattgagacactctgggctcccctcctcccacaccacccctgaagcctgtcagcccctgtcctctctgagctctgctgcagggatgtgacccacgggtggtgaccggctgtgcactctccccctggacccaccgtaatggcttccccctgagcaggggcgtccccacgagccactgctgggctcatcttgtgtaatgaggtttttccattgttgccctcatgcattgtgtgccctgattgtttatgcagccttctgggtgcttagataagaaatgcctccgctggctctagccttctttggcgatctccatcagaaggatctaggaaaaacatccttgtcagtaaagcctcggcccttttgtcacatggcctcatggggcgctgccctctcttaagaatagaattggtcttggcggtggggtgagagtttctgggatggggataagaattaccaggtttagtaaggaagaattcctctccttaaatagattttaacttgaaaacctgatgacagaagcggctgagtctcagcaaagagagaaaaaacaaaggaggccgatttcaccttgacttcaccttggggacccagcagccgccgctgacccctgagggctgcagctgggcgcttcggggcaaggagtgggaaccacatcttcagtgtgtccccctgtcaggcagtaccaccctcatctcctctgcaagccacatggcttctgctctccgtggtttagctggtccaggatccactttctcaggaactcacaatgcttctcattcaggttctcatcgcccccctgaggacgggtgtattttggggacacttgatcttcatctctgcagcctgttcttattaaagttcacttaaggatattttttctaaaaatatgttttttttttgtttttttgttttgttttgtttgtttttgctggggaagaaaagaattttattaattttatttattttcaagtagttgtataaatgaatgtttaaatcccagcttcgtcatttacctctctgaggctcaggctccaccagatggaaatagaaaagaattgacttgcatgctcattgagaaaataaaataagatgctcaatataccttagttctcctttctgcccaaagggcctgctctccccaaacacacatgcacgcacacacatgcacacgcacacactcatgcacacatatgtgcatatcacacacgcatgcacacacatgcacacatcacacacatgcacatatcacgcatgcacacactgatgcacacatatgcacatacatgcacatatcacacatgcacacacacgcacacatacgcacacactcatgcacatatcacacatgcacacacactcatgcacacatgcacacaatcacatgcacacatgcacatatatcacatatgcacacatacgcacacactcatgcacacatatgcacacacacatgcacacacacgcacacacacatgcacactcccagtcctggctgttttcactgaagaaacatcctgagagggcggagcgcggtgcagaggagagagctgtgggcttgctccctcctgtgtgacctgaagccatcggtgcaggttctgttctgaggaatttctttaaagtctctcttcaaaccactcgcaggcaagaggtgcctctggtgcctccgcatctacgaattgaatatgaactaatgtggtgcggctgggtggttgtgtcctctccagccttccttggaggggtcgttgctcttgggacaggggagttcccctgagcattttgctcaggctgtttgttaaatggggtaaagccacctcccaccatgtgccgcataggtgatggtggtggcaaggtcctcagagcccgtcaagggcccttcccatcttgtggccacaggcaatgagggcctttgctttgaatttgtcctaaccagaaattagtggttgtctttctaatgtagagctttttgtttgtttgtttctagagcaaatcatggaggaagataaaaaacatggtgcactggtctcccttcgtcatgtccttcaagaagaagtacccctggatccagctggcaggacacgcaggtagacacagctctcccagactttcccagcatggtgctcagccctctggggaggtgccctggacgctgcattctggggatcaaagctccagagcaagttccctccaagactttctagtctgaaatcacagccacacttgcaggctgcggccttaccaatgccttgtaaatgccatagacaacggacctctctggagtctgtgttacccccatcctccaaaacatgcatcctcccctccctcggtctctggctcttatctctgtctcttccagtctctttctttctgtctctcttcccgttgtattcaataagacagatgaagccatcagtctttatagcttacctgccatttgtcaccctggacaaagaggcaaagctaaccccttcattgagcacctactgtgtgcctaaattgccatggtcctgggggttgcggcattaatggagatgtagtttctgccctgagggagcctgcagctggtggaagatgcggccaagccaccccataactgcagggcggtgtgcggtgttgggaggaaggtggctaggagctgagtccaggcagtgccggggagaagggacatctggagccgaggccccagagccatctagcccacatgtaggaccctctggaagcactgtcatctggagacatgtcaggggctgcctgtggacttggccttcgtgacttcaccagcctcctcaggccagcacaaggtcccgcatttcgcttacctcgttggccacactggcccaactcaaggcacatggatggacagcctgtgtgaatacttacttggtctggctcagaagaagtgccacccaggtgggctgagccttaggccccccagcttctcagcctgctgtatctccccaccttggctctgaatcctgtccaatcagggtttctctactgaggccaggagacaccttcgttgccgagaagcagggctgatgatggaggtgaggatgaaaatagcaacactaaggaatgactgggtcgtggcacctcagtctctcacctagctctgtacccttccagcagggaacactggtgaggaggagtctggagtcaaggaagctggggaaccagctcagaattacagttagtgagtggggactaggtcttgaacccactccccttaaggtgctcagtccatagcagggacatagacacaccttcagccccaggcttagccatccccagggaggcccagaccctgtgctggggagggtgcctctgccagctacctgcagccggagaccaggaaccttctacacttgctctccagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggtgagccaggcttctcgcagcccacatgcctgcctcagtgcaagccacatggcaggtgcacagcgtggcactcagggcttcccggaggcctcacaggtgcaagggcaggctgaggaggctgttggaccaattagagcctccccatccccaggcatctcccattatttgcagagggttccgggacctgggctttgcccatgatggcccctttccttctccagtgagcagaagccaggggctggcggaaccagaaaaagggcaccggctgggttctgaggccccctagagagaaggaagagagagctgcccttggttcaggtgggatcgctgggggtgcggggagccaccaggtagggaggtcgcaggatggtgacttcctgctgtgtgagctgcaggggagatgggaatcgaggtctttccatttccccagccctggtgagtgggaagagagagtggctagtagaacatgctggtttcccaaaaaagacctgtatctgcctaaaaggaggaggaagcccctgacggaactcaagaaacccacatggcaggtcaccgcagggccccaggtgagcccggagcagtcactgggcctgtgtgcaggactggctcccacccccaggttcctgacaggggctcaggctcaccctgacacctgcccaggggataagcctggagaggactccagggaagaggagagaggaagagggggcttgaggaggcagggcagagagcagacagggatgcctgaggccggctgctgtgatctcggggctcagttttaggcagccgggttttctcattacctctcaaactgctgcccttccaccctgagtcatccacagcacggctccttctcccctgtgcaggcttggtgaacctccctaaggctgtcggcccccatggtgtccagcgtgcggtgctcatgttgtggggctggccctcactgcagcacccgggctggacggccagatgccaagcccccccatgcttccttgcagggctgtctgggaggccaggcacggagactcagagctcagagcagaaggctgtgtccactgtgactggtttaaccggattatttctcataagagcagattgagaaagaggggtgtgtgtgtgagagagagagagacagagacagaggccaggagagaagagagctaagccagccagcatttctttccttctttcctttcttctctctcctcctgggagttctgtcctaaaatcacaccctgccactgactgttgtgttctctcgccatcactcacagggaaagaatgggggatggagaagcacaggccccactgtttgctcttgagccatccctggccacctccctcccaccatccaagttccttactatctttagcccacagggacctgggatagggcagggaggagaaagaacatgcccccagccagcccgaggcctttgcttttcccgagtctgatttctgacccaggatggcatccactggtgcaccagaatgtgtcctctcaggggaggcccagcccttccttccaacccagacagcagcaggacttcgcaggtgaccacatggagaataatccaagtggtgtccactcagacctggccaaaaaagtacggcctgtgtgaagaacactggctgggcatttctggaagtcggctgtcccaaagacacagccagccaagcacagggccaggctgccccagaacctgcctgctcctgctggggacaggagccccgcttcctgccccagggctgcccccacccagccgcttgacttccgcagcttctctctgattgcaccctagtgctctcaagagagatctagagtgaccgtggctggtacccatgtaacccatcttggcaggcagagggaagaggatgagagaggagtatgtgtggaggggaagaggaaggtctccccagaagcagggtgcacccagcccgatctttcctgcacacaaatcctaaggacccttcttgttccaagggctatgctagatgcttccattatttatcccattgcgttctcaccgccattctgggagatgggtcatgttccagtgtaagcaggagggttctgtcaccaggaggttcagtgactcatcagggccacccagccaggcagcagcttggtgcagttctgcaccaggcttgcttgactgcaaatcaggcccccagctgcagcccagcccttcccaagggggctgtgtgggacccagcttccatggcatttccctggggtgccaggctagttccatttgggccatggactgtgccttcccccaaatgcgttcatccagaacccttggctgcagggcctctcccaagactggctgctcatggtcacctctagaatgtggcctttccatgacagggtgaggaggctggagcccagggttacctcacatgctgagtcccagggcaagagagtttgagacatgtcacagagaaagggaagggccggtcaccaaacaatgctgggcatggcgggggcagaagggtggcactaaggagaatgtgatgcagttgctggtggcgtctgcacgtcggggcttcttgggactctggctcccgccgacatgtgctcagtggctctggggcatgctctgagatttgtgacttgtcctggagagtcaacactgtcttcctgacattgggaccaggggcctggggagtgcaggtgagagcccgcccctagcacctaggagctctgggtggctttcgcctgccacctgttggctccctgggctggcctgtctcaaaggagcacttcctccacctgatcttgagtcccctcctcccccagcgtcctgtgagtgggcgagcaggtctctgcttccctgcatggcttggagcttcgactttgtctcgggcaggcaggggagtgtggggaggggctgagcctcaccttcctgtgggcatcccgccccaccatccagctggcaccccctgtggacatctccccccagcctctttcctctcctgggcagtgagtgactgcccgctttgagccacgggggccctttttggagaaaggccatgtgaaaagggatttcacattgaggtctgcttcctgtttaagggggtgctgagagctctttgcagaagtgcagccacccaccatgcggtcccctacagcgccctcaggagtccctcccacagcctggctgccccttttctacacagtacacacatggatgcacacgcagcccctgcctcaatgcccccgtcaccactgacctggctctgcatgtgaggggtgtgctctgtgcgtgtcctgcatgggtgcacctgtgtgtgtgcagtggtgcacaggagtccgcgtttatgtgcatgtgtgtgcatgagcacatgtgtgtgtatgtgcgcacatggttgtgtgtgcatgcaagggcccaacccaaagctactgacttccccctccagccctcatcacctcctggaaggtcctaaccagccaggcctaagttcacacccaaaggatttgtttttttcttcccttttctttccgtgcaaatttcaattaatacagtggtttctaaagcctgtcatttttaagaggctgtagtttttgtttagtctgttctgggtcccaaaccagcaacttggagaagttggtgggcagtgttggaacaaggcctgggagacagatgcaggaagagtggagggccaggtggagggcaggcgggcggggcctctgtgggcagctcccgcccacacagggcaaaggggagaaaacttccccatcctgcaactgacactgctgatttctgcctcctcaagggctgtgggcagcctctgagcctgttgtgtagggagactggggctctaaaaggagagcagaggagcgggggtgggatgactcaccccacctctgctctggagaaggtagaagcgcagagctgtgtgctgggggaggtggcgtgtcccggcagctcagggccagcgattcagcccccggctgctcaagtgctctgctgtccctgcccctgttaccttccccagtgtctaggtggtccccgccagttcagctggagctgctcgtgtggaggccagggccgtgaggcagttgagttggaagcattttctcaggctttttggactgggggctcacctatgaggaggcctggtgtcgatggggtggggtgcaccaggcatgtctctgggatgagcagaggctgagggagccccctgcctttcccccacaatacggccttctccatccacactgggaccccttccaaggccactttctgacctgaactttgtgctccagaagatttcacctctttggaaagagccagagacacttatgggcaggctcagccttcaggctgcctgagagcagcagagatggggacttgaggacagaccacttctcccaccaggacaggttctggctttggaagccctcgctttatggaagggccgaggcagccaaggggatctagtggggccctgagtagaccctgcccccagtcccctctcttagctccaccgtagcagcaggatcaggaccagccacccccgacaccccctgctgccctgcctccgtcttccttcttctgctggttcctgtgggggtctcccgaggaggagctccttgggctttgtgaggccagccgatgggcttggagtgaaagtgaaggcagtccgattcagtgaggctgcaccttttctcctggatcaagagccaaccccaggctgggtggtggtgcacacctgtaatcccagcactttgggaggccaaggtgggaggatcacttgaggctagaagtttgagaccagccggggcaacatagcgagactcccttatctactaaaaaaattgtctaaaaaaaaaagaaaagaaaaattagagccagccccagctggaacagagtctgccgtcccctcggaaagacgtgccttgactcagggcactgagctgactgcagctgttgggcaacacacgccccaaaccttcatccaccaggcaggaaaggagctgctggtgagccctgccccaggcctcggccctcatgtcgccttccctcccacgtaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaaggtgaggccggcgagtgagggcagcctcgggccccacccgtgcccacctcagggggcttggcttctctcagcgccctttggaagctgtaagcttctccaggcacaggctcagaatgtgggtggcccgccccaaggccagacatttggagacatcagcctattcctcaggcgggatggctgtgtagggggctcaggcctcagagcagagtggcttctagccctgcccagctgtcagccctctgccgaggactctccatttagcccagacggtgcctggcaccgaaagccaggcgagaggcacctgcgggatgcctgtggggtagctggttcattctgccatggctgcaaactgggactggcagacaattcggggaagggaggagcatgctgaccgcctttgatgttggagccagggtctctgagaaactgcattctctctgctttgctcttcgatctttttttggaaattttaaaatatttattggaacagaaatagaaacataagctccaaagaaacaacatgacaaactttataagtaaatgtaattttcccctaattaatatatttactttgtgtttgtggtttacaaaatgatggctctttcccttctatccctttgtacctatgtgtatctggcaggaaagttcttagctctggctatgggcacacagaagcttcctatacatgattatgttcaaatgttgatttactttccccagaataaattggggaactggcactgtctggattggtgactgtctggatgatctccctgtccctgggcccctgtgtgcacccttgctgttaaatttgcaagagccgggctttggggcgccggcccctcagggtctcagaagctgtccctcttgagcagatggcagtccctgtggggttgtcgggtctcccattctctgtccagtcatggtctgcatcatctccagtgtccagcctggagtcagggttgggcagccgatggtcctgatgggagggtcccctgagcctcctttcagatggcatttagacgtagcttccgcagctgtcaatggctcgctgcccacggtggcatgtggggaagtttttaccttcccccgggacagctgctttgcgagctctgggctgagaaaggcatttgcccccttctttgtcttttgaaaccagcccttccctcttttttgcatccagctctgagactggatgcaaattccgtacccatccgccttctccttaacgctcgctttcctttctttattagaaacaatccactttcccttcacctctccctctcgagcaggatgtgctcctggtctctgtctattgtccagccgtcagaacagccgacagcctgtcttcccactcagagagaagccagctgtcttcaccatcacctgcctgccccgcccttagctaagaggctctgcctggggtgcactgcccacagcccccggctctcggcccctcctgcacccagggctgctccctcagccccaggtcctgccagtcctgtcgaaggcagccacagtgaggacacagctgaagtactctccagcctgagggcagacacggcccactgttgggactcctggtggagcattccctttgtccctaaagaacagatttcctcataggtcagcaaagccccacatgagggcccaggacagcctgaacagagatagtgctggggccaagaagatgggagtggggtgggcgagggagcagagatgggcagggctgtattggatcctggctttcagaaaacgtgaaagaagagatggtagattataaaggaagtcaagctgagctcagggcgggagcaagtctctcctccctgtgctgaggggaggtgcctctggcgggcagggacctccgggcaccggttccagggcccgggccccagagtgggaagtcgaggccgaccctctctcttggccctgctgttgcacccaggacaggccagccccgggtcatgctcctccatcctcagcctggatgcccttcacacctccgggcctttcctaccactgttcactcgcctggggatgtcagcgccaccctctgcgttctcctgtgtctgggcacagggcaggctcccctctgctgtgcacgccacctccatgcgccatacgtggacacctgggtgcctccactggccctgccccaggttcagatggggctcgcctgctctgtggtgttgggtgggtgagaacagtttctgcccgagggtccctgctgaccccctcctgggtggggtgttctctttctcagaaagaagacggcaccgtgaaccgggacttcaagaagaccaaaacgagggagcaggtcaccgaggccttcagagagttcactaaaggaaaccataacatcctggtgagtctggcacctccagagagggtctctccagccagccagggagggacaactgtgtctactctggaggtgcccatggggaggacaaggcacccccagggacagcacaccccagcccgagttcgtagggctctgtagagaggccactggcagagacttttgtggctctctcactctgccctttcaaaagtcaaaggcacgccgggcacagtggctcacgcctgtaatcccagcactttgggaagctggggcaggtggatcacctgaggtcagaagtttgagaccagcctggccaacatggtgaaactccatctttactaaaaacacaaaaattagccggacatggtggcgcatgcctgtaattccagctacttgggatgctgagacaggagagtcacttgaacctgggaggcggaggttgcagtgagctgagattttgccattgcacttcagcctgggcaacaagaatgaaactctgtctgggaaaaaaaaaaaaaaaaaaagtcaagggcactgaagttagtacccaggaaggtttgtatccatcctggccccaggcttctgcttggaaagtaaagaagaaggcgatgtgcttgtccctggcgtgcggcgggtaggcggggaagcttggcggacactcactgactctcccttagccatcggccccatagctccagagagcatttcccatgccctgagagagagaacagtgcccgccgtctgccaggtgtcatgccaagcgtgcagcaaatcttcacagcagacctgctgtgggtagacctgcttgtccccatcttgtgtgcccgaggtcacgctgctccctgccagcaagagctggcgagctgtctccgagtccaggagtgtgggttgtacaagttcatgacaaagttctgtcttgtgtgttgctgctgcagcggctcgcagactggatagatgctctgcccacagggaccagagcactgacccttccagctgagtcagggaatattgtgccactgtgccccaagtgcacggctccctgggacagtcagagatccaggcacatctgggacacgggccctggagcccctgtgaatggcaccttctgaacagtccacagcagctgcagagcaagtgggggcggaccaggcagccgtttctccaaggagactcagtaccggctggaactgggaaatcttccttttccagctggggaggcttcccttggctcctggcaagctctgaggctgcaggcagggggaatgtgcctgactctttcgtagcccaagtcctccaattcctgagtcccttgcaggggaggatctcagcccctaagcagtggccaccatggaacatgcctcctatgcctggggtttgttcctggtgctgaagactccagggggctgctcggctggcccggccagctgtcactcttttccagcaggcattgaggaactctgtgtacctgtgtatgacgagcttcccaaggcagcccgggggtgagacccacagagctggcttctggggaagatggggcaccccccaaggccagcaaagcttgacatgggtttatagggctccatggagagggcactgggagagatatttgtggttctctctcttaccctgtcctttcaaaagtcaaaggtactgacatttatgctgagaaagacgccacagcagccctgctcgcaggaagctgcctctagatgtccggcgtttagggtaaagcacattcacgggagggaccactagaggccgcatgggtgttctgacactgcccttccccacgcggcgcttaaaaatctggtcctctttctattcccagatcgcctatcgggaccggctgaaggccattcgaaccactctagaagtttctcccttcttcaagtgccacgaggtagatactgggcttttgccctcttgagcagaatgctgcgcgtgccaacaggccttctccttctccttccagaagcccggggcatcgggcattttcagggtggtgcagccagaggcaggccatcagggaccagaccctcgctgcacgggggagctgcgtctcaatgcttcctggggtgaccacacgggctgtcctgcctgagacccctggctattgccccctttctcctcccttgtccttccagctccagagtcttgtccattctgggcagtggtggcaggactcatatcccacacacccgtggtctcagggcagaagctctctgagctgctagagtagccaggcacccgccgaccgccacctacatcttcagatgagaccctgaggagggcaggcaggtcttcaggtgccactctcgggcagggctggaatctcccaactttgcatacgttggttggcaggggcagcaggcagcaggtggggaactgagacacctgagagaggctctgggaggtgtcggcaggttccctggaggggtgtgagaccctgacatggggagtccaggtccccagccacatgacacattcacacacacattcacagatcccacactcatcaatcctataccacacacattcacagatcacactcataaaccctacatgcacacaccttcacagatcacactcaaaccctacatgcacacacattcacaaatcacacacattcacacacatgcagatcaatcacatgcatgcacacacattcatacagcacattaacacaagtcatacgtatacaaacacacacatgtattcatatatccacacacatttttgtgtgcacacccactcatacacaaacatgcatgcctttcccagtctcacacacacacacacacacacacacacacacacacacacacagagctgcagtcctggggctggctaatcccatgggtgggtgggtgtgaagcgggatcctgcggctccctgcagctgtgtaggtagttcaggaaagcagcccctctcgtagggactctcttgtggaggtcctcttgtatggggtcttacatggaggtggcctcagcctcagcctatgcccacagagaaggctgcggagccagcaggaggaactcatagggtcagccctgaggcagccagcagggcggtgcatctttctgcaaactacaccaccaggcctcctcaggcagatggtctaccttgctctgcatgtcattccctgcggggcgcctggagaggatggctgcgaggagggggtggcacacccagagaggagactcaggctttgctgtgcccctagcagggagctcggtccttctcggaatgttctttgctctccttgtcccccagaccctcagctcctcctgtggcctctcctttccacttgatgaagcatcctcctgccacctgccagagccccctttgccccagctgcctctctggacgatgggggtgctgcctggctgcctgaccccaggggccaagcctgggagaacttaaggccacagagctctgtctcaaagccgttcccacccttcttcaacacttctgcttttatttcttggaaaagcattttgttctacactttttggggtctcccttaaggtctagaaagaggccaaatcagcttgggtctgttgttttccacctgcgaagaggaagccccttttttgggctcagcctcgccaggggccccacctgccctgcactgctggaagctggaatgtcacctgagccctttctgtgcccccggccttcctctggccccactgaggtgatgcaggggtatgtgtggccatatttgggaaagcgcctcgctcccatgcagaggctctgagctcacccaggaggggcaggctctttggtgcccactatccctgggccaggctgggaaggccctatagggtctgcccacgctgaatctgcaggggttgtgctgctggggtgggggtgctgtgtgcatttgaaacaggttcttcaccacccccgccccgggatagtttggacgctcctgggcaccttccccttcactgtggttccctgcagagtgtttgggaggagtcaggttctaggaggcggaagggcgaggccccagattgggttgtggtctagaaagagtggaaagtttgcccaggtgcagtgtgattcatgcccgtaatctcagcactttccgaggccaaggcaggagaatggcttgagcttaggagtttgggaccagcctgggtaacatagtgaaaccctgtctctacaaaaataaaaaacaaaaagttagccgggcatcgtggtgcatgcctgtagtcccaactactcgggaggctgtggtgggaggatcgcttgagcctaggagatcaaggctacagtaagctgaggttgcaccactgcactccagctggggcgacagagtaagaccctgtctggaaggaaggaaggaagggaagaaaggaaggaaaagaaggaaggcaggaaggaaggaaagaaagagggagggaaggagtggaaagtgtgcaggccagagtcagggggtgaaggggtgcctgctgctgcccacacagaagggtggtcgccgaccctggaacccgatgccctctgcccaggcatggccattcttgggccggctctgctgcctgtctgaaaatggggattggaattgcaggcacccaactgtccggcctgagcgagcctccccacctggtcacccaggccccgggccgcagtggggagggcgaggcccgggcttcagctcacccttcacccccatgttctcctcaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagaccagcgctgtctgtggtgtgatccttctggcccccagccctgagacctggctgaggggcaggctggggagtcttaggaagctagagggcccacatgggggctgttaggggagtgggtgtcagactgggtaacattttaatttgtaaagaatataaaccactctccaaaatgagtcttttcaaccctcatgaaactttgaaatagtagctcagagactagaacatcaaccaagaagcactgtccccaagtaggggggtctccggtgcagcgatcgcttctggggccttactctaagctagactggggctgaacacgcccatcggagttcccgttttacccagatcaattccctgaacaaagatttatagtctgttttacagatgaggaaactgaggtttaaatgaagcaacttgacctaagtggggagcagggatttgaatctagaatgtgccttgattgaaaaccaattttgtcgtcctcctaactggcagtgggggggtgtggggagcagtgtctggagggcagaaagcttgtcttatttttgtcccagatcccaggctctaagcctctgacttggcacacggtagcagcccagggagggtctggagaactagttcatggctacttggctggggcatccaggaaagacctttgggggtgaagcccctgccacacatcatgatggtttcaccatctgctaccgtacacttttcctttagtcctctccctagctctggattgctgggggcttcatttgcagaactcagaattctttatttggaggtggaggtccttccttcttctcctttctcctttcttgtttcctttcctcccttcctcctccctccctcttttcttttcttttctcttctcttttcttttttcttttcttttctctttctttcttcttctttctctctctctctctccctcccttccttctttcttctttttgcctcctcctcttcctccttctctctctctctgtttctttctttttttaacagtcttcctctgtttcccaggctggagtgcggtggcacgatcatggctcactacagcctccacctcctgggctcatgtgatcctcccaacttagcctcctgagtagctgggaccacaggcatgcaccaccacgcccagctaatttttttgcattttttgtatagatggggtttcaccatgttgcctaggctggtctcaaactcctggcctcgaccagtcctcctacctcagcctccccaagtgctgggattacaggtataagccaccgcgcccagctgcatcctttctttatcatcactctgagaagtgataggctgtgagtacagatgatgaaagccacagggcctttgcacctgctctccacaggctggcatgtggtaactatgcttccttcagatttttgtgccttcacttacatggtattgttggtgatgctacagcaaccagctctgcaggtgccaagcaatgtccagcaatggagccctttattgccttgagaagggtgggccatccaactgcagaattccaccctgcggtctgttttctaaggagaccagctgtcccgtttgtgtccttgcaaacctggatggtcagtcaccagttgctttccaggaccactgctggcaccaattgccttagcctgggccccctagaaacaggtcactgtggccactgcttggcagcaagtgtgattgactccttagtctcatgggatgtcttcagagacactgtgtgaactgccgtgtctggggacagtcctcctagaggaggcagggatagaaatatctgtgccagctcccgctggctctgtctcccagtggtcagtcttcccggagggtgtgatttctggggtggcaccgtcagcctctccagtaaccatggagcccctgagcctgtgcacagatgtcacatctccatagcatgtccctgcggtggtggcagcattggtgatgtggctccaagaccacaggcaccgtactggccatggctgggtggc

SEQ ID NO: 14091 - DNA, 48994 bp, Human
aaataaataaataaacaaaccagcctggccaacatggtgaaatccggtctccactaaaaatacaaaaattagccgggcatggtggtggacatctataatcccagctactcgcgaggctgaggaagcagaattgcttgaacccaggggtggaggttgcagtgagctgagatcgcaccactgcactccagcctgggccacagagcaagactctcaaaaaaaaaaagtgtaagttagaatcctccttcacccccagatcaccgctatgaatggcggggtgcgtagtgctctgaacttttctatcaggaaggaattcctaaggtggccagtaggcccagctcagaaaatgaccttcaaggggagctcagtatgagtagaggggaaacgaaagacagaatctaaccaaccaggctgaggccaggccttggggcgaatggatcaaaccacatgttccaagggatggccaaccccgaatgccggaggctctggtagaatttctgctactcagtgctttgggccctcagatctgccactgaccttgacattcaagttacagaattgtagaactgaaaggagcctgaaagtccatctggtccttttgcccattttagagatggggaaactgaggacctacaactaagctgactccaggaaggaatctggccaactaagcaccttccagagcctgctgcatccctgcctccaaccacagccctggaggcaggtgcaggagtgcatcaagcccaggcaattagaaagatgagacagagagagagccaggaagcgatccaatagcactagaaaggcagagaaggagcagcatgtctccacagcttgaagccccaggctggtgttagaagctttggcttcaaagtctggctctgctgctgcccagccgtgtgaccctagatggtcacttacccgctgagtctcagcttcctcacttttattttatttttttagagacaaggtcttgttctgtcacccgcgctggaatgcagtgtggcacgatcacggctcactgcagcctcgaactcctgggctcaagcgatcctcctaccttggcctcaggagtagctgggactacaggcatgcaccactgcgcctggtcctttctcatctcacctcagagcagataaccgcgtctatttcatgttgttggaagaattaagtgagataatgcaagaagaattgagcgcaatgcctgacacacagtaggtgcccaataaataactaaaaagaataaggtaacggcctgtaatcacacctgtaatcctagcactttgggaggctgaggtaggcagattgcctaagctcaggagttcaagaccaccctaggcaacagggtgaaaccctgtctctactaaaatacaaaaaaaaaaaaaaaaaaaaaatggtggcacacatctgtagtcccagctacttgggaggctgagacaggagaatcgcttgaactcgggaggcggaggttgtagtgagctgagactccagcctgggtgacagagcaagatcctgtctcaaaaaaataaataaaatacaaaagattaacctggcgtggtggcaggcgcctgtagtcccagctacacagggggctaaggcacgagaatcgtttgagcccgggaggtggaggttgcagtgagctgagactgtgccactgcatttcagcctgggcaacagagcaagactccatctccaaataaataaataaatagtataaggtagggagagagaatgaacacacacgtcaaacagagtggggtgggggatgccaaaaagcactgcaactcagaattttctgtttcaggatatttggaaaatccatacttctaagaaagccctgtctcctgcccaaattaaacagtaaccacccaaggtcagggaaagggccttatcagagcaggtttctctccaaggggcggtttggccttgaccaggtgcactcacctgctcctgcctataagtgtgccccagcccatcccgatggtcagccagtcctgagcacctaaccatgttgggcatcactgtcctcgctgcgctcttggcctgtggtaagcggtggggtggggctgcagctagcaggctgtgagctcgggctggcctccagggcaaggacgggatggggagtgggggggcctctgctctccaggtaagacactttggggtcccctgtgggttcagatgctaccaaccagctgtgtgtcagacaagccacagcctgcctgccaactctgtttccacatctgcaaaacagggaagatgatctgacgtgtccccagttagaaatgaggtgtggaaagcaccacgcaagggggagggacacgagatgcctcatcctgggttcaccccagggaccatcggggtctgcctttcccagcattctctctcccttgaggattctccattccatcattttggtggcgttttcccagattaggagcccagggacttagcttaaatgccacttcttctctgcaggacctggaaaagtcatttcacctctctaaatctcactaacttttttggcaaaggagagcacttaatgaagagtccttccagctaacaacaacaacagtaataatagcagctcctgtttcctgtgtgtttactatgtgccagacgctatgctaggccccttacatgtaggagccaatttaatcctcaaaacaaccttaagaggtagggtctattgccaggcatggtggctcacgcctgtaatcccagcactttgggaggccgaggtgggtggatcacttgagatcaggagtttgagaccagtctggccaacaagatgaaaccccgtttctactaaaaatacaaaaattagccaggcgtggtggcgggcacctgtaatcccaactactcagaaggctgaggcaggagaattgcttgaacccaggaggaggttgcagtgagccgagatcgcgccatcaaactccagcctgggcaacaagagtgaaactccgtctcaaaaaaaaaaaaaaaagaaaaagaaagaaaaagaggtagggtcttttcatagccccattttacagatgaggacatcgaggttccgtgcgacttagtatcttgcctgacatcacatggcaggttagtggaagaggcagaatttgagtccacgtctgtctcgcggaacagcacgtgttcttgaccgctccacacagcttcccagctataacagtggatttactgctctctcacacacacaccatgatgcaggggcctaaaaacagacagaagaacacaggtgtaccgggcactcgcacacatgccagccagttttgttttgttttgttttgttttttgagatggagttttgctcttatcacccaggatggagtgcaatggcacgatctcggctcactgcaacctccatctcccaggctcaagcgattctcctgcctcagcctcctgagtggctgggattacaggcatgcaccaccacgcctggctaatttctgtatttttagtagagacagggtttcgccatgttggccaggctggtgtcaaacccctgatctcaagcgatccacccgccttggccacccaaagtgctgggattacaggtgtgagccaccgtgcccggccaaacgctttcttttttatgtgttgtctaattcagttctcagggcaaactcaccgcattagtgtgattcttcacatttcacagaaagggaaaacaaggcctagagacctgggtggcttacccccgtgacacagtaaaatatcaaccccgtgtctgcccagccccaactctgtgcttcttccacctgcccaccctcccacccctttccccgtgggctaccagccctattcactggttcttctggcctcctgtctccccagcctccagctgtggggtgcccagcttcccgcccaacctatccgcccgagtggtgggaggagaggatgcccggccccacagctggccctggcaggtaagcctgtgtagggctgggaggtacagatagagagggtggcggggtgagggtcccagggacctgcaggctgacacacagccctccccaccctcctgcagatctccctccagtacctcaagaacgacacgtggaggcatacgtgtggcgggactttgattgctagcaacttcgtcctcactgccgcccactgcatcaggtgtgcggggatgataccctgagacctggccatcgtccgggggcggaagcctgatactctgctttttctgagcagcttctccgcactccaggcactgggctacataatctactcacacccagtaactcagttgtgcatttagtcagtcaagtattcattgtgcatctattatgtgccaggaaccagcagtgaagacaaagtctgtgctctcgggaagcttatatttttgtggaagacagagcggcagacaattaaacaaatatatagcatctcaggtgatttaaaataatactaataataaggtattggccaggagcagtggctcacgcctgtaatcatagcactctgggaggccgacgcaggcggatcacctgaggtcaggagttcgagaccagcctggtcaacatagtgaaaccccgtctctaccgaaaatacaaaaattagccaggcgtggtggcgggcacctgtaatcccagctactcgggaggctgaggtaggagaatcacttgaacacgggaggcagaggttgcaatgagccgagatggcgccactgcactctagcctgggcaacagagtgagactctgtctcaaaaaaataaaaaataaaaataaggtcagaagaggacaaacagaatgaggggttcagttttaaaagggatggccaggggaagagctgaaagggggatatttggcaaatatttgggacatttcggagagctaaaagggggttatttgggcaaaggcctgaaggaagtgagggaggaaatcatggatctaggagaagggtgttccaggcggagggaacagccatgcaaagccttggaggagagacctgtcagtatggttgagaaataacgcggaagccggtgtggcaggggcagcgtgtgctagaggagagtgggaggtgagctagagaggaaataagtgcaggtcagtgtcaggaccttggctttgaccctgagtaagatggagctattggaagggtttctgagcaaaggagagttgtgggctgacatatttttatatattccataaaatatttttaatatattttataaaaaatatatattgcaacatatttcattttatatatttcatatacactttttttttttttggtagagacagagtctcatttagtggtaccatcatggttcactgtagccttgacctcctgagctcaagcaatcctcccaccttagcctcccgagtagctgggtctataagcacacgccaccacgcattcccagctaatttttcttcttgttttttgtttgtttgtttgttttttaacttagaagcccaaacctcaccataagttttctattttttgtagagatggggatttgccatgtggctcaggctggtctcaaactcctggcctcaagcaatccccccgtctcggcttcccaacgtgctgggattacaggcatgagccaacgcacctggccggagatatttttaaacccacactgctgggttcagaatagacaggagtaggccagcgtacaagtgagagatagttagatggatgccgcaactgtgcaggcaagggcggtggaagcttggatgagtttattctcacagccgccctgggagtaagttccagcattgcctcccccttacagatgagggaactgaggcacaaggctacacagccaggagcagcaaagtcacaacatgaacccaagtcccttgaccccaagtcccaggcccttcccctcaccctgggaaaggacaatgggaacactctcttcccccaaaatgagtcccactaaagccccgagctccctctctatcccactggctggcaggaccagggggccaccctgacctggaccccttcctctgcccagcaacacccggacctaccgtgtggccgtgggaaagaacaacctggaggtggaagacgaagaaggatccctgtttgtgggtgtggacaccatccacgtccacaagagatggaatgccctcctgttgcggtgagtgacagactgcccatcccacagccactgggggcagtgtggaaggaggggtccccaagacggagccgcagagcctgtcgcaccccatacctgacaccccatcctcaccctggaaagccagcaaatgactgtcttacacaaaatggcaaaatgctaagtggagacaaataccccctcatatccccctcattggccaagactcccaggaaagtccacaaggaaggccccccacagtgtctctccagaggctgggccagcgctcacctttattgagttcctactgtatgcccacattgcaatagacactttatatgccatctgttatgtaatcctcacaacagccctggacaaagaaccaaggctcagagaggttaagaactgtgtcccaggccacacagcccacttcgtggcagaactaggaatcaaaccaggtctgactgggccggccagcttttattcttgtaacatgaaaatattaaaactggcatctgcaagtgccgtcttttggcattagagttctcaacttgctatagcctctgtttcaatggacccacagccagcagtggtttcggacacttccactctcacctccctctgttaaccctttcccgaggtgatgacatgtgagaagaagctatgtcaacagtgcgggtgatcatgttagatggtgaatcgtttgtcctgatattcccaaaggccaagaagaagctggcagtcaggatgtttgtgaaggacccctgagcaccctgggcctgactcccaactcacagcccgagccccttagcctgagcttgtggggccagggccctcctgcccactcaccctctccactttggattccagcaatgatattgccctcatcaagcttgcagagcatgtggagctgagtgacaccatccaggtggcctgcctgccagagaaggactccctgctccccaaggactacccctgctatgtcaccggctggggccgcctctggagtgagtatcgtccctggcaaatcctgagagccttcctgaaggaagcaggacgtcacccacatttgtccaccactttgcctttttgccttcacattttcatgtctttgtaaactttgtaacaataacagctaatatttactaagcacataccatgtgacagacactctagcaagggtctctgagagatgtggtaaagtttagacgaattagaatttgtcaagtgctcagaacagcacttggcacatagtaagtgtcacataaataaactaaaataaaccattaggggtaggggatgacatctgtggtataccgtatgcccaaataggtcccagctgaattaaaagttaaatgcaaatcatgaaactatgggagacttagaaaatgcagatcactatttagaaaatcctgggggagaagtcagctgtggcggctcacacctgtaatcccgacattttaggaagctgaggaggaaagatcacttgaggccaggagttcaagaccagcctgggcaacatagtgagaccctgcctctacaaaaaaaaaatttttaaatagcagtgtatggtggtgtgtacctgtagtcccaaactactcaggaggctgaggtgagaggatcatttgagcccaggggtttgaggctgcagtgagctatgatcttgccactgctgtccagcctgagcaacagagtgagaccttgtatgtatcaaaaaaaaaaagaaagagaaatagaaaatcttgggggtgagaaaggctttttaatgggtgacagcaaagacagagacccacaggaaattattgacaattaaatccccagaatccaacttaaagacaactcaactcaacactgtagcttccttctgccggcagcctgctcctgaccctctgggaccttggcttgcctcttgatgaagggcaggtgtgtggtccgcacactgtctcagccggcgctcccctgggtcctgtcccaggcatctgctccctgaaggcctggggaggggctggactgggcttcccggctgcctccctggtcactgctcactctctccccagccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatgtgagtggctaggttctgcaccttgtccctactccaagtggccaagtggatgtgggcaaaggggggtgcgatggaccaaacccttctcctgggaggagactgagcgagccctggctgggcccagcaggctcagggtaagcccatcaccccccatcactgtggtgagagcatgagcattgagcacgagtatctgagttcaagccccagtcccaccatttatgagctacgtaaacttgggagggccgttgaacctctgacctcagtttttccatctgtaaaatggagttacagtaaccacttcacagggttaggactaaatgagtttaaaggacagagaagaggcttcactgaagtctctacacatgttcctccatgcatttgctccaccagtccagggagaccagaaccataaaacatctaagacaatcagggaatgtcctgttttcaaacacacaaccctctccccattctcaccctccttcctcaccttcccaggcctctagcacagctgcctgcatcctcactgctctgagtagctcacagagtcttagataaggagacctgaacagctagggaaactgaggcacggagaggattaacatcatcccaagatcacacagcaaaccaagagctagtctgacaccccagggcctcccagaataaggccaaggcagccgcaaaccacatttcctctgcctccctcaccatgggcaggctgaggccaaatctgtccactaactaaggctgagaagccaacccacatcccccaccccaacccagtcctgcttcccaagacttcctctgggggggggcctggtggcttatgccctcccggtctggtgcagggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgaggtgggtgctgcctccacagctgtccctgcacctgtcagcccctccccctcactcacccatcccctcactcattcactcattcatgcgtttattcattcattcatttattcactcattcatgcatttattcactcattcatgcattcattcatttattcacttattcagtcactcattcatgtatttattcatttattcattcactcatgcatttattcattcattcatttattcacttattcattcactcattcatgtattcattcattcattcatgcatttatttactcattcatccatttattcactcattcatttgctcattcagtgattcattcatgcacttcttcacacattcactctctcattcaagtaatattggttgagtgcttccagtagcaggccttgagttgggtgccaataaggaaacagtcattgactcctccatccatccattcactgccttcatcaagcacttatgtccccatccaggccccacaccagtctcccccaaaaactgaccccctgagggtatggcccagcagaggagagggatggtgtggatggccatttctcatcttgagagtaggggaacagagggtcaccctgggctgggggcttccccattggggacagagtgtgttccaagacccatttgcacagtggcctgaaatgctgagggcctcagaccccttgaacagggacaaggctggcatgtgaaggccgggggctgctggccatgcccccatggacccaccctccgggcagagccctgtgccaccctagaaggtggcacagccctgagtctctcacactgttctctgctcctccagaaaatgcagctgtgatttgttgctgggagcggcggcagcgagtccctgcaacagcaataaacttccttctcctcgggccacctggatccttgatttgtgcagcttctgttgcttccctcctctctggtgctgcccctttccacactatggagccaaagagagaccccactcagccagtttcccccaccctgcattagacaggtggggaaacagaggccgggagagagggccaaggaaggagcctcctggggcattaatgggaggcagggggctggggtggagagcccagggagtcctgcgtgaagccggaggggatgggagtgaaggacgcatcagacaccttccccgctccatctcacaagctgcgaacaggtgagaccctgatgaaatcactcgcttctccgatcctacctccaccgaggggcctggcaggtcctcacagccccccagcagcaggtggaagacagggtctccccaaaagcagcgtcccccaggccagagagaccaggccacaggaggatggccaaagctcagggacaaccactcctggggaaggggctccctagcagggaccccccacccccaccccgcagcacagaccccatggctgctgttggcaggggctctctgctttgagaagtgtttagtgagccagcccctgtgtccagtcctgtgctgggcatgatgagggtacaggaagaggaagagaccccagcatcatcctcaggagacatacgtttgaagaaggcaatggtttccacacagaatcacagtggtcagagctggatatgctttcattgcattagacaagtggggaaactgaggcccagagagaggaaggagttgggatagctggcaatgcctgatccaggagaagagagttctcctgaggctgacaagaggccaagaggagccagagatgagatagacccagtgtccagggagggacatgccagtgggatcagaccctgatgacaggggcagccagagatgagagagatccaatgtccagggagggacatgccagggggatcagaccctgatgataggggcctctggcctggcctgctcctgggaatgtcctgttctgtgggggtgcccccagcccagcctctggacccctcgctggagagccctcggctgcagctacctcagactggcccaagagttgtcccttttctccaccagactttgtcccctgggagtggggaccatggtgtgactcccacacccccatgatgccaaggcaagtctcaggaaagacttgacttactcaacaagcagtgggagctacagggagcccagcaccacccagacccgggaatccaggatgggggtaccccagctgtgcaggagacagaccagtaaatagatcattaaattccctggtatacatttgaaaacagaaatacagaccagaagcatagaaacaggacacctgaagcagtgtcagttggcgggaggaatccaggatggcttcctggaggtgatgatgcccaagcttggtcttaaaatttgactagaaggtacccaagtacagaacgtagtccttcttaagtttgcttaatctaaacttcattcccacctatcctcttcttttttttttttttttttttgagacggagtcttgctctgatgcccaggctggagtgcagtggcacaatctcagctcactgcaacctccacctcccaggttcaagtgattcttctgcctcagcctcccaagtagctgggattacaggcacgcaccaccatgcacagctaattttttttttttttttttagacagagtctcgctctctcacctgggctgtagtgcagtggtgccatctcggctcactgcaagctccgcctcccaggttcacgccattctcctgcctcagcctcctgagtagctgggactacaggcgccagccaccatgcctggctaattttttttttttttgtatttttagcagagacggggtttcaccgtgttagccaggatggtctcgatctcctgatctcgtgatccacctgcctcggcctcccaaagtgctggcattacaggcgtgagccaccgtgcccggccccagctaatttttttgtatttttttagtagagatggggtttcaccatgtcgtccaggctggtctcaaactcctgacctcaggtgatctgcccgccttggcctcccaaagtactgggatcacaggtgtgagccaccacacccggtctcattcccagctatcttcttttgtgtatgtctttatattgggggttataaatgctaaatgcttgctgtcctcagatcccttgtagttagggagctaattaaaatgttaattaatattacaatgttatttaagcaatgttaaataatatctaacatttattgggcacttagtatgtgccaagcactatcctataggttttacattatctcaatccccagaaacaatcccatgaggtaggttactattaacatcatgcccattttacagatgagaaaactgaggccagacagggttagtgacttcccaatgtgtgaactagaaggtagtggagccggaatccagactttagtgatctgactccagggcctgtgctcttgtccaccatgctctgctgccctgcaatgtaaaacatcctccagaaaaaaaataaataaataaaaacttccctgatgagaaagatctgacatagctggtgctgccccttccccttcttcctgccttgaatatggatgtgatgcctggagctgaggcagccatcttgtggccaagataattacagagatgtcagcttagacctcatcaagctgtagatcccatgccagccaccattttcctctgaatgtctggctacgtgaaaaaaaatacatctgcatttgttttagccaccgaagtagattttcagttacttgctaatcaattcactagggaacagaaggggtcactttccagccaagggaacagcatgagcaaagctatagcgactgcttggaagaaactccggtgttgccagagcataaagtcaggggcaagggcagagtgaccaattgtcctggtttgcctgggctgagttttcccagacatgggagtttcaatgctaaaactggaagagtcccaggcaaaccaagatggttgttgcttggaggggcaagtgacaaggctggagaggaagcaaacgcccttagggaaggccttgtgcagtggtaggggctgctgggacttcctgctgagggcagtgggggctgtagagggcttttagatagagaagtggccactgtggtccgatgtgtacactacagtgtccatcagacagctgtggggagggtgatttggagcaggcaagagtggaggcagacaggccagtaaggaggctgctgcagcagtctaggccagaaataatgcagcccggatggaggcggtaatgaaaaggagaaaagggaggtttcagtaattatttaaggggtacagttgtagcgttgagcagcaagcctccagccccacatctacacaaacttccaggaatctgattaattatcaaaacgattgtttgtcaggagccaggcatggtagcacacacctgtagtcccagctacttggaaggctgaggcagaaggatgcttgagcccaggagttcgagaccagcctgggcaacatagcaagaccctgtctctacaaagaatacaaaaattagccaggcgtggtggcatgtacctgtcgtggcagctacttgggaggctgagacaggaggatcacttgagcccaggaggtcaaggctgcagtgagccgtgatcatgccactgcaccccagcctggtcaacagagtaagatcctgtctcagaaaacgagaaaaaacaacaacaaaaattaccatttgttagctaatacatggtgaaacacaacccacagttcggtttgttcaacaagactgtaaaatttggccaggcgcggtggctcatgcctgtaatcccagcactttgggaggccaaggtgggagtggatcacctgaggtcaagagttcgagaccagcctggccaacatgacaaaaccctgtctctactaaaagtacaaaaaattagccaggcgtggtggcaggcacgtataatcccagctactcgggaggctaaggcaggagaatcacttggacctggggggtggaagttgcagtgagccgagatcgtgccacttcactccagcctgggtgggcgaaagagcaaaactgtctccaaaaaaaaaaaaaaagagtgtaaaattctcagctttggggacaagatccattattatgcccaagaatcaatgcctatgtatggtaaacagaataatgctccctgcaaaagatgtgtacaccccaatccccagaacctgtgaacatgttaccttactcagcaaaagagattgttcagatatgattaaattaaggatcttcccatggagtgaccatcttggattatctgggtggggtctgtgtaatcaataagggtccttagaacagtgagacaagaaggtcagggtcagagagagatttaaggatgctacactgctggctctgaagatagaggaaggggccatgaaccaaggaatgcaggcggcctctggaagctggtaaaggccaggaaatggattcttctctacacctccagaagggaacagtcctgcctatacctggactttagcccagtgaggaaaaactgtggacttctgacctccagaactacaagataataaatgtgtgtgttttttgccactaagtttgtgacaatttattacaacagcaataggaaccagattcaccatccttcctcccgtgttagaaggcaaaatccaaagcgcactgtggtgggtgtagtggggagggagaaggaggggtcaggaaggactccctgggatctggcttgggtgagagtagggatttgtggactttgtcccagaggtcacaaactggtggctggaagggagggaaactggaaacttaggcactgaccctcccacctccaccttctgcctgggggctgggaggcctggaaggggctgctgagagccccaccagccactgatccactagtgtgccattggatgcctaatagccgttgcgtggctagcatatattgagcacttgctaatttgtgttaggctccgcccaaggcttcatatatatgacctcatttcatcctcatggcaaccctgtttattatccctctttacagatgaggaaactgaggctcagagagatttcaaacctcagcccagatcacacagctagcaatggggcaccatgatttaaacccaggtagtctaactccagagcctgtgcaactaacaacttgtggttctgccatgaatcctaaagtctaaggatgcccttgcacgctgacctcctctagtgaccagggaggtgtagcctgtgggggtgccgagaagcctcaataaaaccagcaataagcccagagagacagaggcttgagagaattattgctcccagatgctcacaaaagactttcagccactgtatcagctaccagaggtgtgataatgctgcctaacaacctaccccaaactcctagtggcatgcagtggtgagcacttattgctgacacatctggggacagttggggctgtcaggcagccctgctaatttgggctggactcactcatatgtttaggggtcagccagggttggctgatccagtgtgggtcagactgggcagcctggctctgcatgtctcacccacctcccgggagggccctgcatggcaaagggcatggatgcagggaggatgaagaatcagggccatcttggtcagccaccacatccacattctctctgactcaaatgagaagcataaactagggcagggcagagggagggcactcactgggctggagctctgaactcaccactgacaggcagtcagtggctgagtcacttaacctccctgggcctcagttttccccatctgtgaaatggacacctgccctgtctccttactggggagccaatgaaatgacagaggctagtgaatggggcagagagggccattactactactgacttcgctccctggactcaaatattccctctgtctttttttgagatggagtttcgctcttgttgcccaggctggagtgcagtggcacgatctcggctcactgcaacctccacctccctggttcaagcgattctcctgcctcagcctcccgagtagctgggattacagacacccactaccacacccagctaattttttatttttttagtagagacggggtttcatcatgttggccaggctggtctcgaacttctgacctcaggtcatccacccaccttagtctcccaaagtgctgggattaaaggcgtgagccactgcacccgggcttccctctctctttttgttccttaagagaggaaggctcattcctagcaggcctcagacctcaggcctccggcatatccttgggggtccacttcccagaaactgagtcctatcaagttgagacacaggttgagtctacaaaggtcctcatggcagtgggccaggggaccacgtgaaggcagagaataaacaggcagcatcttcccatagcatccattttctgtgaagatcagaagggaagaaaaaactttatattgaaatgaacccagctatattatgaagttgcaaaattcaaattaagctttcagatgaagaatgagacttccaagacattttgctattgttagtgctgcgtgctagaccccagatcatcactttactgcaaactagagcctgcaaaccaaatctgttttgtaaataaagttttattggaacatggctatgcccatatggctgcttttgcactgcaacggccgagttgactagttgtgacagagaccatatggtctgcaagtctgaaatatttagtatctggccctttacacagaaagtttgccagccgctaaactacttggattctttgatgaaaaggtttcaagaattctgtgctgctctaatatcggaggcccgcaggtctaaggaattaagagtaaatgtttattgcacagttactattctgagtgctttcagtgaataaactgttgtttgattctaacaatcctaagacataaatggtattgttattgcttctctttgataggtgagaaactcaaggaatagagtgaaatgtaccctagcccagtgcctctcaaatgttaatatgcagaggaacaaaatcatctggggatcctattaaaccacagacaccgaagatgggaaattctgcatttctaaccagcgactgagctgtgctgatgctgctggcccaggccacactccgtagagaggagccaaaccacagactcactacacagaggcactgggggtcttaagcccaggcccccagcccctaagccacgtggctcctcagagtagttgttctgaatgagtcacaaaccccgtgagaatttcgcatctggccaggcacgggggcttacgcatgtaatctcagatcacctggggtcaggagttcgagaccagcctagccaacatgatgaaaccccgtctctactaaaattacaaaaaattagccgggcatggtggcgggcacctgtaatcccaggaactcaggaggcaaaggcaggagaatcgcttgaacctcctgatggaggttgctgtgagccgagatggcgccactgcattccagcttgggtggcagagcgagactctgtctcaaaaaaacaaacaaaaaacaaagcaaaacaaaaaatcctgacagcaatgtgatggaacagaccaagcatctgttcctctccctgtttgtagataggcaccccgggccagaaagcctgtgggattggcccaaggtcacacagcaaattcacagcaggtgtttgttcagtggcctcatacaggacaaactttatttttatattaaaacaaacaaagatacagagcagaacgccaaattcacatgaacctttaagataaaatatgagacttaagaaatagttggttgctgtagtgactcatacagaccacaaatgagtccaaactgttacagggattatgggatggagttgggactggaatctacatcttctgacatccagtcccatgggatgctgccccccacccaatctttctcacctttgcaccatcctagggagattgcagaattctttcccacccattttcttacccgtacaacaatcctgcaatccaggcctggatggttatctaggaaagtaaggcccagaagataagtggcttgtccagaccaccacactcaaaattgatggatcaaagacttgaactcggctgggcgcggtggttcatgcctgtaatcccagcactttgggaggccgaggcggacgaacacgaggtgaggagttcaagaccagcctggccaatatggtgaaaccccgtctctactaaaaatacaaaaataagtcgggtgtggtggccggtgcctgtagtcccagctactagggaggctgaggcagaagaatcacttgaacttgagaagcagaggtagcagtgagccgagatcgcgccactacgccctagcctgagtgacagagcgagactccgtctcaaaaaaaaaaaaaaaaaaaaaaaaaaaaaaaaaaaaaaaacacttgatatcaagtcttaaaagtgtggagctggtcttttttttttttttttttgagatggagtcttgctctgttgcccaaactaaagtgcagtggtgcgatctcagctcactgcaacctccacctccaaggttcgagaggttatcctgcctcagcctcctgagtagctgggactacaggcatgcagccccacacgctactaatttttgtatttttagtagagacggggtttcaccatgttggccaggctggtcttgaactcctggcctcaggtggtctgcccgcatcagcctcccaaagttctgggattataggagtgagccaccgtgcccggccgtaaagtgcattttcatccaccagatgaagccctcctctgccagcgttctgcttccccccatcattagagtggccagatcctaattgtgcatgtcggccttgccttctgctacatgtgcacctttcccgcattatgcaaattctgctacatgtgcaccttccccacattatacaaatccttaccacaatgttgtgaaacaatactgggcatgggtttctctccctgtttcacagatgggtctagagacttacatgactcagccaaggtcacattgcaacccctggtatggcctagaacaggctttctcagtctcagcaccattgacatttggggcagggcgagtcctattgcccagtgcattgtcgggtgtttagcagcgtctctgctctcgctccctgcccactggatgccaatttacatcaaccccagccatgacaaccaaaattctctccagatgttgtcaaacgtctcctggtgggctgaaccagccccattgagaaatactgccttagaatgctgtgggctcagcatgccaccttaatcttttcattgaaaacacaactcctggccgggcatggtggctcagcctgtaatcctagcactttgggaggccgaggcgagcagatcacttgaggccaggagttcgacaccagcctggccaacatgatgagaccccccgtctctactaaaaatacaaaaattagccagcaatggtggcacacacctgtaatcccaactactagggaggctgaagcaggggaattgcttgaacccaggaggcagaggttgcagtgagctgagatcacgccacttcattccagcctgggtgacagagcaagactccatctcagaaagaaaaaagaaagaaagaaagaaagaaaacacaactcctctcctcagtcttacccagggaggggaacaaaaacaaacaaacaaaaaaaaaaacaactccgagcaccaacaattagtatttttcttccttccctaacacacaacataatctcttcaaaacagatggaacccatattccaatatctacctttggcatctttttcaaagtatttctagggtgacatttgggaggaaatgggaaaaaaaaatatttggacacaagctcttttttccactgggctttgagaaaaccccatcttgcgtgctcttactgtatctctcactgataagtccgctcataaaaccagggccttatccagggccacgcttacagaactcccacggacacaccatgataaggacgctgctgctgtccactttggtggctggaggtaagtcctgttacccagaggcactggtttcccatgccctggtggggctggaaatgggatcttcctgtcctcccctctcgcccccacccaacccctactgcattcagacctataatcataagaacattggaatggagtttcaaagaattggagcaaagagcaggattctatgacctcttgggatccttctagaacaagggttttctatttggggggtcagaatgcgcagcaagtgtagtttacattgtgtgggtcgctgcttcctgactcaagaccctttctcttttcacagccctcagttgtggggaccccacttacccaccttatgtgactagggtggttggcggtgaagaagcgaggcccaacagctggccctggcaggtgagttgaccacactgtacttctccccgtccctgccccactccctttacatctcccctttgcccttccaccatggcgtctattgtgctggcaaagtgagtattgatgggactcagagagcagcacaggcaactttagcaataagatatatttccggctgggcgcagtggctcatgcctgttatcccagcactgtgggaggctgtggtgggcagatcacctgaagtcaggagtttgagaccagcctggccaacatggtgaaacctgcctctactaataatacacaagtagccaggtgtggtggcacacgcctgtaatcccagcaactggggaggcttaggcaggaggatcgcttgaacccaggaggcagaggttgcagtgagctgaaattgcaccactgtactccagcctgggcaacaaagcaagactctgtctcaaaaaaaaaaaaaaagatacatttctgtggccttggccaaccttgggagtggagggagaggtgcctcctccagctgcagtaaggagctgtcccctccccactgcccataggcagcaaatatagtattactctattaaccaatcagaggcttgtttacaaatgtaccatcagtctaggaaccattcaagactacctatgcaaacattccttgctttaaggaaccaatcagtgctatttgcgcagattaatctttaaccacaggcaaatcaatgttaccaatgaaaaaaatgttttcttaagttgatataatcatagtggtatcaagactaaactgccaagtggggcacaggtgtaaattactcagacgtgttaatggtggggattttaagagaaatgtgtaaagtttacattgacataaacaaatatagtgaaatctcatttatctgatgtaattgggaccgagtaattgaaaagttggttataaagaaattattttaaatcatatatatatagtaaagattttatcttagactatgtaaacaattttttgagttcttaactgtctttttcatataagccatgccccatatcttatctacaaacccgtttctttaaagcagagcagtaactttgagacgttcacaaagcaatctgagttatgagcccatccaatctttccattttctcacagacactacttcaagagcaattttttaagagtcatggtgatccagtctcttccaagcatttaactttgtttccatataaataacgactctctttctgaactcatatttcattggttacatgtttaatcaaatttcattattacaagcataattgatataaactgctttgggagcaaacccagctgaatcaggatgagtttctaccttaagtaggaggagcaactagcagcccactagccttgagcattcagagtgacccatgcagcagtcactgtgtttagagaggccagcgttcattcatctgctccttgattaagagactgtcaatgataggccaggcgtggtggctcatgcctgtaatcccagcactttggcaggccgaggcaggtggatcacctgaggtcaggagtttgagaccagcctggccaacatggtgaaactctgcctctactaaaaatacaaaaattagccaggcatggtggcgggcacctgtagtcccagctacttgggaggctgaggcacaagaatcgcttgaacctgggaggcgcaggttgcggtgagccaagatcacacctctgcactccagcctgggtgacagagtgagatccataaaaaaaaaaaaaaaaaaaaaaaaaaaaaaaaaaaaaaaaaaaaaaaaagactgtcaacgatagaatgatggcagatatttcacatttttttctttttttgagacagagtcttgctctgtcacccaggctggagtgcagtggcacaatcatagctcactgcagcctccaactcctgggctctggccatctacctgcctcagcctcccaaagtgctgggattacaggcacccaccactgtgctcacccatagtaatttttttttttttttgagacagtgtcacattctgtcacccaggctggagtacagtggctggtgaaacatggctcacagcggcctcgaactcctaggctcaagcgatcctcccacctcagcctccctatcagctgagaccacaggtgcatgcccccacacccggttaagtttctttttttttttttagagatgggtctcactatgttgcccaggctggtcttgaacttctgggctcaagtgatcctcctgcgtcggcctcccaaagtgctgggatcacaggcgtgagcctctcaacccagcctcacaatttatatacttggctttgtgtgcttttgccagttcttttgcttttctcacagtcccacagtattttttccctgagaatttggaagaagggccacagtccctctgctacagggccccataacaccgggcgcatttgtgctaagaactaatcattgctgcctacaaaaatacttcctcaccctcttgcacaaaagtattcttgccttgagaaccagtgaatgttaatccatgaagagtccctatgctttgtgcttctgtttccctgcggaaataaggcagatctagctgggtggggactcagatgaggcaagtaagacattcactctggaggcaaaatgtaagggggtagcacaaaactcagcaaccagccaggaacagtggcacacacctttaatcccagctattcaaggggctgaggcaggaggatttcttgagcccaagagtttgagaccagcatgggcaacatagatagccatctcaaaaaaaaaaaaaaaatacaaacaaacaaaaaacctcactaacgaagatgaatgatattttaatgcaattttgtttcttctccaggagacagagtctcattctgtcacccaggcttaattacagtatgagtcaccctgagagccctgcacagtggcttatgttccccatttccagagaaggcaactgggacttggaaaggttacagaattccccaaaggcactgggttagcccggggggcgaatgaggattcaaatctggttcagtgctacctctttagctacactttgctggccacacataatacgtattatgtgggctaaatttcacatctgtacgatggtttcagcacatttttaaattggggggggtacatccttttaagtatcttttttcactttttctaattttaaacatcttttttaagacctcttaatgtcacacaaacgagaaatgccaaatggctaattaaaaacaacaacgttcagagaaaagcaggcatctgccaacaaacaggtcatcgttccccacagttatagggagcccgatcagagcagtccatgccctactgtcacctccctcccctctgcttggccgtggcagggaattgaaagacaggggaggaggaatgaaggaacaggaagggcatggaacagcttcattagagactaaaacagtgtcaaatgtcaccaccttaaagttcttttttttttttttaaagacctggtctcactctgttaattttattttattttaaaatttttttggtagggtcaagttctcactatggtgcccaggctggttcacaaactcctgggttcaagcaatactcccacctcagccttctgagtaaccgggactataggcatgcaccgccgcacccagcggctcattttgggctatttttgttgtagagacaatgtattagtcctgcctcacacggctaataaagacatatctgagactgggtaatttataaaggaaagaggtttaactgactcatagctcagcgtggctggggaggcctcaggaaacttataatcatggcagaagggaaaggaaacacatccttgttcacgcagcggtagcagggagaagtgccgagcaaaagtgggggaaagacccttataaaaccatcagatcttgtgagaacttactcactatcatgaaaacagcatggaggtgaccaccctcatgattcaattacctcccaccaggtccctcgcacgacaaatggggattataagaactataattcaagatgagatttgggtagggacacagccaaaccttatcagatggggtttcaccatgttgcccaggctggtctcaaactcctgggctcaagtgatcctccttccttggcctcccgaagtgttgggattacaagcatgagccaccatgcctggcctgattgtttttcatgtagattgcattaacacgttttttatcttgatggctgaggttttgggtgctgccttaagttgtgcacatgaggcgactgcctcactcccccttacccttgtcccagccccgttcttgggaaactggagtgcagggaggccctgctctttcaaacctagccacagagctcctttgcttctccccaggtctccctgcagtacagctccaatggcaagtggtaccacacctgcggagggtccctgatagccaacagctgggtcctgacggctgcccactgcatcaggtaactgcctttccctgggcgcttggcctgctcaccagctggtgctcatttctgagctgggggctcaaatggcctgaaccatgctacataaagcagccttgcaaataaccactatactggctgagacacaagctgtagtcaatcaatggttcagtgtgttggcccatcaatgtcagtacatggcatggatggagtgtctgtgccaggcaggcactgagggaggatgaagaggaggggaaggcccaatctctgccctcttggggaaactacatgtggcctctggatctggaattgggttcccttgaacaacttaactgacttctcaaagcttcaataccatcacctgcagaaaaatggagtaacagaatttagtgtgaattcaatgagttgatttaccaaagggcctggcacttagtaagtgctcagtgaaagctaattctgaattatagatgaattataaaggcccacaaggttctgcaacgttgttcacttatcctcttctttgtccgtgacctctgctcatcacagctggaactcaccggagtttctgccgggtcggcgtgactccctaccaggagtgatcccttctcccatccgatttataataagctctaggaggtattggggaaaataatagaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgactcctgttttctctgtgttcatctcattccctccataagaactatagagtttgtgttattataacttttatttcatattgtagtttatagttagtatagtaacaattattatatgatcatagttcttaggttatatactttaggccctatgataactaactgattgtcccaggggaggaaagatccccaagtcccatctagtggctcacgcagcagccagttacttgggtctatccccagcattattcaaagccaggcctctggaggtgaccctctccctgggccccctttctcccagctcctccaggacctaccgcgtggggctgggccggcacaacctctacgttgcggagtccggctcgctggccgtcagtgtctctaagattgtggtgcacaaggactggaactccaaccaaatctccaaagggttcgtttctgtctgggtgcacttgggggtgaggttgtcagggaacagatgggggtctcacagaggcaagggtctcaaccacaccacacgcccactgcttcttctacagggagggggaaggagctctggcctcttagatgtggaaccagctccaaagatgtctggggtggggatgtgacctggggaggctgaagcaaagactgccagagcgacctgggtttgctgccagttacacctgcagggcccctgtccgctgagcatgtatctacttcatgccaggtcctggggacacagggacagtgctgtcaaccctgtgactgtccctggagtaggacacaatctctcctgccttccccctttcaacaaggccctctgcattttcaaacatgccctggggccctgccagtcagagcaacctggggtaacagggtacagggaagatgacaaggtctccaagccctccaaagcccacagggcaggaaaagtcaacccggtcctcatgcttcgcctccacactcacccaggaacgacattgccctgctcaaactggctaaccccgtctccctcaccgacaagatccagctggcctgcctccctcctgccggcaccattctacccaacaactacccctgctacgtcacgggctggggaaggctgcagagtaagtgggagccaggagcccccaggcctgggagggaagggaggtgattcacgtcacccctgtctggccggggcctctcacctgtcatcccagggtgtgtggctgccttggagagacgggatggcataggctgacgcctgcctgggatcaaatgtcagctctcccacttaatgactgtgacaccttggacacattactaggtctctccatgcagcacttttttcatctgtaaaatgcaaatatttggctgggcgcagtggctcatacctgtaatcccagcactttgggaggcccatcccgcggatcacttgaggtcaggagaccagcctgaccaacacggagaaactctgtctctactaaaaatattaaaaaaaaaaaaaatagcaggatgtggcagtgtgcacctgtagtcccagctactcaggaggctgaggcacgagaatcacttgaacctgggagatggaggttgcagtgagccaagatttcgctactgcactccagcctgggggacagagcgagactccgcctcaaaaacaaaaggcataataatagcacctacatcacagagttgtcacgaggattaaaggagataatccataggaagcccagaatggggtaggtgctgtgttagttgttgtcactgtccctatgatggagagaaagttacagagaccatgtgacatcttctgtgtggcccaaggctagagttcagaacagcattttcctctgtgacctgagacccctggagccctcatcagaccctccatgccccatagcaaaagctgtcccctgtgccattaggtcttgctgctcagaacctgaatgagggcgggtctcctttgacatagactccaagggtcagagatccaatgacagtagccaccaagaggaacagagttcccgcccttcccttgtgaaatcaccagaggtttggaagattctaggaagggatgagtaataatgaccttatgaccataatgagattatgagtgttaatcacattatgacattttttcctaatgacataaacccataagtataatgacatgtttttccaggggtacatccacatacgtaccctcaaataattcccattgccctcttgactggcttatctgtaaacacaaggacacatcaaatcctgcggtgagcggtggtggaagaggcatttcatgcttattaagatacaagcacaacctcctgtttgtttccccagacaaccctggggcaggcgcatttcatctgagacagtgagagtggggaggcctccaaatgcttggcttttcggcccagctctgtcagtcacggtgaaaccttgggcaagccacttccgaacctcagtttcctcatctgtaaaatggaaacactgttggtgaagactaaaagaggtgaaaggtgaaaatgcatcatacattgcaaaatgttatgcaagtgttaattaattacttattagtggtcttaagccagacacttaacttcccttttttttttttttttttttttttttgagacagaatcttactctgttaccctggctggaatgcagtggtgcaatctcggctcactgcaacctctgcctcccgagctcaagcgattctcctgcctcagcctcccaagtagctggcattataggcgagtgccaccatgcccgggtaatttttgtattttagtagaggtggggtttcaccatgttggccaggctggtctcaaactcttgacctcaagtgatctgcccaccttggcctccctaagcgctgggattagagggtgagcaccgcgcccgaccgacacttaacttccctaggcttcaatcggaagtgaagaattgtgttaatctcatccttgccactcatagctgtggtaacagtaatggaggtgatggtggctgtgtcattgggggccattatgaaagccctcccttcaccacaccagcatatttttcccaaggagggggctctaacagccaggaggctcactttcttatttcagataagtgacagaaagccatggagctagctcagcaaaaaaagggaaattgttataaggatttaaaagttttatcccaagggcagagatacagccaggcatcaggaacaagctagaatcaggggctggaaacctgtaagaaacacaggaaaccctccctcagaatttctgttctttgtgggtctacttcattctccacataaaacaaaatgtcagtcattgccaacagcttcccagaattatgtcctctgaaaccggaatctcatagaccccatctcagaatcccaggggagggagctcattggcttagcttgagtcaggtgttcactgctgaaccaatcaaccgtgaggacacagtatagacaaacgtggctgttcgcatgttgcaatggatggaagacaggaacaggggaaacctaagacgggtccatcacttcctttttctcaggagtccctgcatccctaatggcttctctctgatctcattcagccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacgtgagtaccaaaatcaggggctccgctccatgacaaaatgtggctggggataaggctatagaggtccatccctccataggtccatcctcccacctcctggcagaattaccccgaaacatgttccagatatatctttggccaggcacggtggctcacacctgtaatcccagcactttgagaggccaggcgggcagaccacttgaggtcagcagttcaagaccagcctggccaacatggtgaaaccttgtgtctactaaaactaaaaaaattagccgggcatggtggcaggcgcctgtactcacagctactcgggaggctgaggcaggagaatcacttgaacccatgaggcggaggttgcagtgagctgagatcacaccgctgcaatccagcctgggtgacagagcgaaactcaaaaaaaaaaacaaaaaaacttgatcttggttcttttttgttcttgttttgagatgttttgagattctccttgtagtatccacccatctcactgctgggaagtccttccctgggtctcatcaaggtctctcgtgactgtcactatgtatcctttcctctatgctggaagggaaccaaaggaaagtattccctggcttagggcctttctacgatgacttctggtttttctgttgaattagtctcatcaatggcgcagcgtgtcccctccaggtagctgccacggaaaccttcctggagacagtgtcttaaccaccaggaactgctctgtgttggacttagcagtgaagtggggatggagtaggaaagagttccacacgcccttcagatcacactgtgccctacacactctgcccacatagaccacccgcgggaagacggaaccagtggggaagagcctggcagctgaagtctgggatgtggcctcagctcctttacaaactgcctgtgcaaccttgggcaagtcccaacctctcaacactccagtttctcctcttccgtggcctggggatgctacgaatatttacctcataggattttgtgaggattaatgagatgaggcatagaacatgcttagctcagctctggccacacaggaagaataagtgttggctcttgttggaattatggtaccaccttgggctatgaccacaagggtcagcttccgaggacagtgacctgcagcagaacaatagaaatgcattgagaacaatggttccaatgggcagccccttcctctccctttacctgcctataactctggccttcctcagggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtaagaaccggaccagccctgagccccaaggcactaccctgctcacctggcctcgggagtgccatgcccacctggtgactgagaatcccctccttcctcttgagagctagatgggaaccccttggaggaggctgcagacctgagtaactgctgggcctgccatgggtcccccaaatttctgtgtggataaagctgagtgaaaaggaacatagagggtggccttgtccaaagaggttggacactcctcaggcatatgaagagtgagttccgctgggcgccgtggctcatgcctgtaatcccagctctttgggaggccaaggcgggcagatcacgaggtcagaagttcaagaccagcctgaccaacctggcaaaaccccatgtctactaaaaaaatccaaaaaaaattagccaggtgtggtagcgcactcctgtaatcccagctactcaggagactgaggcaggagactcccttgaacctgggagatggaggttgcagtgagccaaaattgcaccattgcactccagcctggacaagaagagtgaaactccatctaaaaaaaaaaaaaaaaaaaaaaagagtgagtgccatagaaatggtgattttatttttgtttatctgtgtgtaggcccagactccaccatccagtgctataaacaggtatatttatctgcaaagcccaaaacctgatatccccatagcattaattattggaaattagtccacctcaggggtcctccagctattctgtagggtgaccaaccatcatggtttgcccaggactgagaggttttccaggatgtgggacttcctgttttacactgggaccatcccaggcaaatagagctgagttggtccccctgtcttgtaaaagtaaacaactcagagaggtgtctcctttcagcttccacaataactcaatttgtttttaacaatgaacacatttgtttataacaatgagcattaaaattatttattaaaaataataggccaggtgccatggctcatgcctgtaatcgcagcactttgggaggccaaggagggaggattgcttgagcccaggagttcaagagcatcctgggcaacatagcaagactctgtctttacaaaaaaattttttttaattactcaggcacggtggtacatgcctgtagtctcagctacttgggaggcttgggtggaaggatcacttgggcccgggaggccaacgctgcagtgagcacttaagcctgggcgacatagcaagaccctgtctccaaaaataatgataataatacctggcatcaatattaaggagcagccatggatacacgcagcagtaggtgaaagcagccagaacaggaaaccccgtcacaagaaagggatgcctggtggctcacgcctgtaatccaggcactttgggaggtcaagatgggcagatcaccagaggtcaggagttcgagaccagcctggtcaacacggggaaaccccgtctctactaaaaatacaaaaataaggtgggtgtggtgatacgtgcttgtaatcccagctactcaggaggctgaggcaggggaatcacttgaacctgggaggtggaggttgcagtaacccgagttcgcaccactgcactccagcctgggcgacagagcgagactccatctcaaaagaaaaaaaaacacacaaaaaagaaagagttgcccatgagagggcagaggagccaccatgcctcgtactggatgctagaaggaaagagtcggacactctgtgccaatgagggaccagctcagtttgctcttctgtaaaatgggacttgaactagaccaggactcctccacaatttaggcgctagagcaaatgggagttatggtattcgtggcagagcccctaaagaaggggaaagctggcatctgacttcactaagtttaatttgcagagaagtgttaaattgaattaaactgacacttataaaaccaaatatgaaactgcagccatgagcacgtggtcacaggaggaaaactaaactgtcaaaataagcaggtggctgcttccaagtgttcccactgattcttgccagatccttgttcatttgtctgtctgctggcatccttttgccaacaagtggtcacaagcagagattccaaagacgtttgttggacaaaaatgaaaaatcaaaaagacagtagccattaatcattaatggtgcttttttatatctaaattgggaaaaacccatctgagtccacctttggaggcgccacccacatgtcaaaggagcctggcctgagactgactggacgagaggctgcttaggggcctttctcagccaaatcctaagaccgttttccagccccagctgctgtgggagtcaccatgcagctggtcctggcagcaacctggggacctgaagcaggggcaggggcaattgtcccaatttttttttcccagcatcagctgttcccagccacagacacaagcacaacagaacaggccagatcccgaagcatggccagatggcagcagggatccacggggcagcacgcctcgcaaggcagctgggcagaggccctgtgttcatgggagagcagtcgggacaggcacagatgcccggtgacgggtttcagaagggggagagccaagcaaccagctgtccttgggtgggggctgcccctggcagcagcggaggagctagtgaaaccttgcagtggccccaacccagggacacagtgtgtgcagcctggagtcacataccactagagccctgggggtgcctgagagcacctgcctggataaacccagacaggtgatgagccaaggtcaggaaatacaagcaaaagagcagagaagcagaggagacaagtggcctggggcattcatcctttcaacaaatgtccattgaatgacagtcacatgtgaaccttcagcaatccttagtttttattctttttccggaaggtaatacatactctttgtaaaaatattaaaagactataagagtatcaggtaaaaaagtaagaagtcccccctcattttacatctccaattccactctccagaggtaatcattggttttgtttttgttttttaagacagagtctcgctctgtcacccaggctgaaatgcagtggcttgatcgcagctcaatgcaacctccacctcccgggttcaagcgattcttctgcctcagcctcctgagtagctgggattacaggcacacaccaccatgcccaactaatttttgtatttttagtagagatggggtttcaccatgttggccaggctggtctcaaactcctgacctcaggtgatctgcccgccttggcctccaaaagtgctgggattacaggcatgagccactgtgcctggccaagttgtcattgttaacagcttgtgtgtggtctcaactttatgtgcatatatagctatatatttacgtagatagacactgtcttctatgcaaaaactaagatctgagtcttcatactgttctgcagctgtttttcacttaacaccttatcacattttacatgttagtacatacatgtcattcttttgaacagctaaatagtattccatagtttgagtgtaatgaatgcagctttcatgtttcctatttttcactcttacattgtgcaatgaacatccttggacataattcttgcacactggtctgagtatttgtgctgtagcagctggatctcctgcagtttacagcactggatcatgaagttggcatatcaaaatgtttaacaggctgggcgcggtggctcacgcctgtaatctgagcactttgggaagctgaggcgagtagatcacttgaggtcagcagtttgagaccagcctggccaacatggtgaaacctcatctctactaaaaatgcaaaaaattagccaggcatggtggtgcatgactataatctcagctacccgggaggctgatgcatgagaatcacttaaacctgcatagtggaggttgcagtgagcccagatcgccctactgcactccagcctgggcaacagagtgagactgtctcaaaaagaaaacaaacaaacaaataaaaaaaaaaacgtttaacagacactgatcaacagcctctggaaacagttatagccccaaccacagtgcataactgccttgcaaacagcagttttgatttaagaaacaaatgaaatctaaaaatatgccatccacacatttggaatataatttttaggggttcgaaggccccctgacctgaagcccacacaggactcctggctaagaccccctttacaggaagaccctaacaggtcaatgaaaagctgtgatcacatctttttttccgaaacgtcatcagaactcctcaggcaggagctactgtagtgtgggctgcctgtaactcacatgagtagcttagcccaggaggacagagacaggaaactgccatgcacagctctgcggttaggtgaacctgacgattatcttgtgtgtcctgcaggtgattgcaaataactaaccaaaagaagtccctgggactgtttcagacttggaaaggtcacagaaggaaaataatataataaagtgacaactatgcaaatcacatcttgatgagagatttattagcaatccgtcctaacatccagggctgtgggcacagtggcacaaccctgtaatcccagcacttagcactttgggaggccaaggcaggcagatcactcgagtccaggaactcaagaccagcctgagtaacatggcataaccctgtctctactaaaaatacaaaaattaaatgggcgaggtgttacccacctgtagtcccagctactcaggaggctgaggtgggaggatcacttgagctcaggaggtaaagactgcagtgagccaagatcacttagtcgcactccagcctgggcgacagagtgagaccctgtctcaaaaaaaaaaaaaaaaaagaatttcgcatctacgtcaccctgccctactgagacctcaaggacccagcccactttagaacctgacacatgacatcgttgtccaacaatatataaatggagcactaagctccagcgaaggaagtgggctgtagcagcttcctgcactctgcctcctctgcctctctttcctcccctcccagcacagaagcctggatttctgtgcaggcgctgccccatgggatcccggaggttctgccgaaacctcatggcctaggaccaaggctggagcccgtgctccaggcctggccaatcaacacattgcatccccttccccaccacagcgattggctcagggatgggcatgtgacctgagacaggtccaatcagagaggttgcacgactcgtgcagggagctaccgagggctgtcactcattcactgcatgggtgtgaggatgaggggatgtgaggctacaaagcaaaacgagaggggaagggggagacggggttattttgctccccagcatacatctggcaatgtgtggagacatttttagttgcggcaactgtgtggggagggggagggactggcatctagcagcctggggccagggatgctgtcaaactcctgcaaagcacaagacatagacacagccctcaaaacaagaatcatctcgcccaaaatgtcaacactgctgcagttgaggaactctggaccagagatgcggtggtgatcttgtcctcaaggaagggagaacccagagcagctacaggccacttaacggagcctgagatgagacctcaaagcagaaggcagaagcaaaagttgaagaaaagccaagtccagggaccatcaccagggccctgaacccagctctgctcctggactttgccattttgtggcccaatgaatggccctttggcttaagcacaactgagtgaagttttgtgtcactttccaatcctgaaagcggctgggtacagtggctcacgcctgtaatcccagcactttgggaggccgaggcaggtggatcacctgaggtcaggagttcgagaccagcctgaccaacatggtgcaaccctgacgctactaagtaatacaaaattagccgggtgtggtggcgggcacctgtaatcccagctactcgggaggcaaaggcaggagaattgcttgaacctcctagtggaggttgctgtgagccaagatggtgcggctgcattccagcttgggtgacagagtgagactctgtctcaaaaaaaaaaaaaaaaaaaaagtcctgacagcaacatgatggaacagactgagcatctgttcctctccctgtttgtagataggcaccccaggccagaaagcctgtgggactggccaaggttacacagcaaattcacagcaggtattttttcagtggcctcatacaggacactttatttttatattaaaacaaacaaagatacagagcagaacgccaaattcacatgaacttttaagataaaatatgagacttaagaaatagttggttactgtagtgactgatacagaccataaatgagtccaaactcttacaggtagtatgggatggagttgggactggagtccacgtcttctgacatccagtcccatgggattctgccccccacccaatctttctcacctttgcaccatcctagggagattacagaattctttcccacccattttcttacccatacaacaatcctgcaatccaggcctggatggttatctaggaaactaaggcccagaagataagtggcttgtccagaccaccacactcaaaattgatggatcaaagacttgaactcggctgggcgcggtggttcatgcctgtaatcccagcactttgggaggccgaggcgggccaacacgaggtcaggagtttgagaccagcctggccaagatggtgaaaccccgtctctaataaaatacaaaaataagccaggcgtggtggccggcgcctgtagtcccagctgctcgggaggctgaggcaggagaatcgattgcagcttaccgcaaccattgccacccaggctcaagtgaccctctgcctcggcctagcctccagagtagctggagccacatacgtgtgccaccgcacctggctaactttttaaaagaaattttgtagtgacaggtggtctcaccatgttgtccaggctggtccttttttttttttttttttttttttttttcagacggagtcttgctctgttgcccagactagagtgcaggggtgcaatctcagctcactgcaacctccacctccaaggttcgagaggttatcctgcctcagcctcctgagtagctgggactacaggcatgcagcaccacacccgactaattttcgtatttttagtagagacggggtttcaccatgttggccaggctggtcttgaactcctggcctcaggtggtccgcccgcatcagcctcccaaagttctaggattataggagtgagccaccacgtccggccataaagtgcattttcacccaccagatgaagccctcctctgccagcattctgcttccccccatcattagagcggccagatcctaattgtgcatgtcggccttgccttctgctacatgtgcaccttccccgcattatacaaatccttaccacaatgttgtgaaacaatactgggcatgggcttctctccctgtttcacagatgggtctagagacttacatgactcagccaaggtcacactgcaacccctggtatgacctagaacaggcttctcagcctcagcaccattgacatttggggcagggcaagtcctattgcccagtgcattgtcgggtgtttagcagcgtctctgctccctgcccactggatgccaatttacatcaaccccagccatgacaaccaaaaatgtctccagatgttgtcaaaaggtctcctgatgggctgaaccagccccattgagaaatactgccttagaacgctgtgggttcagcatgccaccttaatcttttcattgaaaacacaactcctggccgggcgcagtggctcagcctgtaatcccagcactttgggaggccgaggcgagcagatcatttaaggtcaggagattgagaccagcctggccaacatggcgaaaccctgtctctactaaaaaatacaaaaattagccaggaatggtgacacacacctgtaatcccagctactagggaggctgaggcaggggaatcacttgtaacccaggagacagaggttgcagtgagccaagatagcaccactgcactccagcctgggtgacagagcaagactccatctcagaaggaaaaaagaaaaaaaaagaaagaaaacacaactcctctcctcagtcttacccaaggaggggaaaaaaaaaaaaaaaaaaagaaaagaaaagaaaacacaactccaaggaccaacaattagtatttttcttccttccctaatacacaacataatctctttaaaacagatggaactcatattccagtatctacccttggcatcttctcaaagtatttctagggtgacagttgggagaaaatggaaaaaaaaaatttggacacaagctcttttttccactgggctttgagaaaatccccatcttgcgtgctcctagtgtatctctcactgataagtttgctcataaaaccagggccttatccagggccacgcttacagaactcccacggacacaccatgattaggaccctgctgctgtccactttggtggctggaggtaagtcctgtcacccagaggcactggtttcccatcccctggtggggctggaaatgggatcttcctgtcctcccctctcgcccccacccaacccctactgcattcagacctataatcataagaaaaccgaaatggagtttcaaagaattggagcaaacagaaggattttatgacctcttgggatccttctagaacaagggttttctatttgggggttcagaatgcagcatgtatagtttacattgtgtgggtcgctgcttcctggactcaagaccctttctcttttcacagccctcagttgtggggtctccacttacgcgcctgatatgtctaggatgcttggaggtgaagaagcgaggcccaacagctggccctggcaggtgagttgaccacactgtacttctccccgtccctgccccactccctttacatcccccctttgcccttccaccatggcgtctattgtgctggcaaagttaggattgatgggattcagagagcagcacaggaaacttcaccaacaagatacatttccagctgggcacagtggctcatgcctgttatcccagcactttggaaggtcgtggtgggcagattacctgaagtcagaagtttgagcccagcctggccaacatggtgaaaccccgtctctactaataataaaaaattagccaagcgcagtggcacacgcctgtaatcccagcatctcgggaggctgaggcaggagaaagacttgaacctgagaggcagaagttgtagtgagctgagatcgcaccactacactccggcctgaataacaaagagagactccatctcaaaaaaaagaaaaagatacatttctgtggccttggccaaccttgggagtgaagggagaggtgcctcctccagctgcagtaaagagctgtcccctccccactgcccataaacaaatttacaactatagtcttactctgttaaccaatcagaggctttctttcaaatgtaccattatcctatgaaccattcaagactacctatgcaaatattccttgctttaaggaaccaatcagtgctattcatgcagattcatctttaactacaggcaaatcaatgttaccaaggaaaataaatgtttcttaagttgatataatagtgatattaagactaaactgccgagtggggcacaggcacaaattactaagacgtgttaacggtgggaatttcaaaagaaatgtgtaaagtttacattgacgcaaacaaatatagtaaaatctcatttatctgatataattgggactgactaaatgaaaagttggttataaagaaattattttaaatcatatatgctgtaaacattttattttagactatgtaaacaattttttgagttcttaactgtctttttcatataaaccatgccccataatatctcatctacaagtccatttctttaaagcagagcaataactttgagatattcataaagcaatctgagttacgagcccatcccgacttttacgacttttccccccaatctttctgtttcctcaaagacactaattcaagagcaattttttaggaatcatggtattcagtctcttccaagcatttaactttgtttcacaactctctttctgaactcatatttcattggttacatatttaatcaaatttcactattgcaaacataattgatataaactgctttaggagcaaacccagctgaaccaggatgagtttctaatttaagtagaaggagcaactagcagcccactagccttgagcattcagagtgacctatgcagcagtcactgtgtttagagaggccagcgttcattcatctgctctttgattaagagactgtccatgataggccaggcgtggtggctcaggcctgtaatcccagcactttgggaggccaaggtgggtgaatcacttgaggtcagcagttcaagaccagcctggacatggtgaaactctgcctctactaaaaatacaaaaattagccaggcatgattgcgggcacctgtaataccagctacttgggaggctgaggcatatatatatatatattgggatatatagtttgtttgtttgtttgtttttgttttttggttagacagagttttgctcttgttgcccaggctggagtgcaatggtacaatctcagctcaccacaacttctgcctcccaggttcaagtgattctcctgcctcagcctctgtagtagctgggattacaggcacgcaccaccatgcccggctaattttgtatttttagtagagacagggtttctccatgttggtcaggctggtctctaactcccgacctcaggtaatccacctgcctcggcctcccaaagtgctgggattataggtgtgaaccaccacacccagccaagaggaataatattttaatgcatttttttttttttttggaggcagagtcttactctgtcacccaggctggagtgcagtggcgcagtctcagctaactgcaacctcagcctttcaggttcaagcaattctcctgcctcagcctcctgagtacctagaattagagatgtgtgccaccacaccagcaaattttttttgtattttagtagagacggggtttcaccatgttggccaggcttgtctcaaactcctgacctcaggtgatccacctgcctcggccttccaaagtgctgagcttacaggtgtgagccatcctgcccagccagctattgtaattacagttattaatcaccctgagagccctgcaccgtggcttatgttccccatttccagagaaggtaactgggacttggaaaggttacagaattacccaaaggcactgggttagcccgggggggaatgaggattcaaatctggttcagtgcttgttcttttagctacactttgctggccacaaataatacgtattacgtggacgaaatttcccatctgtaggatggtttcagcacatttttaaattggggtgggggagtagatacttttcagtgtcttttttcacttggtccaattttaagcatctttttaaaagccagttcatctaaggccccttaatgtcacaaaaacgagaaatgcccagtggctaattaaaaacaaggacgtggccaggcacagtggctcacgcatgtaatcccaacactttgggaggctgaggcaggtggatcacctgaggtcaggagttggagaccagcctggccaacatggtgaaaccccgtctctattaaaagtaaaaaaaatcagcagggcatggtggcaggcacctgtaatcccagctagtggggaggctgaggcaggagaatggcttgaacctgggaggcagaggttgcaatgagccaatatcgtgccactgcactccagcctgggcgacagagggagactccatctcaaaaaataaaataaataaagtggaagagacataaacaactgaataggtaaactaataacacgccggaaaacgaaagatactatgaagagtaaagcagagtaaggggaaagagacaagtgtgtctgtgtgtgcatatgtacatgagcgtgcacgcatgtgtgtgtgcacattgtttgggatagcgtggtcacagaaggcctcatggagaaggcaaccttgagcagagactgacaggaagtgaaggaaagagctacgccgatatttgcaagaatattccagggaggaggaagagccagtgcaaaggccctgaggcagaagcgggtttggtgtatgtgcagaactgcatggaagtcagtgtggctggaggagaggagagtgggagcctatggggtcagagaggccacggagagcctagcaggtcatcagacagttttaagttttgcaaactgtaaagggggagccactggagagtctgagcagagaagagaagtcatctgacttccattcaaaaaggatcagtctggctgctgtgttgagaaaatgtgggtgggaatggggagaagagatgggagactagaatgatcatcgagaagagagggtgattgcgacacacagttgaggtagtgaccaaagggtagcaaccactccacaaattctcaaggtagagctgacaggacatcccctgtggagacggcctcactctgtcacccaggctgagcacagtgcaatcgcagctcactgcaagctagacttcccaggatcaagcaatcctcccatctcagcctcctgagtagctgggactacaggcatgcaccaccacacccagtggctaattttggggtatttttctgtagagacggtgtattaatccgttctcacactgctaacaaagacatacctgagactgggtaatttataaaggaaagaggtttaattgactcacagctcagcatggctggggaggcctcaggaaacttacaatcatggcagaaggggaaggaaacacatccttcttcacacggtggcagcagggagaagtgccaagcaaaagggggaaaggcccattataaaaccatcagatatcatgagaactcactcagtatcacaaaaatagcatggggtaaccaccctcatgattcaattacctctcagcaggtccctccccctacctatggggattatgggaactataattcaggatgagatttgggtggggacacagccaaaccatatcagacggggtttcaccacgttgcccaggctggtctcaaactcctgggctcaacccatcctcctgccttggcctcccaaagtgttctgattacaggcatgagccaccatgcctggcctgattttttttttttttactatagattgcattaaaatgttttttatcttcatggctgaggttttgggtgcccccttaagttgtgtacctgaggtgagtgcctcactcccccttacccttgtcccagccccgttcttgggaaactggagtgcagggaggccctgctttttcagccacagccacagacctgtgtttctccccaggtctccctgcagtacagctccaatggccagtggtaccacacctgcggagggtccctgatagccaacagctgggtcctgacggctgcccactgcatcaggtaactgccattccctgggcgcttggcctgctcaccagccggtgctcatttctgagctgggggctcaaatggcctgaaccacactacatgaagtaaccttgcaaataaccactagcctggccgagacacaagctgtagtcaatcaatggttcagtgtgttggcccacccatgggtcatttcatggcatggatggagtgtctgtgccaggcaggcactgagggaggatgaagaggaggggaaggcccaatctctgccctcttggggaaactacatgtggcctcagtgtctggaattgggttcccttgaacaacttaactgacttctcaaagcttcaataccatcacctgcagaaaatggagtaacagaatttagtgtggactcagcaattgatttgctaaagtgcctggcacttattaagtgctcaatgaaagctaattctgaattgcagacaaattataaaggcccacaaggttctgcaacgttgttcacttatcctcttctttgtccgtgacctctgctcatcacagctggaactcaccggagtttctgccgggtcagtgtgactccctaccaggagtgatcccttctcccatccgacttataataagctctaggaggtgatggggatactaatagaggcctacagtcaggagtcctggcttctagttctgatttctcactaacggtgggactccggaccagttactcctctctgggcctcagtttccccatctgaaaataaaaggttgaaaatttccttgagggcaaatgactcctgttttctctgtgttcatctcattcctccataatactatagagtttgtgctattacaacattaattttaaattgtagtttatagttagtatagtaacaattattatatgatcatagttcttacattatatactttaggccctatgataactaactgactgtcccaggggaggaaagatccccaagtgccaactagtggctcatgaagcagccagttacttgggtctatccctagcattattcaaagccaggcctctggaggtgaccctctccctgggacccctttctcccagctcctccgggatctaccgcgtgatgctgggccagcataacctctacgttgcagagtccggctcgctggccgtcagtgtctctaagattgtggtgcacaaggactggaactccgaccaggtctccaaagggttcgtttctatctgggtgcacttgggggtgaggttgtcagggaacagatgggggtctcacagaggcaaaggtctcaaccccaccacaccccctctgctttttctatagggaagagaaaggagctctggcctattagatgtggaaccggctccaaagatgtctggggtggggatgtgacctggggagggtgaagcaaagactgccagagcgacctgggtttgctgccagttaagcctgcagggcccctgtccgctgagtgtgtatctacttcatgccaagtcctggggacacagagacagtgctgtcgaccctgtgactgtccctggagtaggacacaatctctcctgccttccccctttcaacaaagccctccgcattttcttttttcttttcctttttctttttttgtgagatggagtctcgctctgtcacccaggctgtagtgcagtagcacaatctcagctccctgcaagctccgcctcctgggttcacaccgttctcctgcctcagcctccagagtagctgggactacaagtgcccaccaccacaggcccggctaatcttttgtatttttagtagagacggagtttcactgtgttagccaggatggtctcgatctcctgacctcatgatccactcgcctcggcctcccaaagtgctggcattacaggctggcattacaggctggcattacaggccaccgtgactggccgaccctctacattttcaaacatgccctgtgggccctgccggtcagagcaacctggggtaacgtacagggaagatgacaaggtctccaagccctccaaagccccatagggcaggaaaagtcaaccctgttctcatgctccgcctccgcactcacccaggaacgacattgccctgctcaaactggctaaccccgtctccctcaccgacaagatccagctggcctgcctccctcctgccggcaccattctacccaacaactacccctgctacgtcacgggctggggaaggctgcagagtaagtgggagccaggagcccccaggcctgggagggaagggaggtgatgtcacccctgtccggccagggcctctcacctcacatgttatcctgggcatgtggctgccttggagagacaggatggcataggctgatgtctgcctgggttcaaatgtcagctctcccacttaatgactgtgacaccttggacacattactaggtctctccaagctgcacttttctcatatgtaaaatgcaaataattggctgggcgcggtggctcacgcctgtaatcccggcactttgggaggccgagacgagcagatcacttgaggtcatgagtttgagagcagcctggccaacatggtgaaaccccgtctgtactaaaaatataaaaaactcgccaggtgtggtgttgtgcgcctgtagtccgagctacttgggagcctgaggcacaagaatcatttcaatctaggaggcggaggttgcagtgagccaagattgcgctgctgcactccagccagggggatagagcgagactccatctccaaaaaaaaaaaaggcataataataccacctacatcacagagttgtcaagaggattaaaggagataatccacaggaagcctggcatgtggtaggtgctgtgtgttagttgttgtcactgtccctatgatggaaagaaagttacagagatcatgtgacatcttctgtgtggcccaaggctagagttcagaacagcatttcctctgtgacctgaggtctctggagctccacaaaggcccctggagccctcatcagaccctccatgccccatagcaaaagctgtcccctgtgccatttggtcttgctactgagaacccggctgagggtgggtcttctttgacatagactccaagggtcagagatccaatgacagtagccaccaagaggaacagagttcccgcccttcccttgtgaaaacaccagaggtttggaagattctaggaagggatgagtgataatgaccttatgaccgtaatgacattattagtgatgatgacattatgacattttttcctaatgacataaacccataagtataatgacatgtttttccaggggtacatccacatacgtaccctcaaataaattcccattgccctcttgactggcttatctgtaaacacaaggacacatcaaatcctgcggtgagtggtggtggaagaggcatttcatgcttattaagatacaagcacaaccacctgtttgtttccccagacaaccctggggcaggtgcatttcatctgagacagtgagagtggggaggcctccaaatgcttggcttttcggcccagctctgtcggtcacggtgaaaccttgggcaagccacttccgaacctcagtttcctcatctgtaaaatggaaacactgttggtgaagactaaaagaggtgaaaggtggaaatgcatcacacattgcaaaatgttacacaagtgttaattacttattaattagaatggtcttaagcaaaaagcttgattttttttttttttgagacagagtcttgctctgtcgcccaggctggagtgcagtggcacaatctctgctcactgcaacctctgcctcccacattcaaccgattctcctgcctcagcctcctgagcagctgggattacaggcatgtgcaccacgcccagctaatttctatattttactagagacggggtttcaccatgttggccaagctggtctcgaactcctgacctcaagtgatccgcctgccttggcgtcctaaactgctgggattacagggtgagctaccatgcctggccgacgcttaacttcccttggcttcaatagcaagtgaaaaattatgttaatctcatccttgccactcatagctgtggtaacagtaatggaggtgatggtggctgtgtcattgggggccattatgaaagccctcccttcaccacacccaaggagggggctctaactgccaggaggctcactttcttatttcagataagtggataagtgacagaaagccatggagctagctcagcaaaaaagggaaattgttataaggatttaaaagtt

SEQ ID NO: 14092 - DNA, 7296 bp, Human
gtttttgtttttctcttcctgatacattaagttcttacagggatttgattcttactgttttctgcctaatttgttgcagcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgacttggtgtgctctgtaaagcttggttagaatttttttaaagtgacattttgttggccataatttagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaaagatttaactttaaccacaagagggcacaactggagagcacaatttttttggtactgcagtaaaattgattacctcttgagaagtgttctttttaaccagctataacaatagagttgagtattttcacccatggtttgaaaaagtgccagaaggccacactggcccacatctgtaatcccaacactttgggaccctaaggtgggcagagcacttgagccaatgagttcaagaccagcctggtcaacatgatgaaatctcgtctctactgaaaatataaaaaatagccagtcatggtgcatgcctgtaaccccagctacttggaggctgaggcaagagaatcacttgaacctgggaggtggaggttgcaatgagccaagattgtaccattgccctccagcctgggcgtcagagcaagactctctgaaaagtaccagaagcatttttcaggactgcctgtgtgtcttggtgattatgttaaccaactgtgttcaaaagaagtacccatgaaatgcctccagatacaagggtgtttttttttacccataaagctaaactacaaatattaccctagaattaacctcttgtcctgtgtcaaaagtcttgttttgcatctggactgttaaactgtcagcttctctctgacagtctcgaactgtcaagacagtctcagttcacagccaaggtgatctgttaaccctccccatttccagggccaaatctcagttcttaagcacgtcgtttcttagcacggctttattttcatgctctttatttctctgttttgtgcagccttacccctttaaagtccactgtgagtcctaccctgcagggcctcttaacacagtagagttcatgtgctactgatttggtgcctgccttcaaacacatgtgcaagttttgtggggttaaagatagccacttggtggcacaccacattggaagtgctgttcacccggtcatttgaaacggtgtttgaccacttggtgcgcaaatggcctatcggattaaaggatagccaaacccaagatttcttcaggttctttacagctccatggatctaatttcaaaatcctgatcattactcatgaatcaaggtgttttgacacaggctgtaccccttcctgcagctcgtcccccgcggagtggccaggctacggcgggcgccggaagggggcgcactcctcgcctttcctcaatgtgtcgggcagccccgcctccccgctcggtttccgggagtcggcggcgatggcgtcatcaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagttctccgctactcactagctgtggtggcgccaatttagaggtttacaaacaaacaggtatctgaatcacctggggagtttgctgtgcgcttcttaggccctatctttcagaatcgtgacctcgcaagtctagggtgaggctcagggatctgtgtttggcaagtgcagtcctacctgctgcttcctgtaaatgttcatcgccctcagacagcacgctgaggaagtgctccctcccgaaggctcgcctagacccctctggccaccgaccccttcctcctgagctgctgttttctagtttgttttggcgcttgaaatgctctagttttgccaagccagaaggaactcctagatcctcccatgctaccaaggaagaaactgaggccctgggagaagagacttgtcctaacgtctggagcttccggtggctcttgttactgacgccatggccttgaggaggagtcgggatttaggcccacgtgggccacttcccaaacctgtgcttaatgcagcccctcagcccgggcaatatagtgagacctcgtctctacaaaaaattgagacagggcctcactgtatcgcccaggctggagtgcagtgacatgatctcggctcactgcaacctccgccttctgggttcaagcgattctcgtgcttcaccttcccaagtagctgggattacaggtgtgcaccaccacgcccggctaatttttgtatttttagtagagacggggtttcaccatgttgcccaggctggtttcgaactcctgagctcaagcgatcagcccgcctcggccttccaaagtgctgagattacaggcgtgagccactgcggccggccttacaaaaaaaaattaaaattagctgagcgtggtggtgcgtgcctgtagtccagctacttgggaaactgaggtgggaggatggccaaagtccaggtggtcaaagctgtagagagcccagattgtgccactgcactccagcatgcaactatatggggagaccctgccttaaaaaaaaaaaaaaaagtcccagggaggttattatgctaatccctgctcagcattcttttcagaatcttttttttgagacagagttttgctcttgttgctcagcctagagtgcagtggcgcaatcttggctcactgcaacctccgcctcccgggttcaagggattctcctgtctcagcctcccaagtagctgggattacaggcatgtgccaccacgccgggctaattttttgtatttagtagagacggggtttcaccatgttggccaaggtgttctcgaactcctgacctcaggtgatccacctgcctcttcctccctaagtgctgggattacaggcgtgagccactgggctcggccctttttcagaaactttaagtccatatgaggtgaggattaccaaagccctttgtaaaaggaaaagtattgtacacctgtgacatatcaaaatcataagcatttttccttagggaagttatacttttagtagagacggggtttcacagtgttagccaggatgttctcgatctcctgacctcatgatccgcccgcctcagcctcccaaagtgctgggattacaggcgtgagccaccgcgcccggcctccttagggaagtcataatgccctccacttatttgtgtttctatattgccacggtacccttacaagtacttaatgagtgtattgatgaccacctccaaagcccagatttccttatgcttcagcaaacacctctgttttctattcttctttccttcacgttctcattactgagtaacagcctcaggtccagggaatctctctctctgaggaatcagatgacacctggctgttttaatgacacacttgtactttgagttgctaggtctgtagaagtggaagccatgactcagccagaacacctgttcagcccaggggagaagggctagagtctttctttactcatctccttaaaagagagaaaacctaagagcctaccccctcaactttccctctagagcaacacagagatagttttcattccctctcttgatgcaaatgtttcatagtgtgcccagcagtttacccacatcagtagtccagtgaaatagtaaggaaaagtgtcctcaactcttcttttctaggttgaagaattagccctccaatcaatgatcagttctagaagaggggatgagatgctgtcttctcacactgtacctgaacagtcacatgatgtaagcttaatcaagtgcaggcctaggagagaatgcaaagtctgctctgctcccatgctgcttgggtggtgaagaactgttgtaaatcacattacctagcccaaagggctctgagaagtgctgataacagttttctggtttaataaggtggcaactctccattaaccaccttcctaccagctagttatacactaattaattaagtagttactaatgttttacctccatcctcctcgtcatccattctgtctagttactcagatgaacccgggggagagtggagatttttgtaggacgatgtcaaaactcttgattttttgtgaataagtaaccttgagattcaagagtgtggcttcaagtacaaggcacagtgctaaaagatgagctccagttctcatcatactcatctcttaccaaatgccctcaagtaagtcagcaaaatctaagtacacaatatttgagcagttctcccagattttgtgtgttaagacatttaaaaccatgatacagcagcacatgtaagttggcacaaatcttatggagctttgtgtaataatgtttgtaaatgaggtaacattctactgaatctggggcatttactgttgccccattttggtaatggaggtgggggtataaaaggaaagtggccatacctcttagtcataagtactggggatagatatgcaattgagatctgattttaagtcatttttaagaatttgctgttttgaggccagcatctttcctgctaatctgtgatgcccttggccaatacagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatcatggagcctgctggtttctagatagcgacagagagaagcagcagttccttctctgaggaaaagatacaacaggatggtttgaaatccatttctggtccttaagagagatgtgccatgcttggaagactggattttttgttttgttttttgttttgttttgtttgagacggagtttcactcttattgcccaggctggagtgcaatggcgcgattttggctcactgcaacctccccttctcgggttcaagtgattcttctgcctcagcctccagagtagctaggattacaggcatgcaccaccacacccggctaattttgtatttttagtaaagatgggatttttccatgttggtcaggctgctctcgaactcccaacctcaggttttcctcccgcctcgacctcccaaagtgctgggattacacacgtgagccactacaccaggccggaagactggatttttgttaacagatgacagttacagaataagagtttttacttagtatctgaagttgaggttcatttctgcatactgtcccttttccactgactaccatgaaataagtagttgcttaattttataaaattaatttcccctgcccaagcaacagtaaaagccaaacaaaacacaaagaatcatgtcaagcagaacttatgtaacagttcccaaagaaaacaaagaatactttttttgttaatccacatttcattgaagttattttgactgcttttagaggaaacagccagaagtttaaatgagcatgttccttagaacacacaatgggaagacagtttgggaacaaaaagcatcaaggtacataaattttgggggtctaatttaaaatatgagcatgagttttaaaagctggaaaacttgactatgaattccagctctaccacaaactggtcacttgtcttctcacctctttgcaactcacgttcccatctgtaaggtgaagatactcacatctgctctagcagtttcacaggttgctatgaggtgctaatgagatcatttaaaaatccaactatcattggtatctcagtaagaatctggcattgggagctcaaaacactgcaagattcatgcggggatcataattcttggctaaaaattaaaaaaaaaaaatctaaacacccctcaaaagacactgagcatgaaagtggtcagatctaggttttagataccaggttataacatttcttctaaggatgtagtattctcattttaatgaaacattctcagtagtgatggtatcctgtcatttgtaaaagacacacagtgtaaatgttaaaacccagcctaaatgtttatatgttgaaaatgtataagttaaactgttgacttagaaaagctatacttcacagtgagagaaaaaagttga

SEQ ID NO: 14093 - DNA, 14094 bp, Human
acagagctacctcaccctgctacaaaaaagacttggcatgggggattttcccggaatgctccaagtttatccacccatctttgaggggtgtgcatgcaccatgagtggggtagcatagtactaacaccacataaggtcatgttgttcattacaacaaggggaggaaagaaattggcaaggtggcttaatcctgaggcgctggccaggcgcagtggctcatgcctgtaatcccagcaccttgggaggctgaggtgggtggatcacctgaggtcaggagtttgagaccagtctggccaacatggtgaagtagatagagtagagacatggtaggctctactaaaaatataaaaattagctgggtgtggtggtgcacacctgtaatcccagctacttgtgaggctgaggcaggagaattgcttgaacccaggaggcggagactgcagtgagccgagatcgcgccattgcactccagcctgagaaacgagcaaaactcggtctcaaaaaaaaaaaaaaactgtgtctcaaaaaaaaaaaatttaaagactggtatttctctttagaagattctagtagagtgctagattgagagagatgtgagtgaggaacagcactcgggtttaatgcttgcaggtatgcatgttgtctcattttaaagtgctttcaatgtatacagcctttgtagcttcctaatcaccggcttttatttttgctatgaattctttgtcatgggaatcctgcagttgcagggcaggaacctaccgtgttagtctgggatgttgcttctctggtactgttccatatgtttaaggaaatgtcttaatacttcggggcactcctttatctaaataactgctgttctttgcattattgcgcctgaagtcctttgtggactctgaaagcttaatccatgtgaatatggaaaagcatctgcaggatctaagcctgctggaattaggcttttcatcctgacatacctaaaggaagatgagatattcagatgcagccgcttcccagttctgctttgcagtgtaaggtttagtcacccatcctcctgttcctgtgacctctgttgcagtcactttaaatcccagattacacacgcccttccctggcactccccggccccccggcagcatgagcccatctgtgtttcacagtaataaggtaaagaatgcatttgggcttgagctcggaaacctgtttgattcacaaccaaagagtcgtctcaaagccagatctcagtattatcaaagcatcaggtttcagagctggcccttttttgggctaggcatccatggcctaggatcacgtgtggacctttttctgtttatccatgtttaatttgtgtttagctgtgccatggattaacgtttcatcacggtggattaagagtggactgacattgaagcagccttattttgcttctgttacctctcaggaatcagtggcaggggtgggaacagccccttccagagggggaggcagggttcatcctaaaagtaccctggtgcttggaagagggagtataaacctgagcgtcagtgtggaagtaaatcccagttgcagcttgggagggctggatagagcaagccaccggcttcatcagtctaacgagatgtcacatggaacaaagctttagggttttatttagctcctaatccgcatgctgagagagccctggtccatgtgagcacaccagccaggaagggggacctggcaggctggggacagcctcctctccgggactgagctgtaaggaacagacctctctggctatcgttggggagtgaggcaaagttaccgtgagtcttatgttttgtctgctaaggtttcggaggattaataattcaggccatgctttgaaacagaaaacccccagttggttgtccctgccgtctcggaagggttagcacacagccaggtctgtttttgatgtatgtaattgaagatttataaagaaaagcttctcctctgcctcatccgcagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcctactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtaccagaaggtggcccggcgcacaggggcacccatcatcgtgtccaccatgcttgcaccagaaccaagtaatacatcctccccgcctgccctgcctggggacctggggggagcaggggggtgcggggttgtagaagtttgaacataggatggcaagtcctcactcaccaggccacacacacacacaccaccaaacaagaaggacgcagcactgtggccagttgacacggcttctcttaagttaatcagatttgtgtgtcaggccagatctgctggggcagcagtgccctcctgttctttagttgaggtcgggttgatgtgtagatttcccattacggtggtaaaactcaactgtgtttcttggagaaagtcgcaagtcactcagaacagactgcagccttgagctcacgaggggtggccctttctgtagttcacactagggaactttggagaaggcaggaacgtttcatcaaatgctggctgtaaagtgtgcatcctccatttagaagggcgtgatcgtgtggaaacgtacctctcacgggtccgcacgccgtatcagaggcagtgattacccaccgtggagatgaaaatgtgtgtgtttgcatacttgtgggttaaacaaagcaagatgttgaaatccctcagaactcagtttcaaaaacagatttagtctctcatatcagaaaatacagttgggaattccgcgtgcttgaagggaaggatatatttccaagtccaggaaagggagagtgatggtaggtggttttcttcacaacatgtgccaggtgtgatttatggcgtgtgtttccttggacattgtggatgaagtcctaggtgggcgtcctcagagcaccatttacaatttttattttaactctagagtcttgaccacaaatttaaaatgtaaatcagttttcttcctttcaaacataattctttcctccccgccagcctcccctacgtcattcagaaaacagaatccttttcaaatgatttttttttttcctgaatagcttgtgaaaatcaggatgaaacaataagatctacctttttgaaaatagccctgaagcagctgtaggcggggaccgaggcgctggacctcacaaccctgcagagaccaccttaagtttctctgccatcgctgtgtggcccgtgtgtgctattaatattacctcctagagatgacctccaggcattttgcattttgtttccaagtggagactgagcaactggcctgattttctgctttgtcgtatagattctgattttgtctcatggatttttttgaagtctgatcacatcattatttgactttctcaaatacatgtgcggcaggagggacgtcagataatttttccgagggcctgtgcctgctctctcagtcaaacattctttctttgcaaccaactgatttgcatggcgatgacatttgttgctccagtaatttcatctgataatggccgggcttgcaaagcggatctgaaaacatattccttaattatgtgttgctaagtgacaggagggtttggtcataatcacagaaagattatctcctcacccaagtcgtggaaaggttttgccgaaggaggaacctgtaagattgccttttcttttcttttctttttcctgtttattttagacttgccttttaacaaaaacattcgccattatttgggtatggagtgaggggtattatataagttgtttgcagtgtgattgctaacacgatgttttacagaccggaggatattgatttttacttaatttgcgtggcagcgagccagtgccagggaagtctgcaggcagaagccagccagcaaatcaaatgtctctgttaaatgatccaccccatagctgcagtttccctcctcattccttatcgtatgctgattgtggcattatcccccacaccctgtcgggaagggggcaggggctggcgtccctggtagcgcttcagctgtgtacatggctgtacgttttgtacagtaggttccacagaatccgcagtcacatttggatctgtcggagccagcagggaaagtagacggtgtgtgtgtggaggataatgttgacatttcaggaaagcacaggctgggcagtcccgccggcctctggtccaggacgcggccatctggaaatccagtgttgcttgtttgggacgccgccagcctgaacgcatcttcgttctggtgccgcctaactcaagtgcttccctcccatcggagggacaaggaacgcccttctggaagttgactctcttctccccttcgggatgggcggtgttgcactgcttatagtggggtggtttggggtttggggattgttttcagtatctattttattttcggatgctttggctatttttaatgtatgtttgctttttctcagtccacgaactacctgccttatcttggtgggttttgtgcatacacacaataggctcctatttctagtccagtttgctggccaagcagtccagagtgacaacgtgaggaaggcgtatgctgcggggaccccagtgcggcccaccagccccggtgacacagacaaatgggggctccaggcccgcgtgagtggcagcacctggcaggtggtggggtcggctgtcgctctcaggctgacctggccggctatggcacaagtcgcggagccctccggcggtggctgcgagccagcaatctccccgtgtcacgtgctgtcacccgagccctgcctgcaccagatgcagcagggatcatcagaaacaacgaacgaatggggctgcggccattttcatatctttgtcttcacaaaatacagccaagcctgcagcctgcacagggctcagctcaggacacaccctgggggcaaagtttcagatgtgagaaacgcagtcccagcccaaagagccacaaaaagatctttctgagctttttccattttcttccagccgtttttcttgatgcaactggattaatgggggcacatgtgacccctgtctagttgcttagggtcactgcctgaggactccaggatggagggaggagcgcgtggtctgtgtggaggggctgttgaggaggctgatggttgtgacagttacctgtcaccagagctggtcactctcatggcttcttttcgtgtggcctcggtttccagcaactggaggtgtgaacgctgatctcctaggtagaaagcacctccatcaataattttagccctatcagaatctgtatagagggtcgccgccatcggcccacacccctgctgctgagtcctcaagcagccttgcctcttgtttgagactcctctgcaccttgaggtctgtcctggggcagaggacgcactgctcttgagggtcttgacccttaaaccttcggcaggcttcccccatctcagagcacaaggacatttgggggtgaggtccaggggctgtgaccccaggctggccctgcagaccagcagagggatgagtccagcccttcctgtgtgctggccatgcagtccagccagagagagttgtaagggagcaaggaaacctcttccgggctgcccccaggacccctgagtcctggacacagaccactgccctgggcagagcccagcgtgagcttagaggcttgttcacttcttccttccttcctcattgacctgtcccctgctgttccttccttccttcctcattgacctgtacccctgctgttcttccttctttccatccttcctcattgacctgtcccctgctatgtgccaggcctgtggccagatgtttggggctcccaggtgggcaagacccaaggcttgtgtttaggtgctctctggtctgggggccaggaaaggcaattcataaaaggacagttaactgtgactatgtatagcaggcaccaagatggggcctgtggagcacctggagctccagggcttcttggccactcctatgcttggaagagcgtccctacagcgcatgtgtgtgcaccggcagggaagcaggagaagggcagagctcagcaccgcagccagactggggccaggggagaggccaccgcccaggccggcgtggggcagatggaagtgtgtgcgtgagctgtcgtgtgcaagggcagctaagggcctgactggtgttttgagactccctgtggcgtctcttttcttgcagagtaatctatgcctgcgtagtaaaaacattccagcattgtggagccacatagccaggactctgcccctaccccagcctggtagagcaagaacctcggcatggcctcccttccaaatccaagagcagctgaacggttcccaggtgctgacagctcagccttttctagcaaaacattgaacacacccgacatcagtgagctctgcgggccttccgtttggcttttgtacttgatcagtcattgggtttcatggcccggtgttccctgcattcagtgtgcccctgggcaagtcacctgctactggcctctgtgcctctgaggccctggttgtgactgatgcctgacctcctgagactcccagcccttcttgtgacctcgccagatcaccctccgccttcatggcagaacagcagtgatcatccctcctgcccgttgctgccctgaagtattcgcatcttggttgtgcccccttaccagactgaactcagcgagtgcctgaacctggcctcaccctttgttcatggagctcattctgctaggctagactgggtttcttggtcccctttcaggctcctggacgtgccgtagaccccaggaatatgatttcagcccaggagcataaagtagttgaatgcatggcccgaaggagtgccacctgctttgtgtttgggcaagtatgttgagttctctgtgcttctatttccatgtctgtcaaagggggtaggtcttgaacctgtttcctctgcttctgggagagcagtgagcagagaaggaagagagggcttgtgtgttgaggttggagctgcctggcctcagcggggaatggcgcttttcttgtcgtggttgacccttggcctcttctcacactggactactgaggccctcggggtctcaggggccaaacttgtcccccagctctgccgccttcacagcacttcctctgaccccgtgggtgtggatttcattctgtccatggaggacgtggggtgagccatgccgggacaactagacagcggccaagctgctgaagaaggccctgctgtggtcctcagttttgtgcaaagactgctctcctaggcctctgtcttgttaaagcttagtgggccttttttcaaaagtgagtatctgggaatttctgtaagcccaccttgcatagagtgtgtccccctcgacagcgcagaccccctccacactggtgggtgggtgatctgaccaggagtctggccagagagtaacgtggatgcttggtgtcagctggctggggtcgtgagtctcaggccttgtgcgtaacaggctgggctcctcgccgcatctggagagctccaagggggaagaggtcgacaaatgatttctgccgggcgtggtgcaggactcagagcaggtggtgaatgaggtcggcgcttgctgttggtttaaagggattgacccgtgttttcatgggaggccatgtcagccaagactgctgctgggaccttggccagctctgcccgcgttccagtcaccagaccctcttctgtctgtctccacaaggcccgcgttgactgacctcctcatgtctacaggggcgttctgtcttcctggtttagaaagcagttccacatggagtagggaggtcttggccagcggaccctctgctttccaggaagcaggtcatggggccatagcttcagtttctagataatagttttgtgtggctgtgctgtccccatcccatccccccaacccccacccagtgctgtgagaaccacatcacacctggaactctgtgcatggccaagctcagggcctcctaaacccctccagggattgttgctcctctgaaatctttaaaagctgttgatcttggccaaggtatggttcctattttcctggaaggtttgcggagccaagggcataagtacctgagcagattccacagaccaggtgagtggccccatgttcacctggccataaaaacaaccaatgggcccctacgctattttgctttaactctactttcaaatgtggcctttgctcttgagtgtccagtgtccatcctggggctccacaagtcacatttcagctctgtcaacctcagtgcttgagttgagggtcttcctgggtcatggggcccaggctttttggtgtcaggcacacagtttggaaatagttctcccccattctgtggttgttttttcaatttcttgatagtgtccttgaagcatgaaagttttaatttggagtcttacgtatttgcttatgccgttggtgtgacatctaagaaaccattgcttaatcgagggtcatgaagatatattcttatgttgtcctccaggaatgttagttttagctctgacattgaggtcttgatctgctttgagtaaagttctgcatatggtgtgaggtaggggtcccattcagccagttgtcccagtgtttgctttgtgctttgcagaagctgagctgtggagagctgggctgggtagagcaaaattagagcttcacgccagacttcttgcatttggaaactaacattctaaggaagaaagacgtggtttttttttttaagtgagaaagccaacatatattaacaggaaagcttttcaggtgtttggcacaaatttatttacccccaagaacatacgaagccagaattctaaagctttttcacagattccttgctcatacgtgggagaggtttttttggtaagtttatgaaagagaaatagtacttgtaatccataactaattagcccacgttagcgatgtagaaacgagtgtgattaaacgtgcagttgtcaggtgtgtgtttcccactctgaggctggcttcaacaaagggctttctagttgttttttacataaaggataaaaaaactagccttcgttcacttttcttgccccctccagtgggagggaggaactgctgaaggaacaggaaggtacactgtagttaaatttagcccaacagcagctttcagcatgtgaataaaacaacttttgccaaattgttaggagagcaaaaaatccaacctagaaacacccgtccccactgacagagtgggcggccccctgggacatgttctcctgagagccatggagaaattcatcccaggagggtttgcaaatgtcaatgggacatggggcagcctgtggctgagttagcaccctgggtgtgcttcaccagaaggggcaagagtaggaaccctgattcctggtcccccaatgcagttgtgtgggatgccagtggcgttggcggggagcgcgtcctgcaataccagctagatatgaacacggtgcctccgcagggctggtggggtgcacctaccccaggtggcccatggaatgtgcctcttgcccctttgccagggccgaggtaggggaaaccagccttgagagaatctagggccctgactgagttcagtaaatattagtaattgtcactattgtggagtttgtttgtttgtttgtttgtttgtttgtttgttggttggtttggtttggtctggtgctttttttggtttttggtttttggtttgtttttgtttttttgagacagagtcttgctctgtcacccaggctggagtgcagtggaacaatctcggctcactgcaacctctgcttcccaagaagctgagaccacaggtgcccactaccatacctggttaatttttgtattagtagagatgggatttctccatgttggccaggctggtctcaaactcctgacctcaggtgatccccccgcctcagcctcccaaagtgttgggattacaggcgtgagccactgcacctggcctattgtggagcatttgacaaggatgatcccccatctgaaatcccaggaagactctggacatttttcctctgacagactcagagaggttcaccccctaccctgagtcccacagcagggggtggcccatgccatgatgatcctcaggcacggtgcattagcacagcaagggaaaatcaacaatggtatacacttggggaggagacaccagtccgagctggaagccaaggtctgtgtcagcaagaggaaacaggacaaagtggctgggctctggagcaagagtcatgacgggctctggagcagcagtcatcatgatgggctctgaggctcgcttcccatgggtaacactggggtgatggtgcccaccctacctgccccccacggctctgagaaccgcatcacaccggagctgtgtgcatggcaagctcagggtccccagctggctccacgagcacctgctggtgtttgcctggctccagctgctgccctcaagaccatgctgcatctgagctgctccgactgcggggccaaactccttgccctggatcatgctgctgcctgggagagttcagggaattaattctcccagtgaagagcaaatgccattcttttgtgtgattaaatggaatgtaaaatgttctttggtcataagaggatttaagctggctgttgggaacagctgtaacacacacaagggtaaagttttaataaatggaaaagtaaatgtaggaaaaggtgagggagggtggtagggccggaacacagcatcccgtgcaatcctgtacacaaggataggtgggaattctgctctgagcttcctagcaaccaaagaaagagggaaactgatcacatagaagaatcacactgcatgtaagatgggaccgatgaacccgttgctcagaagcagaggtgagtttctcctgcctttatcgcctctccaaagaagcggcatcagcgctggtttgcagtttgctttctggcattacctccctgctcctcagcctgcaccttcctccgctacccgtcgacagcctcctgcgtgtcaccttctgatttcaccagggcctcatcctggttgaagttgttaagctcttcttgcactttggctggatacagtcagctgttctttggcgctgacttcccccggggttcctacctcctcttctggccctgcctcattaagggattgcattaagggatttttcgtggtggaaggaagctctgcctgcggaactgaatgttggcaccaactgcccagcgcaggccagtccattccccttccatccacagtgcttagagctgacctctggcctctcaacccaacacgtttccccactggggatttgcctattagatgctttttatatgaaggaataaatatgcctttgtgatgggttctagtgttttcctgtaaactgggctctgagcctgggatgctgtagaagttactagattttaagaaaaagttagagaagaaagaagagtggaggcggcatccagccagctgttgtgctgagaatgttcacttcctggctgtgagctgggcctgggcgcagcgctcttggcccttggcctgccggacagcagtcctcgcggatcactttcctcttgggttttaggaccactcgaaaaacgagagtgtgctgcaagcatgaggcttctccctctcccatctcagccttggctgccatagctaaggaggagggtgttattttgcttttgtggacattcaccctgggaaataaggtgagaaaattaagactgggtctgccaggctacaggctactcagggtccttttgcgggaggacgtgttgttcatttctctggaacactggtggaattggtccatctgattccaagggacaagccagcagccagggcggccatccagagggctcctggtcccggcactcatgggcagccatcccctcgggcagtgactcagtggtggcccctggaacttggcagtggcactcggctcgctgcaggttcatggaacatccagggcgtttgccctcctggttgctgctacttcctgtaccttggaggaaaagtcccttggggcactgggaagggtgggcggggcctcatggccttcctcagcctgatcgggacccaccaaagggtcccagaccccagtctcactgcaccctgaccatccccttccccgtcaccccgggtggtgccagagcctttttgtgaggtgcagggatccgggtacccagcgcacagtaggcgttctcaaactttcacacagtgagaagtcagactgagccatccatctctgggttgcctgtggcctttttagattcctgcagaatctcacccagccccgtgtgtgtccacactggacacgctgccagcccagcacccagcctcttgtgcggccggcgagtgagtgtgcagcagctggccgctctgccagattcctctggcaacaattcgtacttttctcttctctattttcccttatttttctcaaacatccccttctgttgttgtcaggggcacatttttagaacttgagagctgttcacccaacacctccaccagcggtatccacacagcgggcgggcgag

SEQ ID NO: 14094 - DNA, 69752 bp, Human
  misc_feature (1)...(69752): n = A,T,C or G
gacacataaataagtgtgttgcgggggaaactaacaatcaggcaaggatattagggaagcacacaggtgaaacacctagcctaatcctgagagtttggtgggtggagagttctggagaggctctctgcaggaagttacaccctcatggatagctaggaaggaccagctgttggaggaaagggcagaattttcttagtctaggggagtcaggaggtgttaacactgcttaacaccttggaagagataaggcagggaggtaagctagggtaggagtttagactctatccccagaactatgaggagcaagggaagggcatttaagcacgggagtaaagtggccaggtgttctttagagcgatcattccatcattccacttgcgctgttcagaacggggattgaggggaacgagatcagaggcgtggagcccaattccgtatttcctcttgaaatagcgatagggagagagggaaaggatagaaaaactggaaaaggagctccacgccaaaggcacacttggccccagtgaaccacctggaatacgctgggagcgctgtaaccactaagtaattctgagcaaaagctagggtggattctggatatgccaggccgtcttttggaaaaagaacacacaattaggcacgaagtggagtaagaaaagaaatcacaattactggagcctcggaaatccgagtttctttcttctgtttaccagaaccgcttgcccagcaatgtttccagagggcgcccggctttccctcttttcccagagcactccccagctctcccaagacaagggtggcgtggtgccccggggcaaagactaagtcgctgtacagcctcgaggagcgagctgctcagcaaaagcaaaagagaagggctctcgggtggcggggacagaccctccttcggcatgggttggatcggacaaggggggccgtgtgccgtcagctgccccacttctctctgaagcccagtgggctccatccactgacccgcggcccgcgcgcctcccggcaccggctacatcgctgggaggtgaggcgctgggagcgcgtgaggctctccgggagaaaacagcccagcttgcatcccagaggaggcagcagccgcaggcaccgtctatttcctcactcagtatacaaatttgacctcaaaaatacgaaccctgtctttggcatgtctgcatttagaaataaacatcattccagacgccggccagttcatagccacagagtcgtaaagttttatttttaaagggggggacggaaaggacttgtaaagttttttttttaaatttgtttttaaataaaggaattaacttctgcaaaacaagcaatcagcagcagaatgcgcgaggccacgagtgcgatcccccgaggcgcggggcgcggctgggaagttttgggggcgcgcggcgcggtgccgggaccggggaggaggcgcgcggttctgggggcgcgcagtgcgggagcgcgcggccccggggatggggaaggggccggggacgggtagcgcgcggcccctgggatggggagggggcgggaaggggggaagagacgcggggctctgggggcccgcagtctgggagcgcgcggccccggtgatggtgagggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcccggggcgggggcgcgcggggccggtcggcgcgcgggggcggcgggcgcggcgctgccaatcgcagacaaaggccgtcccagtgaatcatgtggtgccgggggaggaagtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgagtttcagagaggctcctggaggcgctcacctggcggggtggtccccgcggggcgcccgaggcaggggcgatggcagccgcgggggcgggtccggccctagggctgagagtgtagggagaaggcgccggctctggggtcgtccgaaccctgtcctgtttgcgggcatttgtcataggaaaccccctgccattcccaaaaggggcaaggagaaggcaggggagggctggaggccgccgctcactcgctgcccctggctccgcatcgtgcggtggattcggggcgcttctccgtgcgcagcgcgaagcagcagcgcctgcacacgccagttagtacggatggaaggtgtgcccccaagggaggcctgaactctagaatttgccctgcctccccaggcacctaactcccggcctggaaaggtcttctgcacgttggcctccagatttgggcctgacactgctgttttgagcgttggcagggtgagaccatgttggttttgatgagatgttttgaacctccggcttaggagctctacagaactgcggcttactaactcattccaccggattgctaaacagcaggctggggtaacacccagctccgagctgctgccgctcatcagagttactgtctgagctcatctgagaggccccaagaaaaggccataaaagctgactggggctcttttacagccacacaaaaatcactttatggggcatattattaaataagctaatgggagagtatgtgaattaacttggctgctgctttactgctgatggttgacttaatgaaagtgcagtaattgttgagcactttgcaaatactttgtatagcgttgcacaaaggtttaataacgcggtgccgccgtcatcatcgtcatcatcatctctgattcccattagctttccaagcactaagatgtccattttcactaggactctgccgaaggggaaggcgtcaacggtgtcacctggtgagggtaatttcagaactgtcggatgggcagaaaccctgtgcaatcaggcatctcattccttttaagtgtcttttttttttttttgagaaaaagtcacttatttaaaaaaagaaagaggccgtatgcggtggcgcatgcctgtcatcccagcattgtggaggcggaggcgggaggatcgcttgtgtccctgagtttgagaccggcctgggcaacatggcgaaacttcctctctacaaaatgtacaaaaattagctgggtgtggtagtgcccgcctgtagttccagctactcaggaggctgaggtgggaggcggagcccgggaggcggaggttgcagtgagcagagattgaaccactgcactccagcctgggtgacagagctagatcctgtctcaaaaaaacaaacgaacaaacaaacaaaaaaaacaaagtaggaaaaggattgctctggtacagtggaagccactgactgaaaatatggaagaagtacttttggctaaaaaatagcatatgtgatattttgtagatagtataatcttttaaaaatgggtctacactcagacttcttgtaagtccagcgcatcagcatattttccggtcggagagtaatgcgtattgcctgtccaagtacaacctttaaacctgcaaaccagttcaggcagtcggctgcattgcacagacacttgggttttgtaattgaaatgaggtggttctagcaagatgcaaaagacaggtgaggtgatgttaccctaagaactgtgacaatggtggtattgcacgttgagctctttatatttgtcccctttttggggggcagtgggggaagaggaaaatgcagggaactgccacagctctctggtaatcacatgcaaattctgaacttagagccggattaggggccgggctgcacattttctgcaccatctgctggttggtgagtaaatgctgagcaagggaaacagtgaccaggcagacagagccactccggcccaggggcccaaagtcacggccctgtactctttatatctcccaggtctgcgggcaccacagcaaaggcttttcgcctgagggcacagggtggctggctggagaaggtggcatgtctccatctctgagtgctggcatctcagagcctggcagaacaaagccatttctggcttagtgacaaaactgtgatacttctggggagttataaagccttttgtcgccaacccagctctgcctcccatctcctcctctcccgctcaccccctctttctcttacacaaaccattggaattacctaaagtggggagctttaagaatgactgttgcttgggcccccatctcagaccaagtaaatgagatttttggagaaggggctgacagctaacaattaagaagtatgtttaagaaagcatactttcgatctcggctcactgcagcctccgcctcccgggttcaaatgattctcctacctcagcctcctaagtagctgggactacaggtgtgtgccactatgcccagctaagttttgtatttttagtagagacagtgtttcaccatgttgaccaggatggtcttgatctcttgaccttgtgatctgtccacctcggcctcccaaagtgctgggattacaggtgtgagccaccgcacccggccaagaaagcacacttctaagcaattggttatatttatttttaccagaactctctgaagaaagtaccggtattgtccccattttccagaggaggaaactgaggctgagaggtcgtagatgacttgctcaaggtcacactgtcagtgcatggtggagctgggattcaacacacatctgtgctgtctgagtgtgaggtttgtcttttatgtacagtatgtgaaacctctttttattttattttttgagatagagccttgctttgtggtgatctgggttcactgcaacctctgcctcctggattcaagcgattctcctgcctcagcctcccgagtatctgggattacaggcacctgccactgcacctggctaatttttgtatttttagtagagatggagttttgccatgttggccaggttggtctcaaactcctgacctcaagtaatctgcccacctcggcctcccaaagtgccgtgattacaggtgtgagccaccgcgcctggccatgaaacctcttaacaatgggaaaacatacccaactctaaatctaacctcgtgttctccaggagcgcaaaatcaggttgcagagaatcaaagtatacatacagcacagttaaggcacgatttgcggcactgaagggaatggttattgaagcgtcaggagacttgaatgagacatgagtcctctgagaagaagcaggtgtctggaggctgaagctgggtggggaggaagagaggatggtgggaaggaagtcgtgggggcagtttgggaattgggaatgaactggaaggagaggtccgagatggggaggaagcttttttctgttgttgtcagtcctttgtgcttttgcggggtccctgtacctgggccttactcatctcaccctccctggtgacccagagggtactgttaccccccaactgaggctcggaggggtgagaacacttgcccacactgccccgtccgagcctccgtgcaatgcacacgatgctgcagtacgcagccccggctgcccttgggtacacatctgagggtaatgcgatcatgagcaagctcaatttgattaacttccccctaaatcactgcttttaaattctgccatgttaagtctctttccacccctaatgacctctcaggcagatcctatggctttctagtcatactcggtaattattattattttggagtctggctctgtcacccaggccgcagtagtgtgatcttggctcactgcaacctccgcctcccagattcaagcagttctcctgcctcggcctccttagtagctgagattacaggtgtgcgccaccacgcctggctaatttctgtattttcagtagagacagggtttcaccatcttggccaggctggttttgaactcctgacctcaggtgatctgcctacctcggcttcccaaagtgctgggattgcaggcgtgagccactgtgcctggcccatactcctttattaaatctttacgtctgatttaaagcttctcccacactgtccaaggccagccaggcttcgagctgcagggcttggtgcagagggtgtgcccatgctctcagcctctccccttccatcttcccaggcagcccaggggaggggcacactctctcgtgactgccagcgtgtcggcctctggtcttgctctggcgccgcctctgtgggtaactgccacgtggccatgttgacatgatggacttcagcttcttcctagccccatctttggtctcccttccatcccaattccttcttcagggggcagccacatggctttaggccccttttcgaaaagcccttttagggctttttcttagaaagccatgggatcactgaggcccctccactcccacttggccacatgggtgacaggctggatgcctaactagcgtcttcaggaccctgcacctggctgcttttcactccttgcgtgcctaggggccctcccacctgtaaaaatcccaggtggaagcaagcatcaccctccaagtgcctggtgcctccagatcaccagggcacaggtcaggctccaccgggactccacctgcaaacagtcccagctcagcaagcatctgcccgggcccccttcctgcccaatccctgtgagcagtgtccatgtgtctttctcctttctgacctggggtgaggtgccctgctggtagcaggctgttaactctttttctccatctccactctccaccttccagttcagcctgggaacatggggaggcggctgtggtaggactggttctgctaactctctccgggccgtctgtatgcagtgtctgtctggccccaaatgtttggaacatggagtgctgactacctgttgtttccagctgtggctccttgtgccagctttggggaacagctgagcttctgctcccggctgcatgaggaagtggcgggaccaaggctttgcaccaaggcctttgactcagagcctgttctaagcgctgtgtcaaatcaccattttagtggggacttaggagaggggcaggactctgaaacctaaggcaggcaggggtctctgctcatgaggaattatggtgccttctacctccaggtttcaggatagaggctcagaagcaaaggcggtagcttctgtgcccaggcagctcctgggcagacaggtctgtgccctgcaggggcagaagttgatgtggcggtgggctcggtgacacctcggcagccacgtatcccagcccttcttcctcggaattcccagcctggaactcagactctccagattcccgagtttggcaggatggaacaggctggttcagctttgtcttgggccctatgacaaactcctgccattgcagtcacatggtttgcggaaggaaatggagaagcgagttctctccatggggagaggtgctgtgatgaatggacactgatgtgggaactgagacctgagacgtcaccacgccttggagggcagatgggaagctgacatttatcggggtctggtctgttctgttctgaaactcagctagggacttccacaccctccactcagctgcagcagggatggttcgtgagtcatgtggtcctgtgggatggtgccaggggctcgtggtgagggcctgcggctcatggtaggggctcatagtcggtgttgggagctcatcatgggcactaggccagcaaagccttatgaatgaggaggcagccctgggagtgaaggagcagggtccctgggtgcagatctgggttccaatccgggctttgcctccagtgtgggtcccatggctggttaccacctctctaaggctgctgcttcaccagggagacagaaactgtaatactcatcccatgggtcggagtgggttaaaggagatgccgtgtgtcctgaatccctttgcttctctcctcccttagttgagattctcactgtgtgttgcctacagctctgaacctaggctcttgcttcgacacccagccactgtcctgaaggtcaggtccccgggctgaccctgcccttttccagcctactgtgccatcaaaattacttttccaccaaacagcagcttttctgtttgtaaaacggtggtgactcttggcgcacccgtagggagcatgtggcaagcctaatctagcagtgcctgacatgagagcagaaggcactgggggtccagcagcccagcccctcctttgcagatgagccgaccagaggaggaaattctcccaggcagcccagccaggcgtgcagaggcaggacaagtcccgtgtttcaggctgaccgatccgtgcttgctacagacgccacactctgacttgaagtgggtcatagtcctcattcttgctggtagggaactaagaggcccctaaaagtcgaatccaggaactagtcctccgtgctcaccaggaaagggacgtgggtgattgtaggagtaaggggcttcggctgtggctcttggtggtcagtttagtcaagacgtgtttatcaaatacctgtcgtgtggcaggccctagtctaggagttgtgaagagggaagcttctaggccttttggtgattgtaaagaagtaagaggcttaggaaacagacaaggcgggccaagggcaaggactgtgctcagcctggcctctgggccctgcgcccatggcctcagcccctggcaccggctccctgcggagctagctcagtgggctcatggccagccagagttgtgtgtgcacctaggtgtgcgcctttgtatgtgtatgtgcatgtgtgcctgtgtgcacctgtgtgtatgtacatgtgtgcctgtgcacgtgtggctgcgtgcacctgtgtgtgtatgtgcatatgcgtgtgtgcctgtgtgcacctgtgtgtgtgtggggtttgtgtatgtgtgcctgtgtgtgtgcctgtgtgtgtacctgtgtgtgtgtgtgcctgcctctgtgtgcctgtgtctgtgtgggtctctgagtgtctgtgcatgtgtgtgtctgtgcctgtgtatgtctgtgcctgcgtgtgcctgtgtgtgtgcctctgtttgtgtctgtgcatgtgtgtgcccgtttgtgtttgtgtgtgtctatgtgcctgtgtgtgtgtctgtgcctgtgtgtgcctgtgtatgtctgtgcccgtgtgtgtgcctgtgtttgtgtgtgtctgtgcctgtgtgtgtctttgcctgtgtttgtgtgtatgtgcctgtgtgtgtgtctgtgcatgtgtgtgcctgtgtgtgtggaaaggtttccttattttcttggtctgccgttcacccccagcacctcccgcaggccactttctaaacatacagcccagtttcccgagccctctcctcgagccatggcagcgtgctcttctctctgcagctgaggctgtgaccgcatcagtgcctcggtgatgccctgccaaccgagggggaactaaatcctgttaatgccctcagcactcggggaacaattaggcccctcacagcacattcagcatccaaccccagtgaccatgcaggaagcctggacttccccacagcagaggctgggctgaggctgctgccgggtcaccatcaggagcgccctactgtcggctccgaacactgtggcacctgcaggctttgctacggcttcttgctcacctgcctttccgtagtcagacaggcagaactggtagtgaccagcagggaggcagggccggagcactgtcctgaggctagtgcaggttctcagtggagttccagggcccagccatggctgtcccgctgctgctgtgcccaccctctgagccccaggctagctgctcagcgttgagtggcggggagtggagggcaggggtcatgacagtgaggggtgggctgcccagagaggaacatttgcaagatccaagaccctctacaaaatctcactgcaagcgtcttagggttttgcaaacaacaaagtcatgtgatcccaagagccgcttttgtcaggctgttcctgttggccttgcgtttccagtgagaagaagaaagctggttcctggttggaaggtctgtctgggtcctgacattttggccggccagttctctcagtacagaaatagccccagcagactgtttagacagtacctgggacaacaggcattccccgagggctgcagaggctcataaatatttcactttttatgtttcctgcagctgaagtttagagtccattaacctataaggacagatgaagcccaaatggttttactctgcaagtgggttgattacctcaagcttatgtgggtcaggattttaggcctgtgagccacatatggtctctgttgcatattcattttttttttttttttttttttttgagacagagtcttgctctgtcgccaagctggagtgcagtggcgcaatctcggctcactgcaacatctgcctcccaggttcaagtgattctcctgccacagcctcccgagtagctgggactacaggtgcccgccaccatgcccagctaatttttgtatttttagtagagacggggtttcacaatgttggccaggatgatctcgatctcttgacctcatgatccgcctgcctcggccttccaaagtgctgggattacaggcgtgagccactgcgcccggcctccctcctcgatttttaaatggcatacacacttgcgaggctgagctacgcagtctgcaaaacacagggtgaaaaaacccccatacacggtggggttggctctgtgggctgctcccaccccataggctactctccctgtcaccttggactctgctgccacagcttctttgtagctgtcagaggtcatgttgtcccatcaggctgtgtgacggtccatttttagtgcatgagtggtggcagataaggagggaagtgggcagggtgtgagcaaccttggcgtgccgtgagcctggccccatcaggcccacactcattttctgggaagacagcacacatctatccatgcgagagggcctcgtcctcccagctttcacaaagcaacataaagttcaactggaacatggcgattcatttcatttattcaacaggtgtttttttttaaattaaaaaaattgtattgtctgggtgtggtgaattacacctgtaatcccaacactttgggaggacgaggcaggaggttcgcttgagcccaggagttcaagactatcctgggcaatatagtgagatctcatctgtacaaaaaattaaaaaattagccaagcatagtggcatgcacctgtaatcccagctactcaagaggctgaggtgggaggattgcttgaacttgggaggtcaaggctgcagtgagctgagatcgcaccactgcattctagcctgggtgatagagcgagacctgtctcaaaaaaatgtattggggctggacacagtggcttatgcctgtaatcccagcactttgggaggccgaggcgggtggatcatctgaggtcagtagttcagaccaccctggccaacacggtgaaaccccatctctaccaaaaatacaaaaattagctaggcgtggtgggcgcctgtaatcccagccattgaggaggctgagacaggagaattgcttgaatccgggaggcagaggttgcagtgagccaagatcgcaccgttgcactgtaacctgggtgacaagagtgaaactccatctcaaaaagaaaaacaatgtattgggctaggtgcagtggatcacgtctataatcccagcactttgggaggctgaggtgggtggatcatgaggtcaggagttcgagaccagcctggccaacatggtgaaaccccatctctactaaaaatacaaaaattagctgggtgcagtggcgggcgcctgtaatcccagctactcaggaggctgaggcaggagaattgcttgaacctgggaggcggaggatgcagtgagccgagatgacaccactgcactccaggctgggagacagagcaatactccatctcggggaaaaaaaaaaaaagaaacaaacaaaaacagacaaaaaaccaaataaaaaaaagacgtattgaagcaaaattgacacaatatgaaattaaccattgaatgcatgcagctgagtgatgttcagtacattcacagtattgcgcagctgtcacctctatctaggtccagaacatttttatcacccccaaaggaaactttatgcccattaagcaatcactactcagtccctgttgcctcagcccctggcagccacccatctgctttctatctctgcagatttacctatccttaatatttcatatcaaaggaatcatacaatgtgtattcttgtacgtcttctcctttctcctagcatagtgttttgaggttcatcacattgtaacatttatcagaacttcattcctttataaggttaaataatattgtgctgcatggatagagactacattttatttatccattcatccgttgatggacatttaggttgtttcatcatgcgcgtttgagtgcttgttgtgtgccagacactgtgcagactgtttaaggtcaaacttagattctcgctgcgtggaacttagccttgagcaaggaaaacagacttcatgtcaacgacttctccattgtgcgattgactggctgatgtgacttagtggctgtccttacagtagagatatgaagtgtgagatgttttcagtggaaagttgaagacttaattcattccttcatctctgtgagtccccctctaggatacatgctttaaaaagaaccagtggtttttgctgctatttaaatgaaagtcaaatccaatttaaaaatctcactgtaatgaaatcaaaatatttcccaaacacaggtattcactgtgaagcgatgccaggatggctgtggagggaacttcttggtggaagtcgtcacctgtgacttgggctgttgggtttccacccaccattgccctggtcctgctcctagggccccttccttgggtgccactgggaggtgaaggcttaggtttaggttgacatagcaggtgtattctcaccagaaccagattctggggcaaccaagttgggcccctggctagtcttgggttttgtgtgtggaagcccccagactccgtgtcctcctgggccctgctccaggttaagctggaatttctggtctgcctgggtttgttctcagcgaatcgtggggtccagaccaacatgaggatggaagggtggtgctgggtaactcccaccctgcgccctggggctgtgaacagcacgcgtcatccgtcccccgaggacacacggcctgtcacggctttgacagcatatattgtgtcttccccgagttctctctgcttggggtcagctagtcccagtttttttcagtattcctggaggaacgtgggtgtgtcctctgccatcctggttgctgttcccgaaggccccagtgagctgggacagtgtcaggagcagaccaagtccccacccctagtgaggagcttcccccgttacccacatagcttcccctcgaggaggccagatggtcattctctcggtggcaggacacagggagtgtcatttaataccagacacgtccagcaagggcaggagttcccagggcatcctaaaacctcagaattctcctcacttctgaagcagaaagttattctgtgaggaggggcaaaaacaaactggggtactttccctgcgaatttattttgtagtttttgcatcgtttgccagcaaggatcagggcacgatggtacgacactgcacactgccgcacgtggcccgggaccctcctgccatagggcccagtgggccagcgctggccaccgggagaaatgcatcctctgtgcttctaatgtgtcaccttccttaagtacatttagaacaattaggggcagggccctggctggtaaactgtgaactgcaatttgtggttaagcagttaagaaacataacagtgatggtagggccttgtgtggccacagcccttgtcattcccaaggccaaagagagagaatcctgccagggaggcaggtcagaattatttgcctccacctctgtgcggaactgatgccgagacggactccacccaggcagtgggcaggcgggcaggtccgtgcgcttctgtggctgaagcggccgggccgcagctattcctgcggggcttccagggcggaggacacgggctgacacgggctgtccctgggaaggaacttcaagtcatggagctgtcaaagtagaagcagcttaatgaatatttgtcctaatgctttcacctcgcagatagacactgaggcctagaaaggtcgatggagctaaccaggaaccaacaaagtaggttcctgagggttgaccagcctcacccctgaatccaggtgctcaggggacaagagacaattcagaaaagcagggagactgaaggacggcgtttggtgtggctttaggttgacttggagagccgcaaagggtgtgggtgggaggtgtgctctctagagtcccgtctcctcgcgggctgcctgctgggctgacttatcaatgtgggggctcagggccaccctgagttctgccttctgggtggccagcctgtgttggcgccgttggatggagtgaagctcagtttatgaggctcagggaggctctcgtgagccgatggaggggtggaggaggggagaggtgcttgctgcccggagagctgagctgctgggaacaggaaggagaagaggagctgttgggaagggggacagtgagtggagatgccctttatctataaaggtaaagactgttatcccattatcacttatgaaatgaggaatgccttgtgaggaccaaggtagggacatcctgggtgggagctgagctcctgccttgtggggtgcacatgcacaaacatgcacacacatacacaaacgcacacacatgcacacacacgcgcgcgcgcaaacacacatgcatacacctgaggaaggatcataggcgccaggtgagccaaacaggaccatgcagcggagctctcaggagggctggagaaggctgcaaacacatccagggagctccgaggtctatggaaatccagagaagcaattatggttggcttctgatcacgtgggaagaagctcactgaagtctggggggcccacattccaagggccagcacgaggccaggagcaggcaggaccagcttcttgggccacatgcttgccaaagtcaaaggtgggaggtgatgcggtgaacacctgaccatgtattccagtgacccctctcacacctggccagcctgggacacagaccaggcacaccttggcttcaggccaccgcctcccagaactttatggcatggacagcgtgcttgcttgccttttctggccagttaccttcactgccacggacacaggactatgagtggggctgtggtggtggttatccaggtcctgagtccctggacctatagcccacagctgacgtttggaagaaaagaacatcctaacgcaggcatagaggccccgcccttgctcgcactgtcttggagactgagcctcaaatgcagatcccctccccgccgcagagccgccttgtgtgtcttccgggaaccctgcagaaaggagaactccggtgtctggatttcggggaccgactgtcttgtcaccctgctctgctgagtgaggatgctcagcatgtgggaacagactgaagcagctgactaatgactgttgcctggggagaccagggccctggggtttgcataatttccccaatatatcaggaagtgggtagcgcagagggaccaggagagcaaatatcgaatgcgtcagtggttcttaacctttttcagaatgaaagttccttttatggttaggatagcatctgtggtcacagtttagtagctgtgcgtttagaatcatggtttgcgaacatagatgaggactaataataccaacagcaggggttgcagccacccacgtggtacttactaggcggcaggcatttgtccaggtgctctacatgtctattaattcaccaaatgcttaggaaaacctggtggctggtgttattagtctcattttacaggtgaggtacttgaggcacagagcaggcaggtgacttttccaaggccacacagctgataattggtagagccaggattcaaccccaggtaagccagctccagattccacacttttttttttttttttgagacggagtcccgctcagtcgcccaggctggagtgcagtggcgcgatctctgctcactgcaagctccgcctcctggttcacgccattctcctgcctcagtctccccagtggctgggactacaggcgcccgccaccacgcccggctaattttttgtatttttagtagagacagggtttcaccgtgttagccaggatggtcttgatctcctgacctcatgatccgcctcccccacctcccaaagtgctgggattacaggcgtgagccactgtgcccggcccgattccacacacttagccatccttctgtgtccctctgtcagagagggctaccggttgtggcctgttatataggagtagcgtcgtctgtcagtatatgtgggggactggttccaggacccccaagtatgctcagagccccacatactcacatccctgtagaacctgcatgtacaaagagttggtcctccttatattcaggttttacgtcctgagaacatcgtagttttgattcccattcagttgaaaaaaatccatgtatagatgcgcccatgcagttcaaacccatgctgcccaggggccaactgcactgtgccttagtgaagatgcatgagctagaactgtgtgtatcaacatagataccttccaaacacatagtcatgagggaataaacaaactgcagaaggttatggaaggtattaatgcattcatataaagtgcaaaaccatactggacggtactctgtatctttcacgaatccagatttacctagtgaaagcctgcctagccataaaaacaccaaattcaggatagtgattactttcctgggagcaaatggcaccaggagggggcaggctgggagctccagctgtgtcatttttatttattaaaccacagctggggctgggcatggtggcttatgcctgtaatcccaacactttgagaggctgaggtgggtggatcacctgaggtcaggagttcaagaccaacctggccaaaatggtgaaacccctgtctctactaaaaatacaaagatttgccgggtgtggttgcacgtgcctataatcccagctactcgggaggctgaggcacgagaatcgcttgaacccgggagacaaggttgcagtgagccgagatggcaccactgcgctccagcctaggcaacaaaagtgaaactctgtctcagaaacaaacaaacaaaacatagctggagcaaacgtggcaaagtattaaggatggagtgctgggtgcatgagtatttgctgttatttctttgtatatacataaattattttataatataaagtttcaacctgccatgcatttgtaacattttcagatgaatttgcatacatacgttttgaaccagcgtgtgtgatagagactggtttctttagtcaggagtctgtgcttggtgcactaagagtttcagtccccctcagttactgcgagggtctcctcaggagtctcagcccacaggcagctaggatcaggatgcacccccttttaaggatagggggattatgaagtgtccagagagtggtggcacagaagtggagacactagggtgtccagatgtgggtcctggcttaggggagaggatttataaagtaaaatggctgcagagattctgaatcaagcgcaggttggaagcatagtgctttgttggtacatcagagacactgcctccagggacatcagaggtgacttctgttgagttctgctgactgcacaggagacactgtcatacccacaaagaatagcaggggacatttctgccagaaacaccactaagacattagtaaaaatgattgtaacccagctactcaggaggccgagatgggaggatcacttgagtctaggagttcaagaccagcctgggcaatgtagggagacatcatctctaaaaaataagacaaattagccaggcatttgggctgcacctgtacatagtctcagctactcaggaagttaaggcaggaggattcctggagcccaggaagatggaggctgcaatgagctatgatggcaccactgcactccagcctgggtgacagcaagaccccgcctcttaaaaacaaacaaacaaacagaaagattgtaagacagcaaatgtcaacttgagttagtagttgaaaaaataggcttggcggggtggctcatgcctgtaatcccagcactttgggaggccgaggcaggcggatcacgagatcaggagttcaagaccagcctgatcaacattgtgaaaccccgtctctttttgtatttgtagaaatacaaaaatgagccaggcatggtggcgggtgcttgtaatcccagctactcgggaggctgaggcaggagaatcacttgaacctgggaggcagaggttgcaggaaaaaaaaaaagaaaagaaaaaaaataggcaagcgggagttcaaagggtgggaacaaatcagtgacgcgtgaacagactgatttatgagggcagggggcagagtccagcagctgctcaaaggcctttatgcttctgtcgaaacaagtacgtcacatgcagagctctaggccttcctgtgtcatccgaaaggatggggtgaaggcctgggttaccaagggggcacaagtcgcccacaggtccgggatgaggaggccttggcccactgtgggagcgggtggtgcggaaagcccatgagggctctcgaacattccccagcgcctgacagcggccagctggggacatctcccagccgtggctcagccttcaacaagtcaaaaagccagcatcacccacagcgtcatccccagatctattctaggttctgaggttctaggtgggactttcaaaagcagaagaaacgatgctaaaaccgaaaggaatttgccattagggagaaatgctttattttcaccagatgacaaacttcagggtttctgatcaaagttgctgcaatttcttctttctccttcaggcctgattctgctcccctcccctgtcctcccatccttcttgccacaacgggggaagccctgaaaaaccccggtgttttcataggctgtgtggagcccaaggaaggggagggaaaggaagtggggctcatttaccaccattcagttcctgatcgggttccccaagaagcagctgggactctccaacccaacctcacttccccggggtccctgtcattaggcagatggcactcccatggctgtccctgccatgttccctcagacccctccttgctgcctcagtttctcagccctccacccttccctgcctcctgcctctcccctgtctgcccttctcgggacccaggctccttctgtctgtccacaagcatgctcaggtctccccatcttaaaaacaaggtctggaccccctgaataacctctttcttgcatttcacaaacatgcgcttttggaaagcagtttatgctcttgaattgactcactgctcccacttcctcctgctgccatccagggtctgcctgttccccctccagcctccccgtcagtcgagcctgcccttggccaggccctgtggcagcttaaggtgaagtggtccagcctgtcagccgcactggacaccctgactgtctcctgcccggggcctctctcccctgcagtctttgaggccttgaccactgaggggactgctctttgacctcctccctactcttagttttttttttgtctttttgtttttttttaaataacagctttattgaggtataattcacattttctgtgctgtccccatctcgaagtgtaccacattcagagttgcgcagtgaccccacagtccactgtagaccttttccatcccagaaggaaccccgtgcctcttagtggtcaccctccaattccccgccacgccctccaggcccaggcatcatgaatctgtgttgggcctctgatttgccttcattttcaccttctctgtcaacccatggtctgcagcctttgctctgctctgtatcccagggacctctctcacagcacaggtctgcatttcagctgtgccaatgctcccccgaagctctccgcacccttaccctggacagcggcctcttcctggctggtccacaccccagcccgaccttctgctgccctccccagctccgggctcctgcagcaccttctctcctcaccccctccctcactgctcctaagtccacatgcaggttcacacctcctcatgcttcccacgcctccatgcacttttcacacctccacacatcacatctcctcacacctccacacacacttcacacctcctcacgcctcccactcacaccttctcacgcctcccacatctccacacgcttttcacacctcctgttatggtttggctgcatccccatgcaaatctcaacttgaattgtatctcccagaatttccaagtgttgtgggagggacccacagggaggtaattgaatcatgggggctggtctttcccatgctattcttgtgatggtgaataagtctcacaagatctgatgggtttatcaggggtttctgcttttgcttcctcctcattttttttctcttgccgccgccatgtaagaaatgccttttgcctcctgccatgactctgaggcctccccagccatgtggaattgttaagtccaattaaacctctttttcttcctagtctcgggtatgtctttatcagcagtgtgaaaatggactaatacagtaaattagtaccaggagtggggtgttgctgaaaagatacccaaaaatgtgaagcaactttggaactgggtaacagacagagattacaacagttggagggctcagaagaagacaggaaaatgtgggaaagtttggaactttctagagacttattgaatggctttgcccaaaatgctgatagtgatatggtcaataaaatccaggctgaggtggtctcagatagagatgaggaactttttgggaactggagcaaaggtgactctggttatgttttagcaaagagattggtggcattttacccttgccctagagatttgtggaacactgaacttcagagagatgatttagggtatctggcagaagaaatttctgagcagcaaagcatttagaggtgacttcagtactcttaaaggcattcagttttaaaagggaaacagaacataaaaattcagaaaatttgcagcctgactatacaatagaaaggaaaaacccattttctgggaagaaattcaagcacgctacagaaatgtgtataagtagcaaagagcctaacgttaatccccaagtccatggggaaaatgtccccaggccatgtcagagaccttcatggcagcccttcccatcataagccttaagtcccttttgtgggctgggcccagggtccccatgctgtgtgcagcctagggacttcgtgccctgtgtcccagctgctccagccatggctgaaaggggccaacgtagagctcgggctgtggcttcagagggtggaagccccaagccttggcagcttccatgtgttattgagcctgcaggtgcacagaagtcaaggtctgaggtttgggaacctccgcctagattccagaagatgtatggaaatgcctggatgcccaggcaaaagtttgctgtgggggtggggccctcatggagaagctctgctagggcagtgcagaagggaaatgtggggtcggagcccccacacagagtccctactggggcactgtctagcggagctgtgagaagagggccactgtcctccagacctcagaatggtatatccaccgacagcttgcactgcgctcctggaaaagccacagacactcaacaccagcccgtgaaagcagccgggagagaggctgtaccctgcaaagccacaggggtggagctgcccaagaccatgggaacccacctcttgcatcactgtgacctggatgtgagacttggagtcaaaggagatcatattggagctttaaactttgactgacctgctggatttcagacttgcatgggccctgtaaccactttgttttggccactttctcccacttggaacggctgtatttacccaatgcctgtatctccattgtatctaggaagtaactagcttgctttcgattttacaggctcataggcagaagggacttgccttatcacagatgaaactttggactgtggacttttgggttaatgctgaaatgagttaagacttttggggactgttgggaaggcatgattggttttgaaatgtgaggacgtgagattaggaggggccagggatggaatgatatggtttggctgtgtccccctccaaatctcaacttgaattgtatctcccggaattcccatgtgttgtgggagggacctgggaggaagtaattgaatcacgggggccggtctttcttgtactattcttgtgatagtgaataagtctcaggagatctgatgggtttatcaggggtttccgcttttgcttcttcctcatttttttctcttgctgctgccatgtaagaagtgcctttcgccacccactgtgattctgaggcttccccagccatgtggaactgtaagtccaattaaacttctttttcttcccagtctcagatatgtcttcatcagcagcatgaaaacagactaatatacctcctcatacctcccatgcctccacactttcacacttcctcacacctacccatactgcctcacaggacggagtttgaatcgcataaaaaggcattcttccccaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgcccctccccagctgagttcctgccaaggtcagtgggagccagtgcagactggcagaaatgggcagccggatatgagagcccagccggccagagagccagggtgagccaggagctttagctcaagttccggacacccaccagtctttagcaaagtctctcagaacacagaggggagtgggtgggagagtttagatttttgtttttgaaaacttggtttatgccctttaattaatgagggcaaaagttgtactgaaattatatgtgcgtttgttgatattatctatataataagttatatagataatgtaagtacatatatatataatttcagtttcacatgccaggaattcaaacacaactttaaagaacttaagtttaggaattaacttgaaggattaaggaagagtttctcagcacagcttgaatagtgcccagatgaattcaagagagagagagagagagagagagagagagagatggatggagttttgctcttgttgcccaggctggagtgcaatggtgtgatctcagttcactgcaacctttgcctcccgggttcaagcaattctgctgcctcagcctcccaagtagctgggattccaggtgcctgccaccacacccagctaatttttatagttttagaggagacagggtttcaccatgttggccaggttggtcttgaactcctgacctcaggcaatccgcctgcctcagcctctgaaagtgctgggattacaggcgtgagccactgcacccagcctgaattcaagatatattgccacaaattataagaagtggatagagcttttcaaaaccatggtcaaggcttttattttgatgtttgcaccatggctttgagcttgggaggatgaaaatgactgatttaacatcagattgtgccttgatatgtgatgactttttccctccaggcagggaggtggccctagtgatgaaatgagtaagggtttgtgagttatccgcatcttggctggcgtaagtcatccttccctttcagggctagaatggtgaactccagggccctcttgtactcagtgcattgcttgatctgtgttcatgttcatggggtaagggctggggagcatcttaaagttgctgttgcttctcctttgttgttgttatcgttactcttattaaggctgcagtgaaccttctgttcatacttggttccatagcgcagtgcttcccaaactctattcccgggaacactcattaggaagactgtaattggtcaaatagatttggaaaaccgctgtataccgtatgtttctcttgaagattgacaatatatttgcctttgaaaggctctgacaattcctgcagggggaaaaagttttcctagcagtttctaaatttgatcacgtgacatttattttcggtaatatttcttaccaatttccagttctgctggaacaccttgagaaggcctgcctcagaataaattcttacaagtggaattgttggggcaaagcatatgaacatttatgtatggtggccaggagcgctgcaatacagccacttcgtgtgttgggtaagagtaatccaggcgtgctggactgggttacctaccgcttggtaaaccccactaagtgggcaaaatatcaaaacagatttttatattgaacgggtcaaacattttttaaaaaattctgtagtttcttcttctcactttggcatttgtgaagaagcctcagttattaaaagcaagatccctcaggactgtttaacagaaaggcattgttctgtgttgtgtgaaatcagtagcatattttgtaatggaactttggagtcatgtattaatctatttcttgtttctaagagaggttgtttggtaacgtttctttttacggatgtcagagaaataccaaaggtgacgtgtcttgcctaaaatcccgtggtgggttgtcagataaagtggaaccaggactcctttaaagaagggtcactgtactgagccatctattgtgccgttaccagagaaaaatattttaatgtatattaaatatatacattatatatatttatatatacatatatatatttatatatatacattatatatatttatatatatacaggtgtaaatccctgcctcctacctacttgcaaaaaggatttatgacagagagaaaactcatagcagaaccaaataattcttctagaaggttggaagcctcacctatgaagctcggaggaggttataaaagggaagaggtgcttacttagaaatctttaggaatggccgggcacagtggctaacgcctgtaatcccagcactttgggaggccgaggtgggtggggcacttgaggtcaggcgtgagccattgtgcctggccgtcataagatcattatcttatggttctttttttaagagctgaggcctcacactatattggtgagggtggtcttgaactcctgggcccaagcgatcctcccatttcagcctcctccctgagaagcagcggagagtagatgtgactgggggattcatgagggagaggaggaccaggcgggtatgcacgttgagcaccggggttcaggagcttcagggggctgtgggaggaaaggccccgaggccgagggtaggtttaggaactccatggagagcagtttgcttgcaagtggggaatgtgagtcttctttccccgccccggcttcattgaagtataattgacaaagacggaatatattcaaagtgtgcaccgtgatgttttgataatacatgtacataaggaatgattcccacaatcaagctagttaacaacatatccatcacctcacacagttgcccacccttgttttgtggtgagaacacttaagatctctcttagcaaatttcgagtaaacaatacattgttactgactgtagtcaccacgctgtaggagagctccccaggacttactcaacgtggctggaggacactacgctaagtgaaataagccagtcacagaaagacaaatagatcccgcttatatgtggaatccaaacaagttagaactcatagaaacagagagtacagtggtacagtggtggttgtcaggggctgggggatgaggggtgcggcaggagaatggagagatgttggtcaaagagtccagacttgccggaatgggcgtcttcagatgcttgacagattgtttctgaaaagctgtcctctctcctccagtcttccacaccctttctttccttctcccagtactgtattgcaaccctgttaaacaccagggatccatgtgctcatgtgtaactgctccacaggctaccctagtccccagagaccccccactgagatccccatgagcctgagcccctgcttgaatctccagcacgtgctgtagcagtagcagcctccttgtctggggcgtggaagcatgcgtggacacctaccttctgcctcctcttcaccttctcgaaggctctgccaggctctctgccatccagtgtgtgtgggcaatccagcaattgtgaagacttagaaaagagcttgagaaatgccagtctgcaatatttctgtttcagaaaacagtccaatttgatacttcttttgtccaaagatgttttgttattttaaatgtactgcaaagtttgaggcctgggtaggcagacacttactaatttggtgccagcaaaaattctaataaagagagtggactgtttgtttatcttaaataagaatcttaaggccgggtgtggtggctcacacctgtaatcccagcactttgggaggctgaggtgggcagatcacctgaggtcaggagttcgagaccagcctggccaacatggtgaaaccccatctctactaaaaatacaaaaattaactgggtgtggtgacacctgtaatcccagctacttgggaggctgaggcaggaaaatcacttgaacccgggaggcagaggttgcagtgagccgagatggcgccattgcactccagctcgggcaacaagagtgaaattctgtctcgaaaaaaaaaaaaaaaaagaatctgaacagaagtacttggccatggtagactagtaatacatttagttttgttttcttttttaaccatgttcgaattcctttactattaaaactgtatgtgcaacataagaaatgtttggcataacaaacgtggacatttcaattataaaaaacgtgcccagcgctgggggatgaaggggcagaggaattcccagtgatggtatcagtctggttctgtcaacatattggaccccaacctgccatgcttttctgtcgttgcaggtgattttcaaagccaagtcaaaatattctccagaattactcaaataccggtaagtactgcagggcatctctttctgtggtagaaggggaaagtgccgacacatgaatctcatctctccattggggtttgcacacatcgctgttctgtgagccgccggaaacagtcctgcctgctggctggctgcccacattgtgcacatcatgtgcattgccggtaagggtcaggtcatcagatcatgacttcatgaatcatggggacttgcatcatacttacccagttcagaaacaagagcctggtgcctttcctaacaggaggaaatacatgggaataaaataggtgtatgttgcctctaaaccttcctgaggcacttgagaagagcctcagcagaaggaaacagggttccttgaagatgcagtgctttgccaggtgcttccccttccccatcccgcacctcccatgctcccactgcaggtgcaggtgcaggtgcaggtgcaggtgcaggtgcaggtacaggtacaggtacaggtgcaggtgcaggtgcaggtgcagctgtggcagggcctcgcccctgcagcctgccacctggtggccttacccgccttgtctcagctgctggtaggctccggctccttgttttccagaacttcagtgcccattgaaccctaagttgctacacagctgcttgcagggtatccatccacatccagaaatactgttctgaccattcagtgctcatttaggcaccaggaggaagaatgtgttatagctgagaagtggacactctatatttgtaacaatggcttaacacaaaggcttgcagaatcaggcagagcaggatgtgcaacatgccaaaaacatggacaccgggaggcatggacattttgtggaagagaggcttgtgccagagtgtaatctggaagggaacctcttaagttatgtgaggagggggatctgcattttcctatggaggggttcgtagctctccccagaggggagaggcctatgactttcctaaggccaagaaccagtggcttaaagaatactcaggtttggctgggcacggtggctcacgcctgtaatcccagcactttgggaggccgaggtgggctgatcacttgaggtcaggagttcgagaccagcctggccaacatagtgaaaccctgtctctactaaaaatacaaaaattagccgggcgaggtagcgcacatctgttgtctcagctacttaggaggctgaggtgggagaatcacttgagctcaggaggcagaggttgcagtaagccaagattgcaccactgtgctgcagcctgggcaacagagtgagaatccatctcaaaaaaaaaaaaaaaaaaaaaaaaagaatggtcaggtttgactggggttgggggaggagaacaggcctctggaagaggcgcgggggtgcagtgtgagtccaggggttctggcgtttctgcccgggagaactccattgccaacggcaaacatttctgaaaaggtgactctggccattgcctccttgggtcaaaatgaaaaattattttgtcattttttaaaatatgttaaatcgtatacatattttatttaaatatatatcatctaaaaatatgtaaagactttttacttaaaattctgaaggtgtaatagtttaatcctgagtttatatccaaggaaaccagttcagaaggtttctctcaagttcagaaagttctgtgaaggtgcctgggccaagatacaagtcccaagactcaccgtcccgggttttgttttgtttttcacctgatcttgctgtctcccttcactgctttgtacgtggctcagttcacgtctctaccaggctcaggtggaacttcagcgtccactgtgaaatgatgttggtcccaaggagagcaatttaaagtacaggttgagtgtccctaatctgaaatgcttgggaccaaaaatatttcagatttcagatttttttggattttgaaatatttgcatatacaggccgggcacggtggctcactcctgtaatcccagaactttgggaggccgaagcaggtaggtcatttgaggtcaggagtttgagaccagtctggccaacatggtgaaaccccgtttctactaaaaatacagaaattagctgtgcgtggttgcaggtgcctgtaatcccagctactcaggaggctgagttgggagaatcgcttaagcctaaggggtggagattgcagtgtgtggagatcatgccactgcactccagcctgggcaacacagcgactctgtctcaaaaaaaaaaaaaaaaggaaaaagatatttttgtatacataatgagagatggggggattggatgggacacaaatctaacacgaaatgtatttatgtttcagatacaccttatacacatatcctgaaggcaactttatacaacattttaaataactcagcataaaacagttgtaactgtgttttgactgcaatccatcacatgaagtcaggtgtggaattctccagttgtggcatcaggttgattgatgctcagaaagtttcagattttggagcatttcggattttgaatttttgggttagggatggtcaacctgtataaagtacaagtagacagttccctctcttctccagtaacaagatagtagcctctcctctgcatctatagtctttgccctgcatccccccagccagaaatgtaggtcaaagcatgagtgaagatgggcataggaggagaacattctgtctgatcggaccgtggaactgattttatcttggaagcagttgaggctggggtaattagatgtcttctagaggtggaatataaaagcactggtcagaaaggaaattgtttaaaaagctttcaacctctgagcacggggactggggtcttcgggtgagaagatatgtgcgtggggcagtccttgcttgatccttgagccaaagtatacctcaaagacaggctgcgctgacatgtatggctgcattttattgggaagggattcacagaaatgaagggagaagatggggagaaataaatttggatccagatgttaaaagtgagatgtttgggactgggcgcggtggctcatgcctgtaatcccagcactttgggaggccgaggcaggcagatcacctgagatcaggagtttgagaccatcctggccaacatggtgaaatcccactaaaaatacaaaaattagccaggcatgatggcgcatgcctgtaatcccagctacttgggaggctgaggcaggagaatcacttgaacccaggaggttgaggttgcagtgagccgagattgtgccattgcactccagcctgggcaacaagaacaaaaactccatctcaaaaaaaaaaaaaaaaagtgagatgtttaggccagtgaagttggagagttccttgaaacaggagggtgaggtttcaatgggacatgcctgttaacccagtcctagtgattttgttgccaaatataaagaaatactaggagttattcctgtgtaggcacatctttagtctcatctatagaattcctcagttctcttaaaccagatgccactagagacatttcaggccacaatctctcccttgagatgctttggtatgttggcttctaaatagattggcttccctcatttaatcataactcacttgaaataaaacatgagccattagtctagaactagttgaaactttccactccaatctattcctgtagtaattcactggttttgaagataatttatatttaactcagccaagaaccactttatttttcacttaaaatcacctctaccctcccacatctgctagctcagagttttgctggagtggaaggcaatttaattcaggctttctctttctcagtctatgtattttaatttatttggtttaagaaatgtgaacatttggcatgggagtaatcatttccaactgtttgccctctagctttgtgatttttttaaataagtaaaaaatacagtgagccaggttttcctttttttttttttttaagagacaaggtctcacccaggctggagtgcagtggcggtggtgcaatcatagctcactatagctttaatctcctgggctcaagcgatcctcctgcctctgcttcctgagtagctgggaatacaggtgcatgtcaccacatccagctaattaaaaaaaaattttttttttttagagacaggttcttgctatgttgccaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcgatggtattgggagataaatttaaacaatgctttaccccttgcttctgtcctctcacagtaggaggtgtcgggcactgttgtgttggctgccttgaagactcgcctcatccctgcatttgctgaccagcagcactgatccttctggtcccacaagcaatgtggtcttcccagatgctgggtcacactgattgttttatttctttgggtcatttctgtcatcatgccaggatgagctatttatcctggccctatggtttaggttaaaaggcagtagtattgggggcagtgtacaaaattctttctgtggaaacatacttttttgatacagtttattctggcctcctttgaaaactctctcgccacacctccagatcgctccctttctaccacagctgcaggcatagagggaaaaaaacttgttttgcaagatggttttgcattataaaagtgataacaaggatattaggaaaaaaattatacaatagaaaaagatagacattttgtgaatatagacatgtggaaagaaagcaagcaagtccactgaactttccctcctcccagcataaacccccctccagccctaaggaaatacaatgatgtattccattataggtttttatacagatttcccaagacaaagttgatgtctatattgcatttccaattttgcatcctgactttttaacttgatgttaggtcacacatatttttccatattgttttaaatctcccaacacagcctcctttcctaagataataacaggcttttgttgagtagactaaacaaagcctcctaaaggctctgagaataggatttgatagataaaaatcaagaaggaggaaggttccaggcagaaaagtcagcttgcagaaagacaggaggtggagacacctggccatgtttaaaacatggagttgaccagcttgatgagcacgtagcctgtccatagattgagctgcctcttgagtgctgggttctggaagatgcggggtggggctttagggcaaagatgaattaggaaactacattagttctggtcagaggcatgagactgtgtgaggctggcacaggaggcatggatagagtgggaatgaagaatctactgaccttgacaatggattatatagggggtggatggaatcaaagaagaacattacagttagagtctatgaaaagctatggcacctttaacagaaataggaacacttagaggcgtgctagaagagggacactggggctgggtgcagtggcatgcacttgtagttctagctactcaggaggctgaagtgggagaatcgctcgagcccaggagttcaaggctgcagtgagctaggattgcatcactgtactccagcctgggtgacagagcaagaccccaactcagaaaaaaaggacattgggaattgagtttgggacatgctggcttgagggggcagggcctccgaatggcaggctgttagggaaatgagtctggaactcagatcaaaggcatggcttgagacgaaagatgtttgaactcagtcatacaaaagtcatgattgaagctacagaaacaagcatattttctgaggaagagtgtaggccaggtgcagtggctctcagctgtaatcccagcactttgggaggccgagacgggaggatcacttgaggtcaggagttcgaggctgcagtgagccatgattgtgccactgcattccaacctgggtgacacagggagatgctgtctcttaaaaaatacagaaaatcataagagaaaacaaattttctacttattaagtggaagtgggtgatcatcaaggtcttcatcctcattgtgttcatgctgagtaagtggaggaggagaggggagaggaaggttttgctgtgtcaagggtggcagtggaggaaaatccgtacataagtggccccgcacagttcaaacctgtattgctcaagggtcaactgtatttcagacagcacccacgaggaatcatctggaaaatgtaagtggccagacagtgcgttccccagaggctgctgcatggagtgtgtgtacacgcgggttctggatgtttccatctagcgctcttcacaaaagcacagcggataaaacaataaaagcagggcttttgagaatctggaatacagatttttggtaactcccaagcggccctgcctttgtctctctccacagctcctttggcccatacccccctcccctgattcccccatcactgagagaacatggggcagagcacatgaaaaccgtaatacctccctgtaagccaggggctgccctcaaagctccacaggcattatttccctcgcccactccatggcctcaagagactgacacggaacacctccagccctagacaggaggaagcagcggggcttgcttggttaggtgactggctgaaggttgcatgcaaatttcagtttcctgattctgacctacaccaagggctttacaacaggttccaggaagagaagaaacactcccatgttgaatgcacagtgttccatagtgcaagatgatcccgaccgtggaaacatgaaaacatgaagcaaagagtgtgtcatagaattgaaggataggcacttagtgggagcccggcatggcattttgaggctggggatgtgggagggtggggctgcccctctcatgcccacagtctggtggggaagaggttggaggtgcggagggaacagcagggcctgtgacatgagagagtgaggggccttgctcagcgatcagggcctggaaaagaatctgtccatggcaaatcattaacgtttctgtttgaaaagctctgagtgtatcatgacacatgaggtcgaatccctaagacttcacagcgctctccatcatcacacagctcttggggggtggggggcactgttcccatcccactgcagccatgctggggtggcgggtcccctcctgcatgtccgactcgctcatctctccgatgcaagtactttgtccctcctccagggcacacacgttccttactgtggcaccttcctgccccctgagctgcttgggggcccgggctgcctcatcttcatcccactctctcagcacgagcctgatgagcagccagcccccagcacagggctgtgcagggagaagcctgcagtcctttccgcctccccagaaagttgtttaattcccctgtgacgggtcgttttcccactagccaggggaagatctagcagctactgtgcttagagcattcataggaaataaaagggcagcccttgatagctgacgtcatgctttttggactgactccttccttcttccctccctccctcttaaaccttcttcgtggagaccctgccacctacagtgtggatggagagagtggaaatggagagtctcattttccacgggactttctgtctagggagacgcaggcattgatcagatggtcacccgtctgttttgttataaactgtgataagtctgtgaagttaaaatatgagggaccaggagagcagatgtcagagaaacctgactgcctgtgtacccatggtgtgtgtgcgtgtgaggaggtacagggagggtcaggggtgtgtttgctgcagtgctgtttgagctaagatctagaggatgagcaggagccgggtagacaaagttctttggtagaactgggttctgaaagttatgtgagagatttttgccagtgggtaaattattaattacaagacataaaatgccattcggattagcctgagtaagtggggggttgttatgtcacactggaatctgagggcaggaaataaaactgcagctgggcatggacctgggtgggctggaaccaaggtctctttgggccatatcccctgcccctctctgtctctttttctctgtctgcctctttctctctctaccccctccctctccctacccaccgacttatcatcagtggcatgtctagagctgggactagaatcccagtttccatgtcctagtctttccatagattttacacaggtcacttaggaagtgtgtagctctgagaaactacaggttaaaaatggccagtgaagtagagttttgcatctgttgatccttgggtagttgctgtggcagttttttgtttttgtttttgttttttttgagacttgagcctcgctctgtgccccaggctggagtgcagtggcgcgatctcggctcactgcaacctccacctcccggttcaagtgattctcctgcctcagcctcccgagtagctgggattacaagtgcgtgccaccacacccagctaatttttgtatctttagtagagacggggtttcaccatgttggccaggctggtcttgaactcctgacctcaagctatccacctgccttggcctcccaaaggaccgagattacaggggtgagccactgcacccggcctgtggcagatttttaatcacataagtgagcgctctctggactccacatcaataatgacttttgggggtaaaatgcattatacaaattcattatctcacctaatccccacaaaagacctatacataaggtaggtattatgtagtcttattttcaagtgatggaaccaaggctcaagaggttgcattttgtctaagttaattctaacaatgtggagttgtcagaatgcctataaaacgccatcccgagctgtgctctccactcttcgctgtgagtagggagcgctcagcgagtgtccacgccagccaacgagtgtgagctctcagtcctcacaacatcccacagatggggaaagtggggttcagagaggtaaaggaccatccagaggcataatttggggtcagtttgtaatttgaatctgggaacgtctattgccagagtccaagctcttaaatgtcacctttggtgtgtctgcttctagcagttcaccaaaacacatctcagtgtccttctagactgacctgggatgtgcagctgacaagttgctctcatgccttccaggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaaggtaggtggaaatgtggtcaagatccctcccatgaaacgtgttctaaaaagagtttcctggtttgcaaaagtacattttgatgaattttagacttgattttgccttgactttctccgttttattgtctcccacacaggggctactcgaggtttttttttttttttttttttttttttttttttttgagacggagtctcactctgtctcccaggctggagtgcagtggggtgatctcggctcactgcaagctccgcctcccaggttcacgccattctcctgcctcagcctcctgagtagctgggactacaggcacccaccactacgcctggctaattttttgtatttttagtagagacggggtttcactgtgttagccaggatggtctcaatctcctgaccttgtgatccacctgcctcggcctcccaaagtactgggattacaggtgtgagccaccgcgcccgcactactcaaggcttttaacaacagaactgtggtttttaataggaagggttgaatcataggttgtcagaataccactgagctcacccctatggcacacaagctaacaaagcactactggcaaaagaaaataatatcttaggtttagttaatgactgtctaatacagtactcaaaagtcagttttagttttttggtcatgttaactatccattttgagccaggggtcttttaactgtctttggaaattgatagcttcataacgtggggcacaaatcactgatttccaggtaattccgagtccaaagtcacattagggctcctgtattcccggcctcaaagattccagacagagccgtcctgagctctgccccagccattgtccctctgagattgtttacttgcctccttgagccagaggccctggccccgggctcacctgctgcgtgtggaagccaagaagatcctcttggagctgagcagtggccatcagagatttagcaaagcagccatctgactttcttgctcgtacactctaggccacgggaaaatggtgcatattttaaccctgttaaaggcatctccaaaccaagtcccagggtccatatgaagacacttgaaattgtaggaagaaggagtgtgaaaaggactctgatggaagacccaacaagatcacagtgctctgagatcccaaagggctttaccagactgatagcaggtgggggctggggaaggggctggtgtcttggacctggagtgtcccataccttctgctccctcttttccagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggtcagtgggggcgctgaggaggtgtcacctgaccagggactcttggtatcctcgaggcattggttccaggaccccagaaaataccaaaatctggatgctcaagtccctgatataaaatggtgtagtatctgcatataacctacacgcatccttctgtatactttaaattaatctctagatgatttacaataccaaatacaacacaaatgctatgtaaacagttgttatactacattgtttgaaaatttctatttttaattgttattagtattttttattttcaaatatttttgatccgtggatggttgagtctgcagatgtggaacccgctgatatggagggccgactgtttgcatttcagtggttcacatgggagacaagtccatggtccttgtttctgctggtgaatgactgagtgaccttgagaggtcacttccctgtgtggcatctgaactcatctgtcagatgggatcacagcacctgccttgttcccttttgagaaaaccaggagattacatatttgtgtgtatgtatccacatacatgtgtacacacatactttgcactccattctccctcttagggcttttattaagcagtacttaatttttttttttttttttttgagacggagtttcactcttgttgcccaggctggagtgcaatggcgcgacctgcctcccaggttcaagcaattctcctgcgtcagcctccagagtagctgggataacaggcacccactaccatacctggctaattttttgtatttttagtagagatggggtttcaccatgttggccaggctggtctcgaactcctacctcaggtgatccacctgcctcggcctcccaaagtgctaggattacaggcgtaagccactgtgccagccagtacttaatttttttaacatgcttccatataaatgtaagatgatattattaaagggtgacatttgcagatagtaagcaaattgtattcagactttagaaaatacataggactatgaagttatgagaatgtttttgttttttttgtcatcctcagggagtgaattttttttaatggagcacgtacacagcatttgagaaaatctagacaaaagtgactgaggatattaaagttttataaaagctcatggcactagttgttgcaatatgatactctttttaaaaatacattctataaatgtataagttacgagtcataaagcaaatgaacaaaggtagtgaaatgtcatctgccatccatgctcacaaaaactcaaagcaacaatgagaatgaaccaccattcactcatttgacaaacagcattttttttttttcctcatcttgggcactgtgcaaagtgccagggatacaaaaccgaacagactcattccctgccctttgggagctttatggtccactaaggaaaagagacacacagattagccattaacaataaagaaatgtaacttctctattatacatttattagattgattggcaaatgttccttagcttttcttggaaaagtattgaatacctaaccatctataaatcttctaacatctcaatagtgctcaaaccctgagctggatttagacagtggaagaaagaataaaatgatcatgataagctaaacctgtgaggacaaggtaaaattgtgttgtaattagaaaggattaaaaccacatctctgaacccaaaccaacaccacaaacacaggatggcagaaagctgggcaaggcactgctaagggcgtgcactattttgaggaaatcaagtatatgaaaatctaaactttaaacaatgattaattagagacaatcataatacacaaaggatttgattttgtattgtagtaaaatacacataatatttgctattttttttttttttttttgagacggagtctctctctgtcaccaggctggagtgcagccgcacaatcttggctcactgcaacctccgcctcccgggttcaagcgattcttctgcctcagcctcctgagtagctgggaatacaggcaagcgccaccatgccggctaatttttttgtatttttagtagagacgggtttcatcatataggccaggctggtcttgaactcctgacctcatgatccgcccacctcggcctcccaaagtgctgggattataggcgtcagccaccgttggctggccctattttaaccatttttaagtgtacagttcactggtattaagtacactcagtgttgtgcagccatcatcaccatccatctctagaattttttcatcttcctaaactgaaactctgtatccattaaataacaaagatttgggtttaacaaagttacttcagtttttcttcaagtaagaatgcatgggtgctctgcctataaactctatatatggaggagtggccattctttctttactttcctaatcttgctttcacttaaaaacaacaaaaaaaatttatgggtgggtgcagtggcctgtaatcccagcattttgggaggatcacttgaggccagaagtttgagaccagccctggcaacatagcaagacctcatctctacaaaaaataaaaaattaaaattaaaaaataacccaggcatgttggcacacacctgtagtcctagctgcttggagggatcacttgagcccaggagctgaaggctgcagtgaggtgtgatcgcaccactgcactccatcctgggtgacagagcaagaccctgtctcaaacaaacaaacaaacaaaaaatatatatataaaatttataattgcagtggatttaaaatatgacaatctttaaaattcttctatttttatgggatatttatggttatctagatgtgtgttgccaccaaaataatctaggagcaagcaaaacaaatgaccacagttgtatgacttacttgtgcggaatcaaaaaagaacacatgatggagatgtgatatagaggaagtaagagagtgatctttctgaaagaagcatgcgtagttttggtcaccatgctttaagtatgatgttatagagaaggcaaaagggttaagtttaggtgtttgggcctttacgattgcccaaacccaaccatgtgctttcctcaggaaccttctgtctgttctgaagagagaacactgctccaccaagctctctggccatctcactgggcctcataccaaacaccttaggctctgtggattgtttttctagacaagctagcctacagtacgctttaaagggtaaacaacaggatatggtttatgtgaagaaacatttgaaagttgacctctttatcctagggatgagactaagggataatagttgtatgctgctcccaagaatttaggaggaggcaacataaccttctcactattcaattgttgaagaaaatcagcttagatttaagtgagagtgttaatttggacttaagagttttgggggcatgaaatattaaaacatcagaggttagaagtttctgtctttgaatattttgaagaagaagataatcatttatctcatatggtttaaaaaatccgtatctgaggtctagaccattactattatctgatttcaatgtgcatattttaggagaatgtactatactatattttaatactttaaatagaagtattaatatagtatattcggtagtacattctaaaatataggggaatgaattgtactagagtattagaattattctctgttcacattagaaagaaacaatcaaatttatttcctcttcccttggtctgatgactctccctgtctgtttctaacaggcagatttgaagaatcagctgggagatgctggatacgtattatttggagtggtgttatttgtttgggaactcttacctaccaccttagtcgtttatttcttccgagttagaaatcctacaaaggaccttgtaagtaaaccattttacatttgtaagaaaatgtctcctaattctgatcatggaacctgcaattagaactttttcttcatttttcagaagagagcctcttccttttgtggtggtatgaaaagtttccttgactattttattgagacattcatttcccttatcttttgagggaaaatggttttcagcttagttttattttacaaaagaaatgaaactattataagttgcatcttaaggcctggggaaagtgattaactatttcttttaatgcaccattgcctcattagtatttgagacttggacttgctgtgaaccaagtatagaagcttctctcatagcaaaggaaaatagagaatagagaaacagaaataggaaatagagaacactcataggaaatagtatgccggatggcgactagggaatgggaggatagggcaataagagacatcattgtaaggaatgctaaacctgctcccctagtttggtcacattgctgttcaaccaactttatatgaatgtctttatgggacaggacagaaaatgcaaaaccaagtagcgtgagaaaccacctgggagccttgttccgtaaattattccagccacacaaactagtggtagctttttgacttactgatctatgaaacccatagaaaagtacagtgagtggatttggggcaatgtgagcaaagagcgggtggtgaagaaggcatagatgagtaatgtcctccaataattcacagttcttatttcatacccagatgactgacctgtttttttatcttgtttttggaagccgccaggcttcaaaccaagcattctggttccagagtcaatggtggttttttttgtttgtttgctttttggtttttttttcttttgagatgaagtcttgctctgtcacccaagctggagtgtagtggcgcgatctcagctcactgcaacctccgcctcccgggtttaagcgattctcctgcctcagcctcccaagtagctgggaatacagatgcacgccaccatgcctgggtaatttttgtatttttagtagagacagggttttactatgttggccaggctggtctcgaactcctgacctcaggtgatccgaccgcctcagcctcccaaagtgctgggattacaggcgtgggccaccgcacccgtctgagttcatggttttaatccctgtgctacactgtagctttctctggcatcataaggttttgagaagaaattatattcttaatatagatgacctaatagtcctatctataacttctgtaattacatgggaaaaaagtctaatactcttggggggaaatctataactcaaacccttcaactttaaaggaatacactgcaggtggggcatttcttaaaaatgtcatctaacatttgtatccataattcatttggtacaaacaggtctctaaacttggcatgattagagccagacttcagagtctaggtaacgagatactcaaagtgcggctctttaccatctgtatccgaatccctcagggcgcttggtgtaaagattcttaggtcatgttggagacccagaccagaatctctggggtaggttccgggaatgtacatttttaataagcactccaagtgatctgaatgaactgtaaagtttgagaatctctgtccttatccttttcttttttgagacagggtcttgctctgtcacccaggctggagtgcagtggcacgatcacagctcacctcagccttgacctcctgggcttaagcgattctcttgccttagtcttgcatgtagctgggattacttgcatgagccgtgttgcccaggctggtctcaaactcctggctgttttttgtcttttaaaaacagctttattgagatgtaactcacttacataattcacccatttcatgtgtataattgagtggtttgggggatattcacatatgtgcaaccatcaccacagccaattttagaacactttcatcatctcaaaaggaaaccccatactatcatctgtcattccccatttcctttctgtccctgccctacccccaggcataagccactataatctcctgtgtctatagatttccctagtctcgactttcatatgaatggaatcatatggcatgtgggttttttgactggcttctttcacttagcagaatgttttttcaagattcgtctacgttgtaacatatatttgtacttaattcttttttattgccaaataaatatttcattgtatggatagaccacattttgcttacccattcatccattgatggacatcatttttttttattattatactatatattatatataatataatatataataatataaataatatataatatatattatatattatatataatatatataatatataatataaataatatataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggtattgcctaggttttcttctaggatttttatggttttaggtcttacgtttaagtctttaatccatcttgagttaacttttgtataaggtgtaaggaaggggtccagtttcagttttctgcatatggctacccagttttcccaacaccatttattaaataggaaatcttaccccattgcttgtttgtgtcaggtttgtcaaagatcagatggttgtacatgtgtggtattatttctgaggcttctgttctgttccattggtctatatatctgttttggtaccagtaccatgctgttttggtaccagtaccatgctgttttggttactgtagccttgtagcatagtttgaaaggtagcatgatgcctccagctttgttctttttgcttaggattgtcttggctatgtgggcccttctttggttccatatgaagtttaaagtagttttttccaattctgtgaagaaagtcagtggtagcttgatggggatagcattgaatctgtaaattactttgggcagtatggccattttcacaatattgattcttcctatccatgagcatggaatgtttttccatttgtttgtgtcctctcttatttccttgagcagtggtttgtagttctccttggagaggtccttcatatcccttgtaagttgtattcctaggtattttcttcttttagtagcagttgtgaatgggagttcactcatgatttggctctctgttattggtgtataggaatgcttgtgatttttgcacattgattttgtatcctgagactttgctgaagttgtttatcagcttaaggagattttgggctgagacaatggggttttctaaatatatgatcatgtcatctgcaaaaagagacaattgacttcctcttttcctatttgaatatgctttctttctttctcttggctgattgccctggccagaacttccaatactatgttgaataggagtggtgagagagggcatccttgccttgtgcgggttttcaaagggaatgcttcctgtttttacccattcagtatggtattggctgtgggtttgtcataaatagctattattttgagatacattccattgatacctagtttatggagagtttttaccatgaacgggtgttgaattttgtcgaaggtcttttctgcatctattgagatcatcatgtagtttttgtcattggttctgtttatgtgatggattacgtttattgatttgtatatgtcgaaccagccttctatcccagatatgaagctgacttgatcgtggtggataagctttttaatgtgctgctggattcggtttgccagtactttattgaggattttcacattgatgttcatcagagatattggtctgaaattttctttttgttgttgtgtctctgccaggttttggtattaggatgatgctggcctcataaaatgagtcagggaggattccctctttttctgttgtttagagtagtttcagaaggaatggtaccagctcctctttgtacctctggtagaatttggctgtgaatctttctggtcctggactttttttggttggtaggttattaattactgcctcaatttcagaacttgttattggtctattcagggattctacttctcctggtttagacttgggagggtgtatgtgtccaggaatttatccatttcctctagatcttctagtttatttgcatagatgtgtttatagtattctttgatggtagtttgtatttctgtgggattggtggtgatatcccctttatcattttttattgcgtctatttgattattctctcttttcttctttattagtctggctagcggtttatccattttgttgatcttttcaaaaaaaccagctcctggattcattgattttttttgaagggtttttcgtgtctctatctccttcagctctgctctgatcttagttatttcttctgctagcttttgaatttgtttgctcttgcttcccaagttcttttaattgtgatgttagggtgtcaattttagatctttcctgctttctctcgtgggcattttgtgctgtaaatttccctctacacactgctttaaatgtgtcccagagattctggtacattatgtctttttctcattggtttcaaagaagatctttatttctgccttaattttctaacttacccagtagtcattcaggagcaggttattcagtttccattggttgtgcagttttgagtgagtttcttaatcctgagttctaatttgattgcactgtggtctgagagactgttatgatttccgttcttttgcatttgctgagcagtgttttacttccaattatgtggtcaattttagaataaatgagatgacgtgctgagaagaatgtatactctgttaatttggggtggagagttctgtagatgtctgctaggtccgcttggtctagagctgagttcaagtccctgaatatccatgttaattatatgtctcatttatctgtctaatattgacagtgggttgttaaagtctcccattattgttgtgtgggggtctaagtgtctttgtaggtctgtaagaacttgctttatgaatctgggtgctcctgtattgggtgcatatatatttaggatagttagctgttcttgttgcattgatccctttaccattatgtaatggcctttttttgtctcttttgatctttgttggtttaaagtctgttttatcagagattaggactgcaactcctgcttcttcttcgtttttttttttttttgctttccatttgcttggtaaatattcctccgtccctttattttgagcctatgtatgtcttttcacgtgagatgggtctcctgaatacagcatagggatgggtcttgactctttatccaatttgccagtctgtgtcttttaatgggggcatttagcccatttacatttaaggttaatattgttatgtgtgaatttgatcctgacattatgatgttagctgattattttgcccattagttgatgcagcttctttatagtgttgacgggctttacaatttgatatgtttttgcagtggctggtactggttgttcctttccatatttagtgcttccttcaggaggtcttgtaaggcaggcctggtggtgacaaagtctctcagcatttgcttgtctataatggattttatttctcctttacttatgaagcttagtttggctggatatgaaattctgggttgaaaatttttttctttaagaatgttgaatattggcccccactctcttttggcttgtagggtttctgcagagacagctgctctttgtctgatgggcttccctttgtgggtaacccgacctttctgtctagctgcccttaacattttttccttcatttcaacctaggtgaatctgacgattatgtgtctgacgattatgtgtcttgcccttcttaaggagtatctttgtggtgttctctgtatttcctgaatttgaatgttggcctgtcttgctaggttggagaagttctcctggataatatcctgaagagtgttttccaacttggttccattctccccatcactttcaggtacaccaatcaaatgtagatttggtcttttcacatagttccatgtttcttggaggctttgttcattcctttttattcttttttctctaatcttgtcttcttgctttgtatcattaagttgatcttcaatctcatatcctttcttccacttgatcgatttggctcttgatacttgtgtatgcttcacgaagttcttgtgctatgtttttcagctccatcaggtcatttatattctcctctaaagtggttattctaggtagcaattcatctaaccttttttcaaggttcttagcttccttgcattgggttagaacatgcttctttagctcggaggagtttattattacccaccttctgaagcgtacttctgtcagttcatcaaactcattctctgtccagttttgttcccttgctggcgaggagttgtgatcctttggaggagaagtggcattctggtttttggaattttcagcctttttgtgctggtttctccctatctttgtggatttatctacctttggtctttgatgttggtgaccttcggatggggtctctgagtggacatgctcttcctttctgtttgttagttttccttctaacagtcggacccctctgctgcaggtctgctggagtttgcaggaggtccactccagaccctgtttgcctgggtatcaccagcggaggctgcagaacagcaaagattgctgcctgttctttcctctggaagctttgtcccagaggggcacctgccagatgccagccagagctctcctgtatgaggtgtctgtcagcccctactgggaggtatctcccagtcaggatacatgggggtcatcgacccactgaaggcggcagtctgacccttagcagagcctgaacgctgtgctgagagatctccttctctcttcagagccatcaggcaggcacatttaagtctgctgaagctgtgcccacagctgccccttcccccaagtgctctgtcccagggagatgggggttttatctataagtccctgactggggctgctgcctttttttcagagatgccctgcccagagaggagaaatctggcagtctggccacagtggccttgctgagctgccatgggctctgcccagtttgaacttcccagcggctttgtttacactgtgagggtaaaaccacctactcaagcctcagcaatggcggatgtccctccccacaccaagcttgagtgtcccaggtcgacctcagactgcttctgtgctggcagcgaggatttcaaaccagtggatcttagtttgctgggctccgttggggtgggacctaccgagccagactacttggctccctggcttcagccccctttccaggggagtgaatggttctgtctcactggcgttccagatgccactggggtatggggaaaaaaaaaaaaacaaaaaacctcctgcagctggttcagtgtctgcccaaatggccgcccagttttgtgcttgaaacctagggccctggagaggtaggcaccagagggaatctcctggtctgcgggttgtgaagactgtcggaaaagggcagtatctgggccggagtgcacagttcctcaggttcagtccctcatggcttcccttgggtaggggagaaaattccctgactccttgcacttctcgatcgaggcgacaccccaccctgcttcggctcaccctccgtgagctgcacccaccgtccaagcagtcccagtgagaagaaccaggtacctcagttggaaatgcagaaatcacccaccttctgtgtcgatctcgctgggagctgcagactggagctgttcctattcggccatctaataggtgatatgtttttatcgctgtatgacatcactggttttaaggaattttaagtttttcttaaatgtttcctttttatcatttcatttcaagctttttttgtttgtttgtttggatacagagtctggctctgtcacccaggctggagtggagtggggtgatctcagctcactgcaacctctgcctcctgggttcaagcgattcccctgcctcagactcccaaatagctgggattacaggtgcctgctaccacgcctggctaatttttgtatttttagtagagatggggtttcattatgttggccaggctggtcttgaactcctgaactcaggcgatccacctgccttggcctcccaaagtgctgggattacaggtgtgagccactgtgcctggactataatttcaaacttcttgacccacatcaagaagtttgaaatgataaaaaggacacatttaaggaaaccatttgtggatatgagtggacatttgggtcatttccaccatttggctatgatgaataaggctgttataaacatttgtgtataagtttctgtgtgaacatatgttttcatttctctcgggtatattcttaggagtggaattgctgggtcatatggtatttctgagtgtcactttctgaaaaactgccagactattttccacagagacagcaccattttacattctcaccagcagtgtatgaaggttctgattcctccacgctcctagcacttgttatctgactttttgattctagatatcataatgtgtattaaatgatatctccttttggcttctgatgtatatttctctgatgactaagtttgtcgaggatctttttgtgtgcttagtggtcatttgtatatcctctttggagaaatgtctgttcacatcctttgtccatttttaaactgggttgtctttttattattgaattgtaagagttctttatatgttttaaatatactcttaagtcccttgtcaggtatatgatttgcacatattttctctcattctgtagctgtcttttcactttcttgattggtatcctttgaagcacaaaagcttttacttttgtccactgtatttatcttttgttgctcgtgttctggtgtcatacccaagaaccctttgccacatcgtatactgatggtccctgatttacaacagttcaacttacaatttttcaactttacagatggtgtgaaagcaggacacattcagtagaaactataattgaaattttgaattttttaatcttttcctaggctaacaatatggggtatgataatctctcaagatgtatagagcagtgaggcacagctctcagtcagccatgcgatcataggggtcaacaactgatactctatggtgtgtattttttatttgttttcaacttacaatgagtttatcagaatgtaacctcatcataatttgagaagcatctgtatttgcccctgaaaacttgcccctatatttttttctaagagttttgtagtttttgttcttacatttggtctttaatacattttgagttattttttgtatatggtgtgagataaggatccaacttcattcttttgcgcgtggctcataggtattcttaaactattaaaaagagtaaattttaaggcaatccaccttgtgttagttccactttgctccttatgtttggctgcaattagtcttagcaaagcaggaattcacatttagatagccgtcatgtggccacctctgttcatgttctattaacttttaaataggtcactgatgttaagaacaatgatgtcaaaacatatgcctgatttggtgtaccatataatctagttctgatcttgtttaggctttcctgacaaagacaactttactttttagaagctgctggcagaaaaggcttttcaaaccccaacagtcatcccagggcagctgtgatactgaaaactggcaatgacctctagggtgtacctgagaccagtcattggaaattttttaagaggtaaactcagtttgggggcagaaacaggatgaaatgattatagaggcaggagatggaaatgggatgagaaatcctccccaaatgatttcaccattgttatgactgctctcatgatttatatccaaattgaactatctactttattctggctaatttgggcatcatctagcttttaaaaatttttttgtaggtacatagataataggtgtgtatatttatggggtacatgagatgttttgatacaggcatgatgattatttcacatcatggagaatggtgtctccatcccaagcatttatcctttgttttacaaacaatccaatcacactcttttagttattttaaaatgtacagttattattgactatatagtccaccctgttgttagtgctatcaaatagtaagtcttattcattcactaaaattctttttttttttttccccattaaccatactctccccccgccactacccttcccagcctctggcaaccatccttctcctctctgtgtccatgagttcaattgtttgagtttagatcccacaaataagtgagaacatgcgatgtttgtctgtgtctggcttatttcacttaacataatcatctccagttcatccatgttgttccaaattactggatttcattcttttttatggctgagtggtaccccattctgtatatgttccacattttctttatccattcatctgctgatgaacacttaggttgcttccaaagcttagctattgtgaacagtgctgcaacaaacacaggattgcagatatctcttcaatatcctgatttcccttcttttgggtagataccagcagtgggattgctggatcatgtggtagctcaatttttatttttgaggaactgccaaactgttctccatagtggttgtactaatatacattctcaccaacagtgttcaagggttcccttttctccacatccttgccagcgtttgttactgccttttagatataagcgattataactgcagtgaggtaatatctcactgtagttttgatttgcatttctctgatgatcattgatgaacactttttgatatgcctgtttgccatctgtatgtcgcctttcgagaaatgtctgttcaaatcttttgcccatttttaattttgattactacaccttttcctaatattctggttgttaatcccttgtcagatgggtagtttgcaaatattttctcccattctgtgggttgtcttgactttgttgttttactgtgcaaaagcttttaacttgatatgatcctatttttccattttgctttggttgcttgtaggatattgctcatgaattcatttatttttatttttatttatttttgagatggagtcttgctctgttgcccaggctggagtacagtagcatgatcttggcttactgcaatctctgctttctgggttcaagtgattctcctgcgtcagcctcccgagtagctgggactacaggcatgagctaccacacccagctaatttttgtatttttggtatagatgggtcttcaccgtgttggccagcctggtctcgaactcctgacctcaagtcatccacctgcctcagcctcccaaagtgctgggattacaggcatgagccactgtgcgtggccaagaattattattattttttaattttagtcttaatttcaaaagtttttggggaataggtagtgtttggtcacatggaaaagttgtttagtggtgactgctgagattttggtgcacccattaccttagcattgtacactgtacccaatgtgtagtcttttatccctcaccctcttccacccttcccccaggtccccaattccattatattgctcttatccctttgcatcttcatagctcagctcctgcttataagtgagaagatataatgtttggttttccattcctgagagttatttcacttagaataatggtctccaactccatccaggttgttgtggatgctatttcattcctttttatggctgagtagtagtccatggtatatatataccatttttctttatccactagttggttgatgggcatttaggctggttccatatttttgtattttgggaactgtggattgtgtggctataaacatgcctgcacaagtgtctttttcatataatgactcctttacctctgggtagatacccagtaagtgggattcccaccagcagtataaaagtgttcttttttactacatccatgccaacatctgttatttttttatttctgaattatggtcattcttgcaggagtaaggtatggggcatctcattgtggttttggtttgcattcctctgagaattagtgatgttgaggattttttcatgtttgttggccatatggatatcttcttttgagaattgtctattcatgtccttagcccacttttggatgggattagttgtttttttttcttgctgatatgtttgagttcttgaagattttggatattagtccattgctggatgcatagtctgtgaatattttctcctactctatgacttgtctgtttactctgctgattatttcctttgctgtacagaagactttttgtttaattaggtcccatgtatttatcttagtttttgttttatttgcttttggattcttggtcatgatctctttgcctaagacaatgtctagaagagtttttctgatttatcttctagaatttttctggtttcaggtcttagatttaagtctttgatccatcttgagttgatttttgtatacggtgagagatgaggatccagcttcattgttctacatgtggcttgccaattatcccagcaccatttgttgaacagggtgtcctttccccactttatgtttttatttgtgttgttgaagatcagttgtctgtacatatttggccttatttctgggttctctattctgttccattggtgtacctgcctcactctgtcacccaggttggagcacagtggcacaatcccggctcattggaacctccgcctcccaggttcaagtgattctcctgcctcagcctcctgagtaggtgggattacaggcatctaccgccatgcgcagctaatttttgtatttttagtagagacgaggtttcactatgttgaccaggctggtcttgaactcctgacctcaagtgatccacccgcctcggcctcccaaagtgctgggatttcaggcttgagccactgcatccggccctgcctgcctattcttatacgagtactatgctgttttggtaactatagccttgtaatatagttggaagctgggtaatgtgatacctccagatttgttctttttgcttagtcttgctttggctatgcacgatcttttttggttccatacgaattttagaattttttctatttctgtgaagaatgatgacctttttgtttttttgagacagagtcttgctctgtcgtccaggctggagtgcagtggtgtgatattggctcactgcaatctgtgcctcccaggttcaagtaattcttgtgcctcagcctccaaagtagctgtgattacaggtatgcaccaccacacctggctaacttttgcattttttagtagagacagggttttgccatgttgtccaggctggtctcgaactactgacctgaagtgatctacctgcctggcctcccaaagtgctgggattacaggtgtgagccactgtatccagcctgatgatggtatcttgatgggaattgcattgaatttgtagattgcttttggcagtatggtcactttcataatattgattctacccatctgtgagcatgggggatgtgtttccatttgtttctgtcatctgtgatttcttttagcagtgttttgtagctttccttgtagagagctttcacctccttggttaggtatattcctaagtattttgtttttgcagctgttgtaaaaggggctgagttccttatttgattctcagcttggtcgttgttggtgatcagttttaggagcttttaggataagtctttagggttttctaggtatgcgattatgtcattggtgaacagtgacagtttgacttactctttactggtttgggtgccctcttgctgttgtctgattgctctggctaaggacttccagtactatgttgaatagaagtggtgaaagagggtttccttgtcttgttccatttctcaggtggaatgctttcaacttttcctgattcagtataatgttggctgtgggtttgtcatagatggcttttattatcttgatgtatgtcccttctatgccagtttttctgagggctttagtcctaaacagatgctggattttttcaaatgctttttctgcatccattgagataatcatatgatttttgtttttaattctgtttatgtgatatagcccatttattgactcatgtatgttaaaccatccctgcatccctggtatgaaacccacttgatcatggtggattatctttttgatatgctgttggattcagttagctattaatattttgttgaggatttttacatctatgttcatcagggataaacatagttttgctatgtcctttcctggttttggtattagggtgatactggtttcatagaatgatttagggaggattccctctttcactatcttttggaacggtttcagaataagattggtaccaattcttctttgaatatctgatagaaattagctgtgaatccacctggtcctggactttttttgttgttggaaatgtttttattgctgtttcgatctcgctagttgttatgttcagtttctatttcttcctaatttaatctaggagggttgtatattttgattttctagtttctgtaaaggtgttcgtagtaaccttgaatgatcttttgtatttctgtggtatcggttgtaatatctcccattttgtttctaattgagcttatttggatcttctgtcttcttggttaatctcactaatggtctatcaattttgtttatcttttcaaagaatcagctttttgtttcatttatcttttgtattgcctttttgtttcaatttcattagttctgctctgatctttgttatttcttttcttctgctgggtttgggtttggtttgttcttgtttctctaattccttgaggtaggaccttagattttctatttgtgctcttccagacttttttgatgtaggaatttaatgctgtcaactttcctctcagccccacttttgctgtgcctcagaggtttgggtaagttgtgtcattattatcattcagttctaagaatttaatttccatcttgatttcattgttgacccaaagatcattcaggagcacattaatttccatgcatttatatagttttgagggttccttttggagttaatctccaattttatattccactgtggtctgagagagtacttgatataatctcaattttcttaaattgatttagactcatttcatagcctatcatatggtctatcttggagaatgttctatgtgccaatgaaaagaatgtatattctgcagttgttgggtagaatgttctgtaagtatctgttaagtccgtttgttctagggtataatttaagtccattgtttctttgttaactttctgtcttgatggcttgtctagtgctgtcagtggagtactgaagtaccccactatggtgttgctatctcatttcttaatgtctaataataattgttttataaatttgggggctcccatattaggtgcatatatatttaggattgtgatattttcctgttggactgatccttttattaataaataatgtctctctttgtcttaactgttgatgctttaaagtctattttgtctgataaaagaatagctactcctgcttactttttgttttcatttgcatggaatatctttttccacccctttaccttaagtttatgtgagtacttatgcattagttgagtctcttgaagacagcagatacttgatttgtggatttttacctagtctgccattctgtatcttttaaatggagcatttaggccatttacacccaacattagtattgagatgtgagactgttttattcatcatgccagttgttgcctgaatacttttttttttttcattgttttataggcctggtgagatttatgctttaaggaggttctattctggtgtattttgaggttttgtttcaagaattagaactccttttagcatttcttgtagtgctggcttggtagtggcaaattcttagcatttggttgtctgaagactttgtatcttttccttcatttatgaagctttgttttgctggatacagaattcttggctgacaattattttgtttgaagaggctaaagataggaccccaatcccttctggcttatagggtttctcctgagaaatcttctgttaaacagcttttaaaattctttcctttgtcttgactttagataacctgactgtgcctgatcatctttttgcaattattttcccaggtgttctttgagcttcttgtatttggatgtctagatctctagtgaggccagggaagttttccttgattattccctcaaatatgttttccaaactttagatttctcttcatcttcaggaacaccaattattcttatgtttggccatttgacataatcacaaatttattggaggctctgttcattttgtaaattcttttttgtctttgtggattgggtaattgccttgtcttcaagttctgaagtcctttcttttctacttgattctgttgttgaaactttacagtgaattttttatcctccaagtgcgtctttcatttccagaagttgtgacagttttttattatatctgtttctctggagacattttcatccatatctgtattttaaaaaagattacttaagttggttttcacctttctctggtatctctttgagtagcttaataatcaaccttcttaattatttatctggcaattcaggtatttcttcttggtttggatccattgctggagagctggcatgagccttgttatagaaccttgttttgtcatattaccagaactgcttttctgattccttctcatgtgggtagactatttcactggaaaaatctggaactcaaagctgctggtcagattcttttgtctgggtggttccttgatgtgggttgcttccccttctcctagtgatggggcttcctgtgagccagactgcagtgattgttattgctcttcttggtctagtcacccagcagggctaccgggctttggactggtgatggggaatgtctgcaaagagtcctgtgatgcaattcatcttcagatctcccagctatagataccagcacctgctcctgtggaggtggcaggggattgaagtagactctgtgaaagaccttggttgtaagtatgtttagtatgctggctttcttaagtgctttatgctagcaatgaagttgccaccatggacagactcaggaccactgtttagccaggatgttggaggcagtagaattagctgttgttttctccttccttggagcaggggatctgtcatgagttgctgtaatgtcctgaggtggttggcctccagccaggaggtggcactttcaagagagcaccagagtttttcacctgtctctcagaatttgcagtggcctgccgcttctttccaagtgtctgtgaattccttcagttttcctggtatgctcctgtggtggttcctggagcaaaagtccatggtgtgactctccacacactgttctgtctgtccaagtgggagctgcatgtaagccctatctcctatccaccatcttcccctcaaagtatttatatgtaaatagaatagatgaacagaatctagatccagatgcaaatctgaaatccattccctgcctgttgaactttcacttcttcaggaaacaaattctctgctctttagccccaaacctctgccatgatggcagtgcccatagggacactctcaagaaatttttgcccagacccatgtcttggcgatattccccaatgttttcttgtagtagtttcacagtttgaggtcttaggtttaagtctttaatccattttatttgatttttgtatctggtgagagatagtggtctagtttcattcttctgcatatggatatctagttttcccagcaccatttattgaagtcttttccccagtgtatgttcttggcagtttgttgaaaatgagttcactgtaggtgtgtggatttgtttctggggtctctattctgttctagtggtctatgtgtctgtttcttttctttctttcttttttgttttgagacagagtcttgctctgtcgcccaggctggagtgcaatggcgtgatctcggctcactgcaagctccgcctcccaggttcacgccattctcctgtctcagcctcccgagtagctgggactacgggcacccaccatttcgcccggctaattttttgtatttttagtagagatggggtttcactgtgttagccaggatggtcttgatctcctgacctcatgatctgcctgcctcagcctcccaaagtgctgggattacaggtgtgagccaccatgcctggccctatgtgtctgttcctataccagtaccatgctgttttagttactataactctgtagtgtaatttgaagtcaggtcatgttgattctcccagttttgttctgcttaaaatagctttggctattctgggtcttttgtggttctgtataaattttaggattgttttttctatttctgtgaagagtatcattggtattttgatggggattgcattgaatctgtagattgctttgggtagtatggccattttaacaatattgattcctccaatccatgaacagaaaatatttttccattttttggtgtcctcttcagtttctttaaatgttttatagttttcattatagagctctttcacttctttgtttaatttctaggtatttgtggctattataagtgggattactttttgtttctttttcagattgttcactcttggtatatagaaatgctactgattttttgtgcaactttactgaatttattagttctcatactttttgtggagtcattaatttgactttttctattccaatttggatgccctttctcttgtctgattgctctagctaggacttccagtactatgtttaataacagtggtgactgtgtgttccacatcttagaggaaaggcttgtagttttcccctattcagtatgatactagctatgggtctgtcatatatggcttgtattatgttgaggtatgtttcttctttccccggtttgagggtttttatcatgaaggaacactgaattttatcaagtgcttttttagcatcaattgagatgatcatatggtttttatctttcattctgttaacatgatgtgtcacatttatttgtgttatgttgagccatccttgtatcacatggataaatcccacttagtcatgatgaataatctttccaatgtattgttgaatttggtttactagtattttgttgaagatttttgcatcaatatttatcagagatattggcctacagttttatgtgtctttggttttagtatcagggtaatactggcctcctccatgagtgtagaagtactccctcttcctctattttttttggattagtttgagtatgactgacattagttcttctttaaatgtttggtagaattctgcagtgaagccattgggtcccaggcttttctttactgggagactttttattatggctttgatctcttgccttttttctccttgttactaacagtgaaagtctttagaaaaccttaagagagctctgaaaagaacccttgttttagggacagaagaactgaagaaaagctgggagaaaacattgctttctcagtggattagggagcagagaaattctagttaggtagaataaaagacttgttattggtctgttcgggttttagtctttccggtttagtcttagtaggctgtatgtgtcttggaatttgcccatttcttctagattttacagtttattggcatatagttactcatcatctagcttttcaataagggattaaaacaatgatgactcactgttgcaagcaagactctgatagaagattttgcccatactgataaaaggcaaggcgaatccctctcaaacataagagtaactgaaatgaatattccagctgaacagatatagcctacattcaaatgaatagaacatctttagtctcctacaagaaagagatcttatttttgtctggtgcaaggcatgatgtcttgtaagtatgctgaatgattacctgtctttctagaccaaccctggaatggtccccagccatggattcagtcccagatcttatttctttgacaaccctcgaagatatgacagtgatgatgaccttgcctggaacattgcccctcagggacttcagggagggtaagaccctacttcatgttagacaagcctcatcaggagggaagggttacaccagttaaatagattcaagctaaaagaaaattcctacgttaaaactgtgcagccttaggtggtataagactggattctcagtagatcattttacttatgtgaaacactcaggaatgagaaaggacatccggtttttttaaagccccatagcattattgtatacagtagtgtttcctaaacaatattccatgaaacactattttcttaatagttatgctgtgcaaaaggaaatgataatcaacttttttatttcttggagatagggtctcactctgttgcccggctggagtgcagagtggtgcaatcttggctcactgcaacctcccgctcccaggttcaagtaattcttgtgcctcaggctcctgagtagctgggattaccggtgtgcgccaccgcacccagcaaatttttttatttttagtagagacggggttttgccacgttggccaggctggattgaactcctggcctcaagtgatctgcccaccttggcctcccaaagtgctgggattacaggcgtgagccactgcacccggccagaaaaaaaactttttagaaaatgccgagcgagcctgtaatatgctaatgtgtgctctgaatctccaagagggaaatacagcacttgtctatggaatcactcaatggaacatgatatctttaatcacatgttctaaagctagagagtaaatgcagtagtatttatttattagaataaattatacattataaaggaccaagttttcaaatttgaatgatgtcagttcttaatttaaaatttcatttacatgaagggtatttatttggtctcaattttcatgaatacttatttaataaatacttctatagcatctactctgtatcagacactgttctaagagattcacaaatatcaactcatttagtcttaacagtcctgagaggtcagtactattattagcctcataatacagatgaaactgaggtatctagagggtaggtaacttgtccaaggtcacacagctagcaagtgatcaggctacaattctaactcaggcagttttgttcaaatttgttttctgaatcaccatactatgtaaacagtttgtatataagtaccctgtctcttagtctcacctacgcttatgttatactttcacgtgagttttaatagcaggagtctccttccttgaatctacatgcggatctggcccagaaaatgtggaaagggcagttaaatactgagagttcaaagcagcatacatagagggtgtaagacaatacatgaactaccagtccgctgccatcgcctaatcttcagtgaattgggaaggcaaataaaaagagggaagcacctgaaattgcaaccatagcagagatccaccccaggattccaagttttgcttacctcagcatgggcatggtctgcaaacaggaagggtagttgctattgggattcccttcccttttcctcagcctgctgtgctcagccatactccactacccgatgactatcatgtttcccctttcagcctgtggctctgagacggtgaggccagcaggggtgagaggagccaaaagggctgacatagtgcctgccaagcctgtcttctctctgcttgtcctctcaggacccccatcctgttcctgggaaaggggagcttcttagaaagtgaaaggttatcttatgtaatcttttgtaagattaaagacttagcattaacaactttacaacttttttccctctgggatgaaatgataaaaaatatatgcttgcctttttactccttgttagtaacagtgaaagtctttagaaaactttttaagagagctctgaaaagagtccttgttttagggacagaagtactgaagaaaagctgggagaatacatgctttctcagtgatcggggagcagagaaatcctggtcagataggataaaagattgtcgctgagaaaaaagaagaaagctgcccaatgcgctgagccagcagatgtaaagaacgtaagctggaagcaagccaacaaacaagaaggacttcttgaagtcaaaagctgtcctttgggtcactcagattctgagctccacctcttccttaaaactgttcttttccagttaccccactgcatctcctattagttgctttcccctttaaacccatattctgctagagctgtcccaccctctcacctgccagaaatgacttagagctgagggagtcctcactaccgatatggtgaagacaagaccccctttctactacatagaggaacataattataatgaaaacgacttacgtgtattgagaattaactatatattagacactgttctaagcactttacagatgttaactcagtccccacaataggcccacgacgtagttactaatattactcccattctaagatgaggaaattgaggcatagaagttacttgtccaaagacaccaccacaggttgtgagctgtactccatgttaggattcagatgcagtttgttgctgaaaacatttcctatgcatagtgactggctgggttctctagtcatgctgtatactctgtgctctaaagagttcagtagagttgtcggtgggcatttcagccctgtgtgtagcatggttttgtgggaaaatggactttaagagccatttaaaagaactttagagttatctatagtttacacaaaaatctcagctctgtctacctaaactagactatgtcatacatactatataatgtttcaagtcactgaaatatttttttctttttaagttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcacagattctgcatagttttttttcagcctaatgaaatctaatatgcattacctcagggccacatcaagaatacacccctttccgaactcactgaatgttcattacattcaaggagaaaataagagggtccataaagggcattaataacaaataccccaagccgttgagctaagactatgtggaatcctaatagttttttccgtaatctccaactatatttaaaataatgcccttctaaatagctctgtaaagagcctattggaagctgcacatttaaaaatggcaatagcactgcaatatgctgtagcatgatgcctgtcagccatgttccagacaattccttgtaagtcatctttcatttaagtaaaaaacaggttatgaagtactgcctcccagaccggaagtgccattctaaaaactccactatatatatcctggagccataaaactgcctattgggaggctaaatgctctgcttttctataaaacagagataaggttctagaggaagtactgttaccagaaacaaggcacgtttcttctctgcctaggaatgctcatctggggacagagggaaggttcaatgaaaaggaacttatattaacaagtcctactacatgatgcaacccatttcaaatgactcctctcattttgatcttcaggaataactgatctctgggcattgatttcacagatgaagtctactattgttttggtagtatttaaaattgggatctcaagtttcaaattgatcatcattgggcttttcatgtgtatagaacaccttcactctgcataatcctacataacaacattcttgtcttctagtacatgaaaaaattggggtaacatagcatttaaagtagttatcagggaaaagtctatactgaagtgaaccctacactgttattcaagttgccttaacacattataagctattattctaaatagctttaacagattattgtggtcacactgtattactaatagttaatttaaaggcagactcagcatgttttaaactcctttaagttacatcttcagaaagtcctgaagtccttcagtattaggtcagctaagggaagatatatttttaaaaatagtgataagactatcactaatatcatactcatcctgtaatatgtaaacacagttctgttgttactggcagaaaaattggaatacccagcattaagtgagagaagtcagcctacttttatgatgaagctactgggatttatttgaactattatttttgttagatagtataaaaatgttctaagtgcctatttttctcattccccttttaaaaatgtaatgctaaaatttctagaagtgttgtaaacacggaatacaaaaaaactatgattgattactcaaactctccttccttcttagtaaggaaaattaaaattccctttggctttctaatttacttgttctactaggtacactaacaaaactacttctggctgggcgcggtggctcacgcctgtatcccagcactttgggaggccgaggcgggaggatcacaaggtcaggagatctagaccatcctggctaacacggtgaaagcccgtctatactaaaaatacaaaaaattagctgggcgtggtggcgggtgcctgtagtcccagctacttggaaggctgaggcagaagaatggtgtgaacccaggaggcggagcttgcagtgagcggacattgcgccactgcactccagcctgggcaacagagcaagactcggtctcaaaacaaaacaaaacaaaacaaaaaaactacttatgtggaatattaaatgctaagaggaaaaggaatggtgattactggttgcaaaatacccaaatgtcctcttgttttaaagcaacacgatgaaattaaagccctgatgattagaaagttgaagtatatggggaagagggaatcactgaaaattttgtgccatcatttagctaagtctgatggaacactgaaaagtttcatgtgaacgtttctgggtaact

SEQ ID NO: 14095 - DNA, 19480 bp, Human
aatcatgtcatctgcaaacagggacaatttgacttcctcttttcctaattgaatgccctttatttccttctcttgcctgattgcccaggccagaacttccaacactgttgaataggagtggtgagagagggcatccctgtctcgtgacagttttcaaagggagtgcttccagtttttgtccattcggtatgatactggctgtgggtttgtcataaatagcccttattattttgagatatgtctcatcaatcccgaatttattgagagtttttagcatgaagggctattgaattttgtcaaaggccttttctgcatcttttgagataaccatgtggtttttgtccttggttctgtttatatgctgtattacgtttattgatttttgtatgttgaaccagccttgcatcccagggatgaagcccacttgatcatggtggataagctttttgatgtgctgctggatttggtttgccagtattttattgaggatttttgcatcgatgttcatcagggatattggtctaaaattctttttctgttgtgtctctgccaggcattgatatcaggatgatgatggcctcataaaatgagttagggaggatttcctctttttctattgattggaatagtttcagaaggaatggtaccagctcctccttgtacctctggtagaattcggctgtgaatccatctggtcctggccttttttttggttggtaggtatagcttgattttgagttaggagtaaaataaatcagttttcctgggtacacttctgggaaaagacaaaaccaaggtactgtaatacagctgatgcttgtctcagcctcttaaatgaatcacagtgaataggaaacactagtaagttgttgaaattgatgtgatgtagtcagtaaggaagacactaactaaagagaactttaatatggaaaagtacatctcttctgatccccaatctgaaattaaccagtctgaaatgtgtgttaacccagaataatgcccttttcatatgactgtgaaaaggctgtaaatatcattactatttttttatttcctaaaatatatagtatgattcttttcctgtaaaaaagcaaagtcgcagtcaacaacaatttttaaaaaccctctctattacagatattttcctcaggatatagtatttttctacattgtataatgatagttaacataaaggaacagagtctgggataggagagaggcattttcatttctttcctttatttacttttaaaaaacaggaaatcagaggtatggcataattttccaaaatcttttaaaattaaaattaatgaataaatattacttctaattagtcaatgttataatttgttaaataaatactatcacaaccaatatgcctaaaagaaagcaaacaaaaaattgtctgctgtagcttaaatatcaccaaaacacataggacagttggatatccttctttgaaaaaaagatcagagcatatacagtataagttaatccataaagcagatagtcacaataaataatagaggacaagctgcattttaaaaggtaaataaatgatgaattcttttaatggcctggtacactgatagaaattggaacgtttctaagaccctattttgtccccaggatttccattataggaattgaatttttcaaaagatatacagagaattttattaatatgttcctgtcaaattatcccttcaacataaaatcatgtttttataatagccataaatttggaaatttttgtattttaatttgcaataatgccactttatttcttgtgtaatctgttatcatagcatgaatcactccctgttgaaaattctcagaatttcctgggaaaggaattggacagaaaattagtttcctatttgggagaattcttagaatttaaataaacctattggttgaactgaaaccacaaaattagcattttctaattaccacatttaaatagcgtaaagcaaagagatcggccatcatcttggtcatcaacacaacttgcttctctccagacttgggcttaaggtactgcgtttacatacagcaaaattgctatcattttacattatctaatctctttcttccactgtttactaagtatatttgtaccatttccatatgtttgcaaatattaaaacttcttatgattttctggcaccttaaaaatccttttgcaaattctgataccattttacagctttaggtgatgaatcaatacagttttataaaaataccaaatcattttttgataattttgtaactaaaatatatttttaaagttgatacataatttcagtagaggcttggggtaagctaatttaaattatttttacctaattctatgagaagttgttatgcaaataatttcttatttttgtaattaccatagcaaaaaccatttctagcagaatagttcaaggccatttttgtttcatgtcatttgggcaacaaaattaactctacaatgtgaatatctattatagataattagctattgatggctactttgtaatgattattaaatttagatattcagaaagacacaaatagtaaatttatttgggttcaaaaatatgccttttttattaacacatttagattctaaaatttgtagactgaagcaatatatataaatgtcagcatttgtatgttgattaaggtgtgaacaaatagtatgtgtgacctgattttttttctaatgatttctctggaaaccattttcccagtacatgtggatgtccatatttcggggttcttgcaatttaatgaaactctggaaatcaaatataagacatgtcaatattttgattctatccaattcaatcatctttatatatttatgtcatgaatattccaatgtagcaaaacacgaagttatggctagattctttatttaaaaattgaaagagatcaatagcttttacataacgtgcagacaggatttttcatgaagactctaaaagaaaagaatgctctcaaatagatttaaaagagaagctcattttcaaaacttttcaataaaattaaattccagttctcagtggatttaactttattgcccactttagaaaatctgatttgtcatctaggaggaaaagtgttttcttttttcaattgtatttcaatattagcacttctttatttctctaagccatattattacattaagaacaaaatgttatgttttaaagtgttagtgaagaaaaatgtttgtaagaaattagtatttctaaataatataagaactaagaaaaataactagaatggtaaacattgatattgagtagtaaagtttttaaaatcttaagtttataaaaattcacattacagctcctcaaatcagcctacttttatcataatttgctcctttgttgaaaaatcaagaatttttttcaggaaacaaatttaacgtaataatatctaactctttcttttttgttctcttacataggctctgataaccatgaggcttctcattctcacctgtcttgtggctgttgctcttgccaggcctgtaagttcagtagagaatttagaaagtcttagactcttgttagaaatgacctgacacttcatcaaacataggatacccagagaaataatcttaaagcactggatgatctctaattggcctctgaagtcttgacaatagaaatgcagtaatgcttcacattttcatcattattgcatagtccactgagagccttaactctgaataaaatgtctgacttgaattataagcaccccacaataaaaaagagctaaaaatttaaaagtaagaaaaagaataaggtaatgcacaacataataaatagcaacaaacaatgtgattaggcctgttccttgagtctactacaaaattctcatatttctaaaaatgtaatagttgtccaacatttctttaccaaatataacacaaagccacatgttccaatgtatcctacttttggaatcaaaatcaaacccttatttgagatggcttgtgtcaacttttcttcccccaagaagggatagaaaactagggtgattcagctaattgagtgatcaatttattgtggtcactgtagacaatgaaaccagataatgtgaattaaaattacctttcttctcaaaaagagtgtttatatcaattagataagtatgtgaaccaaaaagttttctctgttctctcctgttatgtgtagttaatgaatgagaagaataaacaggaatcacctgactggaaaaaacatcagtttagagggatgataagggatatttggacactgaaattatctcatacagaagaaaaatttctgaaatgcagatatagcctgtcatttacactgacagacttgttctctaaattctcctttggaaagtgcagaatcaggaattgtcaacttctgaaccaatagtctttgtttatgctataaactaagcatcaatagaaagaaatctctgcttgcaagttaccaaaacaatgataaaacttcctcaggaatgaactgtctgagcagttcttatcttgtcattctaccaggaagtggggaaaagcagcccagaaaatagatgttacacttttattccaaagcaaacaatagggttctttatttgtttatgtcactgtttaacgtggtcttgtctccacactcaaaatgcagaatgagatcaattttcgtataatttaagtgatgataaaaataaaacccagaaagcgtttgaattaggaaattatattttgcccaacattttttatactagtttaaaatcatctttagaactatggtgtaatatatatagttcagaaaactaaataaattgtttattattctggattcaaactaacccagaatttttacttttttaaagatgttttacatagttttctcaactaccagccataatctaaagaaaggaaatgattattttcctttgatatttgtctaaaaataattatgatttctttttttttccctgtagtcccagagaaacttggtctctgacaaatattgctattaaaacacataccttttgaaaatggcagtgtcaaaaatcatcgtattatatgtgtattattatattgttattgtcattttagttactttttgttttacaattcttgcattgtttttcacagaaacttcctcttagatacccagaacgccttcaggtaaatattctattctgcattccaagaactcactctaattgtgaagcacaaactccaaatgtgcgcttcccttctctatgaaacagcctgcttcacttttgctgacgcatcatttctttagttcaagcactgtcagatggtatttgctctcacaaaacttagaggacggcacactgacttagataaacatttatgttaataaaaatcttatttttattccagagaaatagttaattaaacagaatgtgttaacatgtttattttaatgtattcttgcttttttcaatgttacacatattcaagcatgtgatttacagtttggtctcatttgatatgttgaatcttgaattagttacctctaccacaactttctatgagcacaactaatcctacattctgtcctgcaattggaataataccatttaaaaattattattttttacagaatccatcagagagcagtgaggtaagctctgtttatggggagtcaggattctctcttccttttgctctctttcagttagctgtcatgcatgttgaatgtcttcttctttacaatttttatttcccttcaaatgcatccaacaactcaagtacctggattgctctctaaattctgttttgatgaaattcctatttgacttcttagccattttggtaagcatagacttattaaatttactggcctggtgaagaaggaactaattaaggtgtaggtgttctttagattgtaaaattagatcataaaactaaaactaattatttgttcttctagctaagaaatctgttggtttaccgaattaaatggagcatttgtgttcaaatgagaataatgtggttttttggtgtttttattatttttataattcacaatttaatttcaataagaaattatcaaagaaggaaagtttctcaggcttcttctggtaagtgttatccacttattcttaaaagaagaaacatacttttatgggaaaaattatttaatttttgtttataaaaatgtttttttcactgggtgctgtggctcacacctgtaatcccaacactttgggaggctgaggcaggaggattgcttgagcccaggaattcgagatgagcctaagcaacataaccaaaccccgtctctacaaaaaaaattttgaaaaaaaaaaaaatagtcggatgtggtggcatgcacttgtggttccagctacttgggaagctgaggtgtgagggtcacttgagcatgggcggttaaagctgcaatgagtcgtgatagcacaagggcaacagagcaagaaattgccttaaaacaaagtggttttttgttgttgttgttgtttaacctaagttaatcaacccttcccttcattcagtcatccaaacacccagaaagaatataaaaacaagatatgtatatgttaaagagctgctttatattttaatttgtacctaaacgtttgcctctccaaaacactctgctctcctttccgtgacgtatgtagaggtttacaatttcctcactccttataatagaatgctcttaactataaataatacatatgtgtcacattctctataatttttgacttaattgttgaatagaagaacataacgttttaattcaaggacattatctaaatgatttgatagataactcaactatgaatgaattttaacataacttttttttttgtagcctataccattagaatcaagagaggtaagaatgactccacagaatttaccgtgcaattaacaaagagaagtaagtgttaagatcaggagactcagaacagtgcctaaaacaaagtgaaagtcaaggataacaaatttgagtggaacaaacttaaaaatattgttaaatgcacatttacatactagccttacacaaagaaggagtagggaaacaccacttaaaggttagaaatgatacaataaggaatattagttcatttgtgaaaaataaatttatttctaaatttgtatcagcactaatgaattctgctgagaattctgaagactactgatttgattgacttaattgtgtagtgagaaagaccacttaaggttagaaatgatataataaggaatattagttcattcaggaaaaatggatttatttttaaatttgtatcagcacgatgtgaagtacagtttctcatagatttccactcatgtatgtcttgtttcactaatattgtttatgttttcttttttatccctaaggaatacatgaatggtatgaacagggtaagaaacatcaatgaaatttaaattatgttaaaagtttgttttcatgaaaacatattttacaaggtacactttattgattttagcagagaaacattctgagagaaaaacagactgatgaaatcaaggtaccaaagtttttcttgaaagagtatggcaaaagtatatattcttgtagtagaaaaaaagttttcctttaggaaaaaaaagcatttttctatggttttgtcctttccttgaacttttcactcatacatttgtagtgactaatggagtctgctgagaattctgaagaaaatgatttcattgacttaattgtgcaactgtgatgaaacaaggcattagtgtgaatgaatgaaataacaaataaacaaataaatgcaattatgtattcacatttatcaccaaaattaaaggaatgctttatcaagggtattatatgaagtaatacaatatctggctcaagaatatttacatagtcatactcaattattttctttaaccataacatctttgatttggattgtctactagttttctagtagaattggtattgagagagcaggtgctcaaactttatgagataaaatatatatcttcttaacaatctgtcatacctaactgattgactgtcttggcaggatactaggaatgagtctactcaggtgagaccctttgttttaaaattattaaaccaatatgaggaaaagaaacaatacatatttccccaaataaattattattttaaataaaaactatggcagataactctaattcaaagaaagaaaagaaatagtgtatcatacattggccagaataaccaaaccaacacaaatattttaaatttaaattctatggataatgtcactgatctctgtattgctgtagtcgtgaaaactgagcaaaacatactagatggagcaagttcttttgcttaggtatttacacaccattaaatcagtgctctcctttagtccagttgtatttactgcatgagcttcagtgcagtgtcctgctcagagtccagaagccaagttttaaaagagggaaagcaaaaagtcatgctggataaaggaaaatgtaaacttgttttcactgatttgctacaatatagaagaatccgaaacgttttatttaaacttcaaaatgcagattcatttggctcagagataaagtaggcagattttttagtttttcttattacttttatattgtctcagttttctattttctttgacatccattttatttggtaatcattacttttgtatttgactatttgtcatgaaaaatgaaattgattattttttctttcttaagaactgtgttgtggcagagcctgaggtaagacccattcattctagtgaactctacacttacgtatcaaacatagtatatgcagcatgcttcattttaaaaagactgtcttctgaaattaagcaaaataagaaactgaattttaaaatgttaacattttaattttaaattaatcctattctaattttaacttattgaacttctcaaacaggaatattatactcaagaatgtacaatgttgtgctagataaagttgaaattggaagacggaatttaagccatttaaataataattagtaaaaaaatgcttattcattaaaatataaaataaaaacaaaaggtgcatggatgtttaaaatgagagtcccacagaacactgactctgacatcccagggcatgagattacttttttattttagatacaggtgcatgtatgtatgtaagatttttacatgagtatgttagacacaggtagtgagcatactacccaacaggtataggttggtgcaaaagttattgtgctttttaccattaaaaataatggcaatactattaggttggtgcaaaagtaattgcagtttttacagcgtaatggcaaaaacctcaattacttttgcaccaacttaatagtttgtcaacccacgcccctctccctctccttgggcagaaagaatctatggcagcaattacctaggatcagtgagctatactacctactctacaattatatttttttaaatgctgacttattacatatggttaatcaaccatccccagagataaagtctgttgaatattaaaattaatctgttaaaatatgtatgtatttggaaagtaaaattatatgtatatataaatataaacataaatgactttgaagaaaaagtaaatatttcaaagtaaatattttaaaatctaatgtaattttaatttcatcttaagattgtgcattgtatttaatgtttccattttattcacatcaaagaagccccaaggacagatgagaacagatgtttaacccagggttctgggtacccagctaaatatggttctttcttagaggtttcatttttgtcacaaaaatctatgcaaattttgcattctactcaatgataaacttgtgtttgttttcctaaattaaaaacaattgtttttaagtttttatgttcccagataagttattaaacctaccaccataatttttcaagtaaaattcacactccaagaaaatacaatgtagtacgcctgaatttttccataccacttattcagttataatgttaccatggtaagcatttcaccatgatgacatggaactagtttccttcaaattctaaaaatcccaggggataattaacactagatttctttcttttagaagatggaatccagcatcagttcatcgagtgaggtaaataattttgatattaattctgtgtcccaactaatttaaaaaattatgaaaacttgtaccgtgaggattacatatcccttaaggtctcattgtacaaggcagtgtatatgtggcactattctagttttagtatgtgagtagctatccaaaagaagtaagaaagcaattgtttgtcagagacaaattgacaaaattatttctgggcaaacaatcttatctggccatctgtgatgtccaaattatttttttaaccaattactttgtccttcgcagattttgttaaaactcaatcttatcattaaaaattctaacaattaccatgcttataaacccatgaagtaaacatttcataaaccatttagaatttaaccaattctagattaatcagacactggactcctccagctactctccactctttgccctgtgttaatcttgagaaaaaaagtcagcctacaaaaaaagtggtgcggtttttcctttgactttggaagaagaccttcatgcaagttaccaaaataaaaccaactcacttaagtggggtttctgttaattgaataaaaatcattacttcacatccacccccagcattcggagcaatgtagtggttaaagcagtgagaaaaggaaaagcaatgtgattataatatgtggttcaaattattaatcttgtctcagttttttgggaatttatcactaaaatcaattcactgcaattatttagtaatagttttgttgattcatattttaactttaaatgtaaattaatgtcgtgaaattaaaactatgcatgttttaatttttttaaaggaaatgtctctcagtaagtgtgcggtaagacatatttgctaaatttaaaatatattaatattttccaggataattaaaatgcacttactttctcacacacacacacacacacacacacacacacacacacgggaaaacatgctataccaatgccatctggaaaggtggcattaaagttttatcaaaggcaaataaatataccaaggaatgagtgagaatgttgtattaataaattatttatccttttcaatatctgctagactttattgtaactagtctgatgggatctagatgttttcttattccccctctaaaaataaagctagcgactttttttatcccagttatctaattcacagttttagttgaatatttgtaatttatagtctccttttgaatctacataacatagtatttaagtggcagtctatagatctggttacacttgagttcaactcatagctctaccttttacacgtatgtgatgttgaaccgttcactttcccagtataagtctataacttaatcctaaaatggcaataataataaatattagatgatgtaaagcaattaatgtaatccatgacacagagcaaactgtcaataaatgttggatagcatttgaaaaattatttttccctgtccatttaatattctaatataatttggccaaagttaaatcttcacagtcagaaaacaaaaaaacagttttaactttcttaataattctgatatattgtaactaaaattggctgtactaatttatatcagacagaattataatttaaattcaagaagttgctttttaaaatgtttttaaaagggaataatggaagagatccaaattatttggggtagaaatggcactcaggtgtaatagttcctcattctctacccttgggaaagagcattgttagattcttgtttcatcatatgaaaatgatggggttggactgaatgacatccaagcaattgagaatatttttctttttaaataggaacagttttgtagactgaacgaatacaaccaacttcagctggtaatattttattcattataatacaaaatcatattctactatagaattaaaacatattaaattttaaattggggccatttctaaatatatttttatttttcttaagaaattatttattctagccttgaccaataattggcaagttatttgtatgattgccggcatatttgcgggcaatgctcattctctttattcctggactaaagttctatatattatccatacttactaaccagggagaaagtgactacattctactgcaaatccacttttaacctccctgatgatacattatgtcctggttgagaatttcacaaatatgcttacctgtgaaatcacagatatgtcaaataaactttccatttaaggaaacaggatagattctgggaaaggaaacaggaatgctaaacatcagatttgcttctgtcaaaactcacataatctgcttaacactggttttgacccttttgagtaacataaaagtctttcttttgggaggacaataaaaacctttcagtaactacaaacaaatttgacgtaatgaaggctttgggaaatgcttggttttagttcagcaaaattgcatgctagcatttttaatcgttatcaatagaggaagatgaaaatcagtaatgaatttaatatggaccctaattgttactctagtttccattttcaggtaacttgtgtttaaaatagtatccaaataaatttaaacacattagtaccccaatagaattcatcattattgatctagaaaattacctgaataatatattttagtaccatagatatgatatggctagtctgtaacctccacaactgttagaacctacttgtcctcctgagagattttgtagtattttacagtggtatctccagtatttaacattgtccctgaacaaatgaaggtacccagcaaatgtttcttattaatgagtaaataaaatgaaaatactaaaacagaatgttttctcctccctagcaagctgcccatgcccaggtgagattatttattaaatctaaaatattttagtatttccttcatgtgttatgtttttataatgcatgattctcttttaacataaatatattctgagagagtgttctaccaacactatctgataatattttacttaaaagtcacaaaagacaaaatttaaataattaataaatagccataaatagaaaaatatgtagtcctagagaaatggtaggttattatttttcctcagagtatgaaccttactaattgtttatttttccaaactatagtgagcttagcctttagctaaaatttttttctgacattagaaaataaaaagtgttttgacattttttgctaactgtggcatagaatacagtctattctaaatttcatgaatgatgttatgtatacttctggtgcaatgtaagataaatgtgttgtaccagaagatgtctaagtaatttagaatgtgtttccttttatgcaggagcaaattcgcagaatgaatgaaaacagccatgtccaagtggtaatattttgcttaatatattacaaaacgataatattttgttaagcttaaatatgtttgctcttaaatagccccctactcttgaagagatttttttcttctcaaacatttctcactcccaacttaaatctcagttctgacaacttctaagcatatgaccttgagcacattgtgtattctcttggacctttggtttctcatttgtggagaaaaacaatatgtgtctatcaatttatttcctcctccaaaactcccatgtcttgatgtttacagtgacatattgtgtcttcacatttaaagataataactgtatgtttaattcagtgtctcttgtccattaatgattcaatttatgtacaacatgctaattaaaaaaaaaaaaaccatgtaaagaaagccatggaacatcctccgcaactagagaaagaaacttttagttcctcacagtacatcaaattttaccctcagttttttttttctgaaattctgtaatcactgtcactggctaaagtaaaaagaaaataaaggcaagtattctcttcatttgggccccaaagaattacttggtcttaattttccatgtgaatattattattattattattattattattattagacagattctcacactgttgctgagctggagtgcagtggcacaatctcaggtccctgcaacctctgcctcccgggttctagtgatgctcataccttagcatcccaaagtaggtgggattaccggcaagcatcacgatgcccagctaatttttgtatttttagtagagacaggttttcaccatgttggccaggttggtctcaaactcctgacctcaagtgatccactcgccttggcctcccaaagtgctgggattacaggcatgacctattacttcaatgtaattatttttaaaaaaagtgtgacaactatatatgcatttttcatattaatgagggtttggagtagcaataatttgccctatcctcatgttcagttggatgtaaattactaaactagtgccttagtttgttttgtgctgctatagcggaataccacagactaagtaatttataatgaacagaaatttatttggttaacagttgtggaggctgtaagtccaagattgagaggccaacatctgtcaagctagggccttcttgtttcatcatcccatggtggaagagcaaaaaagaatacacaagagagggtcaaactcagtcaaaacaaactcacccttgcaacagtaagcccactcctatgataatagcattaattaatttgtgagagcagagcccttgtgaactaatcagttcttcaaagtcccacttctcatcactgttgtattgcatgttaagtttccaacatatgatctttgggaaacacattcaaatcatagacacttatttctgtctgtctgtctgtctctctctctctctctctcggtctctctattaagaacagggccagttctatcttgaggtagttaccttattttatcttaaaaaattctagattttatatttgttttaatctttacataggcaggtgtccacagcaacattttaaatgcttttaaagattttcctaattccagcaaagaacttccacctgaatatgtagagaattatatgcaactgtttctatgaacaatgcaattattagtacacagaaaaaattaagtgtaatctcattatgaatcaacagaagcaactattccaaaattatagaaaggaaaatagttttggccccaaaactctagtgtttgaaaagaacagtggcctaggaattaaagaattattatttttttctgttcctggcatttctgaaagacagctatgttgaccctgggtgcggggcctgtactttgaccccagtggctttaaggaaaattatatatctaaatggcaaaaattcccttgagtttataacgtaaataataatgaaatgtatgctactactctcttctgggctctgataagtggacctgtgagtaatgtgggttcttggagttcagttttaaataatgtccttaaaaaaagtgatttattcattgcccctcaggtgtcttaaaagagcaccttctgaaagtttcttcaacatggttcaccatagaagattttgatttattcttttccctcacagagtaatcattttttatcatgctaacaggcatcttggaaatgaatgagatgtattgatatttttcagggactgaaaaaagcaattgctcatacactgttgcttttcaaatgtttttccctctagcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtggtaagttcatttaaattactacatcttgatgttctaccaaaggaatgaaatagaatagcttggagaggataccataagaacagatttagattaaacatggcaaatcaatgcctactgcaaaggactaatatgttctgaaatggaaaattgataatattttgtgggacctgtggctaatattatcaatttcttagtaacatgtggaacagtattatctattctataagtgatatttattctaatgagcctggaaaataacttcttttcaagttaaaaatataaagacttctgacatgtaattcaacattatcctttttgcgcttttactaatctttaaatgacttccttctggttatacctaggataagtataaaaacactgggtaggtaatatagcacatattttggtgttcagtagtcctaaattcaaatcctaacctttttgcttacttgaaattttataataatccttatttattataatcctgagggtgatcaaatatagtaatctctgttaagtatattgtgggcaaaataaacactgaataggtaaaagtccattttttcctgatttagcaaatctttattaatgacttcctttaatcacatgattttaacaattttcattatttcggaagaattaagtaaattctcaaggaactccacagttagggcccttggtaagtttggaaattatgtatctaaccattgatcttattttttatggtcaaatagacatccttaacaagtcacatagataaataaagtgttagtctgtcaacaccacttaaaaaggtctataagttcaattattttcaccactacattggagcttccaattgtgtgtgtgtgtgtgtgtttccttttccagtggtggaaacttcccttctaatacattaaaccaaggaaaatgaccaaattttaacctatgtgaaagccttttattctaattgcattgccatatcttcagtaataccacaaaacaaaatacaatttagtaataaaaatgtctttgtagcttaaaaaccaagagcaatggataggtatgtcagtaacaggaaagcataaataacattgtgagcctgtctaatacgaagagaaaatagtaaaacgtgttctaccataagagcttttcttttcttcaaaaatatttaatataactcaccacatatttctatttctatttacagatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaattacactttaaggcaaaagccgtattttctgtcatcattccattcaacagtatttacataatcatcttaagagtctttgcatgtaacatttgttttcattaaattaaaatccatattttctgtcattattccatcaccagtatttacataatcctattaatagtgtcatgtatgtaacattttgttttcattaattttttatgacaatttcaatcacattttagtgaagaattgtagaactgttcacttctggatggcactagcagccagatcataaaaggcatttataaacttgtccaatatctttaatttatagtcagtggtttgtagaacattttccatgaggacattgtcagagctgcagagaggaacaacagtgtggcagttgtgggcacactagagtttgagcaacctgactatacagtttacttatgccatctggacctgtttgagtccaatccggttgattatacctaagtttatagctagagaaatagataatagtcattaaaagatcagctcaggaacacagtaacctggtgtccttcagagctgaagtaggagctatttctctaaataaaaatagttacttgttctgatattttcaaagccccaggtgagatttacctgtcaaggtttactccaaacttcccacaccaaccaatctgtcatgatcctttaatgacccattggatccaccagatcataacacacaagtgaaaaagcttctcaccccatggcctagaccatctagatagacattagatgctcagtattctaccaaatttatatacattagtatcctactacatatatagagagaatataaaatgataatatattctatataaagggatagaatattcagaacactgttttatgtatgtgtgattttatgtatatataaaatccaatattttatgacttaaaaatctaaagaaaccaatttagcattgggtcctctgccttctccctatgttaggaagtacaaggagaaacaacttgttttctgatccagagaaagcctgtgaaaatactgagacttctgggcctgcaggaaattaatggaggaggcaggctcctgcatcttcataaaatatatctctgcaaaggccaaataagaaaacagaataatattataatatgattcatcacactgctttattttagtctttaacattcatggcagtactgcttttgatttattcttttattatagaaagagacatgataatgatttctagtcagtctttttttgacctccttactgcatacagcagtgaggcaatacagggattagttcactttatatgtatttaaactacacactagggccaggcacagtagctcacacctgtaatcccagcagtttgggagaccgaggcagcctggctaaaatggggaaaccccatctctactaaaaccacaaaaattagctgggtgtggtggtaggtgcctgtaatcccaggtagttgggagggtgaggaaggagaatcgcttcaacccaggatacacagtttgcagtaagccaagatcacgccattgcactccagtctgggcagtaagagtgaaactctatctcaataaataaataaataaataaataaaaataaaaataaactgtagtctttaaactgggaacttaccatgaatggcttagtctgtcactgggcgacaaaagaggcaaactctgttggcaacaccatctattacctggcttaaagaaatccccacatgaagaccagatcatcgagacattattcattccaaggaatttgtgataagatagagcatggattcaagtatctgtaagaagatcagatagttccctttcttcaaataaatatccagaacttataggctcatggtaaggaccaggattagatacatgatgttataataggatccttcctgtagatctttgatttttctcttcattcaaggaatttgaattcataaacttcttcttatttagaaactgggaggtgagaagggtcattactttttttgataca

SEQ ID NO: 14096 - DNA, 15229 bp, Human
tggctttctccaaagggtgtcatgaggattcaatgagatagtaatgcctgattaaatgagatattagtctatgagaggaccgaacacagagctttgaatgtaggaagtgatgaataagaaacataagggctacattgatgagtacttgtcagattctgtcatccagtcctagcaccatgctaaggcagaggcagacttcctggaaatggggcatcctatgagattggtttgcaggcagattgggctttctcaggagcaaaaaacaagcaggcggtcactgaccagctcctgaccattctgggccaactgctgcagaaggtgtggtttggcttccaggctggttgctgcagaatttgtgggtcagtgctctgttgtcacataggggctggccactgtctgtgtgtgcagtcagcctctcaccccgatacagaactcaccccctctgctccgtctgtaacagcatcctccgagatccttttctcatctcttgctacagattccaaaggagtccaaatttcgactgacaaccaagttctttggaaccttcctacctgaggtatggaagaccttgctttcctttagtgagccccgggggttctgggaggacagggctttgctgagtggatgatgagagccctccacccaacataacacacacaagatccagaaacaacccagcatgaaagggtggaaatagcttcatccacagaacagagaaaagctccaagcgcccagttgaccaggtgtgggagtagatgctggcaggaggtggagggagggtctttcatgcaataaattcttattgaatgcccaccatgtgcctggggccctgtgctgggaacccagcagaatagggcacctccctaccctcctggagctcccagaccagtggagagagaaaaatatcatccagatatccaaaacaataacaaaaatagtgtggactgttaccagtgaaaccaacaggtggatgaggttactttagacaaggtggtcaaggacgcctctgtctttatctgctcaggctaccataacaaaatgccacagacctggtggcataaacaacagaatttatttctcatagctctcgagactggaagttcaaggttaaggtgtcagcagatttggtttctagtgagggctctcttcctggcttgtagactgcctccttcttgtgtcctcacagggccttttctcaatgcatgcatggtggcgggtgggagagagctctctggtgtcttttcttataaggacactaattctatcagatcagggcccaactgttatgaactcacttaacctcagttacttcgttagaggcccttctccaaatgcagccacactgggaattagggtttcaacatatgaatttgggaggacacattctgttcatagcagtgtctctggtggtgaaaccccagaaatttctatacagagaagctctggttggggggagaggtgtggctgctaggggtgtccaggagtgttgtcttgaagcttcatttgcataacaatcacattatttttactcagactgtgggtttacctgggggaagatcagagactaagagaaaggggaagaaggtcacaaaggccctccttagttcccccttgaagccactactgctgtctgagaaagtaacatctgcagagacctgaaggaagggaaagagccgagagaagaatgcgaggaaaagtatctaacaatggggaacagagagtgcaaaggattttagatggcaagagagcttgttgagtttggggcacagaaagagttccatgtggccagagatggaagacaagaggcagaggtacatgtggtgaggttggcagggtgccagctggcagactgtgcaatcttaggatttattctaagagcaatgggaagacattgaaggtatttaagtaggggcaggccaaggtaggattcagaaacattttaacagaaactcctcctttcgttgattgtctccactgggggctgcaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatggtaagcagttcctgggttggacagatgaggagccccagacagtcccaacagcactgtctttggagtcaggagaccatgtgaatcctgtctggattcaaacctggactgtgtcactccggagcctgaggcttgagtcactgtactcaatggtgccgactcctggaggtattcattcacccagccattcactagtgcgtttgtttacttattcattcaattattcattcagtcaatttctcattcattcaattattcattccatgttggcttgaaatatgtgtactgttccaattcatccatttatatctttagtcattcaattatgcatttgtgtatttgttcattcattcaattattaattcattcagttatttattagattgttgacttgaaatatgttatacattttctgattcccacttgcactcatttattcaattattcatttacttatacctttgttcaattgatcattcatttgtatatttgttcatttattcgtccatcatttattcattcatgcatatctttgttattcttcaattcacatattttttaatccttcatttgcctcagttttcactccattgttgatttatgcattcatccctttgatcactccatcactccgcaaagatttggtggcacccatatggccactgagggtgtggttcagacactctctgcaccaggaagcacttagaggccttaggcaggtctactgggtctcccaagctgagacctgttattcccactttgcagacagaataggtcctaagaggtcatccaagaccacacagactgcacagaacagctgaggtgggaaccggggacttccttctcatattttttgaatgaattaatgaatgagggattgtgagaatggggctggcctgtcttatgcagcctctccgagagtggcccaagaactctgaaatggtcctggaagtagagagagaaaatggaaattgacagtttaggactcaacagccacaaagccaagggaagtctccccactcctctggctctgtgggcctgaccccacagtgtatgctgccctgctgagccgttgtgaagctgacccttcttggtttggaggccttgcaatcaggtgcctgggtcagggcacttcaccctgggttgttgttttggcagcacacaactggttccatggaggtcagcgccgagtccaacaggcttgttggagagctcaagctggataggtaagtgggcctgtgagaggaggagggggctgcccctctgtccttggtgtctgtgggatgacagtggtcctgtgatatacagaagcactgcattgttgttttcctgttggctcatcacattaaaacctcaaagagtgtgcgatggccacagtatccccattttgcagaccatgaaactcatgctcagagaaaaagtgacttgctcgaggtcacacattgtaggtgaccaaccatctcagcttacccataaatgtcccggttctagcagtgacagtcctgtgttctgggatatggccagtcctcatggctgggaggcgtcagctgatgatccccactgaaccacaacagcatgcagccactgcacgtccctggctttccttgacactaggagatcccgcttcaacttcttctcaccccatccttgggactttaaccaccatcctctgctgggagactctggaatccacatggccctgatttgagtcccagcaagggagtttgtggttaggagtgtggccccaacatgaggctgcctgcgttaaaagtgtggctcaccttggcaagcaccaaaacgctgccaacttcagttctccgactgtcaaataagcccagtaaggccaggcgcggtggctcacgcctgtaatcccagcactgtgggaggctgaggcaggtggatcaactgaggtcaggagtttgagaccagtctggccaacatggtgaaaccctgtctctattaaaaataaaaaattaactgggcatggtcaggtgcctgtaatcccagctactggagaggctgaggcaggggaatggcttgaacctgggaggtggaggttgcagtgagccgagatcgccccattgcactccagcctgggagacagagtgagactctgtctcaaaaaataaaaaataagcccagtaattactttgccaacagcattattgtgagctgaaatgaggtattaatatgtgttgaagtgtttagaacacttccagggatagaataaacactcaatatgcaagagggaaagagaaacagaaatgcagaaagagagaaatacagggccaggcatggtggctcacgcctctctcccagcaccttgggaggccatggtgggaggatcgcctgagcccaatagttcaagactagctggggcaacatagtgagacctcgtctctaccaaaaaaaaaaaaattgttttaattagccaggcatggtggtgcatgcctggggtcccagctactcgagaggctgaggtgggaggatcacttgagcctggcaggtcaaggctgcagtgagccatgttccagccactgtactccagcttgggcaacagagcaagaccctgtctctaaataaataaataaataaataaataaacaaatagatttttaaaagtaaaagaaatacagaaagggagtttcagacatagagaaagagacagagacacagagagtgacactcagagaaggagacagacacaaaggaaggaagggaggggagagatgtagaaaaggaaaggtagagaaagagggagacactcagagaaacagagggagggagtcggggggcagagagaaagagacaccatatgcaagcagatgtgatggccccccgcagttagacctggcacccgcctcttcagcacatttgcgctgttttcacgccgccttgacccacatccctgcccagtcccgccctctccctggcaccaagtcgtccttcttcaccttgagacgagccccagaggtttatgtgctactcatttctcctggcatcatgttgacaagcattactgcttcagaaacgtatagatttaatttctcttaaacacccatgggcctctaaagtaaaggagctggagaggatacagctgggtgtgggctgagcacaggctttctggaatatgcaggggatggggatagggtatgagaatccacggagcagaaatcctggggctactgactcttgaggagcaagggcaagtttttaagctttgtacagtgttggagacaaccaaggctttgccttcaaggagccctgttcgaaaccctgctttattttatttatttttttttagacagagttttgctctgtcacccaggctggtgtgcagtggcatgatctcagctcactgcaacccctgcctcccgggttcaagcaattctcctgcctcagcctcccgtgtagctgggactacaggtgcgcaccaccacacctggctaatttttgtatttttagtagagacatggtttcccatgttggccaggctagtcttgaactcctgacttcaagtgatctgcctgcctcagcctcccaaaagtgctgggattacaggcatgattcaccgtgcctggccaaaactctgctttattatagcctgggcaacatagtgagaccctgtctctacaacaaaatttttaaaaattagctgagcttggtggcatacccctgtaatcccagctacctgggaggctgaggtgggaggatcacctgagcccagggaggttgaggttgcagtgagctgtgattttgctgtgtagtgcagctgtgactacactctagcctgagctagtgagaccccatctcaaagaagaaaaaaaaaagcaaaccgtgctttgctaattgttagctgtgtgaccttggaccattgtttgatctctgagtatgtttcctcatctgtaaaaatgagagtaatggcccttgcctcttgtaatgttactggtattcagtgggatagagcgcccaatacagctaatgaatggttggggttcaataaacagccatatgttccccccttcctctgagatcactgttaaaaatgtcataaaggccttaaagggaaaatagtatattggctcaggtaactgaaaaatccaaggctttcagtcaaggaaagacccaggtgctcaaatgatatccttaggaatctgtctccatctcttggctttgctatcctctgtgctggcttcattgcccagcaggctgtcaccaagtggtggcaaaatagtcaccaggagcttccttattttcccagagaaaagagaataccttattcccaatattcccagcagaagtcctgggactgactttcattgggccagcataggtcagaggtacatccttgcagcaatgactgtagcagaagaagtggactatgccctttggtcagcatggcccagagctcagtgtggggtcaacggcactaacaatgcagggaatgtgtgaattctccaaaggcaacatcggggggctgtgacccgtggaaggggagtggatactgggtgggaaaaccagacagtatccaccagagtgggtctctcctctctagagactgggttctcatgctagtcaggcaattggtggtctcagtcccctcctccccctctcacaggctgctcctggaactgaagcactcaaatattggccccttcccggtgagtctgaggcccttggtggcttcttcctccttctgacctggcggcggggagggggacatgtcataggctcaaggcattatttaagaggctactggctcatttgcatttaatttggttgtgaattaatagttcaaggagcttcgtgggcagagggacctgagccagaatccctgctccatacttactaactgtgaggccttgggcaagtcacttcccttttctgaactccagaccttccccacctgagtgagtgtagtatggtttaaatgggattaaacatgcacaatctggtagagaaaatctgctcaacaaatgtttgttggatgaacaaatgaattactttattgagcacctattatgtgccaagtactcttccaagtatggggtaggctgatgcatcagacagggaagtgatgccttctcagagccttacatggcagtgggaagacagcacaataagaaatgaaaggccaggcatggtggctcatgtccataatcccagcactttgggaggctgaagcaggaggactgcttgaggttaggacttcaagaccagcctgggcaacatagcaagacctcatctcttataaaaaataaaaattaggtgggtgtggtggcatgcacatgtagtcccagatacctgggagtctgaggcaggaggatggcttcagcccgggagttccaggttacacaagctaagatcatgctacactgcactccagcctgtgtgacagagtgaaatcttgtctcaaaaaaaaaaaaaaaaagagagagaagatcgtttcagtcacaatcaaagctataaaaaccaaagcggggatgggcggaaagtgatgagggagaatgaagagtcagaagatgtgatcagggagggcctctccgaggaggtgacgtttggactgaaggaggagaaggagccagcagaggaaacagcaggggcaaaagccctgtggtagagacaagcttggtgcgtttggggaatgaagggagcctgtgtgtctggagcagagcaagtagggggcatcggaagagatgtggccagaggggcaagcacaggctagctcatccagggtcttccgggctgagctagaggaggggagattgttgtgttgcacaggcagtgagaagccggtgcgctgtttccctgcagggagtgctgtgagtctatttatacctttgtaaaagcttcccctggctggggtggggggatagattacagacaaggggtcattgaggaggctggtgtgtttgtccacgtgagatgctggaggttgggactcagccaggcagaagagaaagatggtggattggagatatattttggaagtagatttagagagaccttagtgagagatatgagcctcttttataaagtgcatttaaatatttaatgaatattttgcacaccttcttttgcacccagcaccatactaggcacagtggggtataacatgtggtcaatgtctggcagatttagacacagcacagaagcctccctcatggctgtgtggtgagggaaaggattgtccaggtgacttctagggttttgggtggagcagttggatgaatggcagagctacgtactgacatggagaaagggctggtaggagagggaagagcagggagaaacccagctcaagtaggtggttcgcctgcccaggaatcactgctcatcattaagtagatttgccgctactgccctcacgaggggcattgatgacgagttgcccctgttagtagtaagtagtcgcccatgctgttcaacaccagccacacagagcacctgccctgtgtctaacgtcagaagctgcagtctgctgatcctgtccagcgtcttgctacattgacctgaatctcctggtgggctctggttgaatcccagtttctgctgctctggagaacatttccttagattcccgagatgcccccaagttccccaccaagtgagtgccttgtaagccctccaaccccaaagtcataccgtcccagtgtccccttcaaatctgataaaaatccagccagccatttctaccaaatgagattccaaatgaaaggaccaaatgcaacctcactgtattttcatggacttactggttccaaggctttcttggtggcttgactaagtccataactaatttctacttctgtagaaactagaaattttaagttcccaggattcataggaaggagggcactgcatttggtgaggccagggaataacaggccaggaaaagagactcagttgttccagaaacaaaaatgtatatatttacaaattgtaaatgtcacaactacaggcaagcatcttgagggttttacactatttttaattttttttattattgccaaagaaaaatatatgcactatagggcaatcagaacctacagatttgcaaaagaaagaaaataaaaaccatgcatattttcatcacttagttaataatttggagtatatccttcctgaccttttgctatgcctatttaattaaaaaatggaatgatgtgatttctatagcctggttctcctcactcaaaaacatatcatggttatgtctgtgttgttacttacatttctacaatatcattcttaacagttgcataatatttccttgtattaaagtattaccattttccaccaagtgattcccctattgttggacatggagattgcttttaatttattgttttggataaatttgttgctttggtcaacattcttgcatccacattttttcctacaccctacattatttccttaggataaattcctcagaggcatgtttgctagcccaaaaggcacacgggtcttgctgtgttgcccaggctggtcttgaactcctcctggtctcaagtgatcttctcgcctcagcctcccaaagcactgctgttacagtcatgaaccaccaagcccaaccaggcacacacaggctttggaagaacattgtgccaaatagccgtcaaagaggttgatttgatttgccctcttactgcagtgtctgagaggactcattttttaagctaagcttttcccatttaaatactctctgatgagcttcctcatgattgtcgtgagttgtaaggccttgcaccttacaattgagaacatgctttacatctggaaccattggagcaaaagaaaccacttccatgaccttgattgggctgccaagtattcacatatcacttgcgtccacctctcagcagttttcccaactgcgcggttgctgagcagcgctaggggaaaggagggtgacagaggtggggtgatgaggactgctggacccgcaaggttctggcgatgcagggccatcctcccatcctccctctgatttccaggttgaattgctgcaggatatcatgaactacattgtacccattcttgtgctgcccagggttaacggtaaggaactttgaagaaaccattcattttcagtcatgggggaagagggtggggttgattacccacagccacctgttacctggccccaggtatgagggctgggcagtggtgatgtcaagtgaacttcaaatggcatctgacccagaaatgaatgcaacaaaaaggaactcacatgagttgacttactacacatgggttgattcattattgcgtgagtttgtccttacaaaacccccatgagatgaaggattattaacatctccaacttttatggcaggaagcggaagaacagaatggtttagtgacttaggtcacagagcaggcaagagatggggcatgggtttgatcctagcagtgaaaacaaagcccatggtctctttccaactttggaagcaggatgagggggttccctgataacccctcccagagcttagatcaccacgctggtaagagcttcaggcaggccggcccctgacctttgagagtgaggggcaaaagtactaatagaggcccatataacctgtgactaggatatttagaacttaccaattaatccaacaaattatcatatgaaatatgatacatcagtcctgggatctgtcctcctaccttgacaaatgtagctttgtaatgacctgggaggccacgttctaatttagagttctccaaagttccgtgtcagaatgtggcagtatgtggggggcttgccctggccactgtccacctctggctttatcctaaatgttgaggggtttcatgctcacatgcataaatacccctattacacaccacgctctagtcacaccattgcaagcagcagatttttggtttagtgtataccagcagtgctgcaccctcaggagggccatcatggggatggagtccacgcaggtgctagaagtggacttggggttgatggacaacaggtgggaggtacggactctggggcagccttcctttcaggcatgtatgcccatgccagtccctacctagggccaggcatgctggttcagggaggctgtctacccaggctctctggccctccctcctcccctgcccttctctttcttttctcctggtcctcaccatcggtctctgtcacagagaaactacagaaaggcttccctctcccgacgccggccagagtccagctctacaacgtagtgcttcagcctcaccaggtgagtcccggagtcttttccacaaatctcccctaacgatagtgaccaacagcagcctatggctgcaatgcttcctgcatgccaagccctgtgtgaagcgccttctacccttacaacaactctgggatgtgggtgctgttaaaaaacaaagaaagaccaaggttcagaaaagccacacagtgttaaatgaagtccagattcaaagccaggctcccggctttgaaccatcactgcatcgttcccacgctacactcggcaaaaatgaaatgcatttgtgggccaaagagcctcttttttaaggtgcatttaaatatttaacgaatatatgttgcacaccttttgcacccagcatcatactaggcactgtggggtataacatgtggtcgacgtctggcagatttagacacagcacagaagtctccttcgtggctttcgcccaggctgacttccgtctgcatttgacactgatgcgcttcctgggcatgctttcttctcttagtttccagcactcccctagctcttggttgtctacctgccacctcctctgcttgttctcctgccccttctctgcaagctggagatctccaggacccctccccaggcctcttctcttcccccgccattggcaagccttcgtcactcttgtcaacctcttcaggcttagctgccacctgcgtgccacccaatgtcccagacatgcttccagtctttttattttttccaaactctcagcttgtgcattcgcaggctccctcaatgtctccaccctgaggcctcttaaacccagcatgtccccacaaagctgtcacctccgcagcgaaaccgtcacccagcttgcatttctcaccttggtcaaaggctttcctgataacttgtggccctcctggggagcctcgcatcacccagatccctccctctccctttcccccaatgtccaggccatcaatcctcaattctttagaccagggagctaattaatggggctgagagactgtagaaaaataaccaagagtgcagaggaaacacataccgcatattcctcacattttaccaagttcgtgttttaaaaaaaatgacccatggcacaatttaatttcttcatttctaaaaatcctgagtgaaggacacaaagaagcagagagaagtggttttgcagccttgattggaacaagcactcccttgagctgccatgaggcagggacgacaaatgaaggcctctaaaacagcccggggggtctccgtgtctaagaaggaggcagcttccagggaagctgctgacagattcgcagatgttggcagctgtggatgtgtagatccgggcagcgaaacactgagtgacccccactggccctgcctttctccttcctaagaggcaggctcccaaaatgtccttcttaaaactccagtagctccacactcacaaacaaggggtgcatcttcaactggtgacaacattctcatctctccctagaacttcctgctgttcggtgcagacgttgtctataaatgaaggcaccaggggtgccgggggctgtcagccacacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtggattctgtgtgctggtattgtttcttgttttatgttcatttatttattattcattggctgtaaccaatgtggccggcagtgccagtttacagcacagatacaatcatctctttttatttctataattaatctctggaatccccacagcctccattaacagaaagtctcattgttccaaatgtccttgtgattttcttagtccaaattcctaatgtcacacagagagggtctggagagtgggtcagtccactatgctgttgttctttccactaccacatggtgtggctgttgacccgtcattctgcacagcccattgtcctgtgtagtcacctgtccactaggactgttgctcccgtcactaccacacggtgtcgctgttgaaaagctagcctgcacagcccaccttccctgccccacacttgggctccccgtttcatccatgttctcctgcccagccattgtccccaaaagcagaacaatgggccaggtgacagagtccattggggttttctgcttcagtcacatctttgggtgcaattagcacttccccatgactctcccagctctagtgtggaagccagatcaccaacccagactgtctttggaattctggggagtttccttgggggctttgggccatttcctgccatgggacatcagagggggctatctcagcccatgagatggggttttatggattgtacttcagattgattgaggagtcctggaaggcctttctacactgctgacatgtgctctgagaccataaggatgagcaacaacacactggaggagttcgatgcagacggtggagtgggggaccacatgaccagatttagtttttaaaatgttttattgtgacttctgaaagcatcagaaggacaagagggcaagggatgagcacaaattaggaatgtgttgttattcaagcttcaaccagattggtgatggtaaaattgaagagaagcatttgtagcgagcaaaagcagataaaaggtatttattttatttataaagaaaaatgtacacacttctgctgacatcattgattctctgtcaaatggagttaaaggctctagggccacacaagaagggagggccattgatcaaacactctcaggagtcaagcaaagggcatgaatgatctaatttaatcctgatagcattcttcatcccccaagatggcaattgctcaaacttttttggttgtttgtttttgagacagagtcttgctctgtcacccaggctggagtgcagtggcacgatctcagctcactgcaacctctgactcccaagttcaagcgattctcctgcctcagcctcctgagtagctgggactacaggcatgtgccatcatgcctggctaatttttgtatttttagtagagatgaggtttcatcatgttggccgggcaggtctcaaactcctgacctcaggtcatctacctgcctgggtctcccaaagcgctgggattacaggggtgagccaccgagcccagctgttcaaacattttaaattgagttacccttccctgatcacatagccagcaggtggcagagttggaattcccaccttatctattcccacatgtcagagcccatgctttttttgctcctccccgatgtcaaaatgttgtctgttctgggggacttggcacgtttaaagcagaacttctttgttctgtggcataggttgtacactgtaaaacataggttgtaccaggttgaggaaacaaaagtctttctctaatttgtccaccagtagtatgcatctttttctccactagccaggggctatggaggccctgaatagaacagaagagcagctagcaagggcggaaggaagagagagaagggaagcacagcgtgggatagactgggaggccatgaggactgttaagggctctaggttttgttccaaaagataaggcaagccactggagagttttgagcagaagaatgttacaatccaattcacatttgtaaaagagccctctggctgct
